United States Patent 7,868,149 (PLANT GENOME SEQUENCE AND USES THEREOF) - sequence listing, part 42

SEQ ID NO: 22126 - DNA, 4335 bp, Oryza sativa
gcttcatgcactattatcaccagttcatcgtgtggcatttccaaagaccccatccaatttgcattgtacccgatccatctaaaggtatttcactatgtacctggtatagatgtggacttccacacaaacattcagcgaaaccaccagcaaatccatctgtgcctttaatgaattgacgaacaatgtcccggtactggagaaacaagcacataatataagtcagtgctatgataaaacaacaattacacatataaagtgggaactatgttagatgttggtttaactttagatggatgcagatcatatgttataactccaaagttcagtgtctagctcaaatataagcttagtatactgttgtttcttactttttcataacccatgccctgctaaagaacaaaaggcgtatttatgtattgttagcagtagccctgagaaatagctcaccgttcagttcatgtattatcttctgtgtacatttatgggcagaataatttatgtgtttgcctttgaagtttagtaaaataatgttatgttaaattagacatgtctcatatataacctctatttagtgtatgcaaggaaacatttgtttccttagaaaatcgaatagatcaagatatgcagttgttacctttccattccattctgaccaaattttccagtgaggaaattgacctacttgatagaggcctcccgcatcccatgcttcagcaatgagctataaatgcaaccggatatacgaataagaggatttcacaaggatacaacaacgtgctaattatatcatactccctccatttgatattataagtcccttttgacttttttgtctataaatttgatcaaacctaaagaaatttgacatataaaaaagtcaaaacgacttataatatgaaacagaggtagtacatactattatgatatttggtgtagatattttctttatatcagaacaaaagaattacttgtgtagaaaaataaattcattgccaaaaatatgaatggtaacattactggtatgaatgtactagaaattgtagatgcgcaacaaaagtcagaaaaagtagtaaccttgacatctccaagaattggatcattgctgatcatgtcaataagtggtggagtagcaagaggtgtccctgtcgtagtcatgtcaccttctactggacttccatacacattaactggatcccaaagacttgtaaaagtaacaggaaaaaaataagactcttctggaaagacaaaacacggccaaaataaaataaaataaatgaactgccgtttacctgcatcctctggtcattatggatgcaagatcaaaacgaaaaccatcaacatgcatttctgtcacccagtatctgcaatgtcaaagctattttgtttagaataaagcaaacaaaaataagcacaccaaagatatcatgaaaaatggcctaacaggagattcaagcatattacaacaaacatggcagttctttgatttatttattattaatgagcataaaaaaatgataagatgatgggatatagtttccctgctttattagaatatagaagaatatccaagtgtacatatactcaagcactgaaacatcatcagtatgtgttttgaaaacagaaaaaagcaatttgctggagattaaaagaataaaacccttacaggcttgcaattgaagttcttgacaaaatgataagcagtgagaagagatcaataactgttttactgtgcagtatatatatatatttataactgtaccttaaacaatctacaataaattcacggaccacaggatgattacagttgaaggtattcccacaaccagaataattgtaaactctccctgtaggcacaaacacccttcaaattcttagatagaattacataataaaactgcattatatacatctctgaagaaaaaaaaagaaatgtttccacaatgagcaatataacgcaccttaggggcaagcatatagtatgtgctattatctatccccctaaatgataatattggtcctttctcattaccctcggctgtatgattgaagacaacatccatgatcacctaatagagtatccccacgtaaaaaaatatgttgagaaagcagcaattactaaacaagaattagctatatcaacttggttacctcaattccccgtttgtgagcctctctaacaaaagttttgaattcatttatggcatcacggccacagtttcttatcccacctgatgaatatcttatcattggtgaaaaaaagtttatcgtggagtatccccagaagttcatcctggtaagatagtgagcagtttatatgaaataatataaaaaatgattgaatttctatgaaaatatgaaaaatcataataatgtaaaaacatgtatggatgtacacagtacacatgttacaagaaagtaagtgcgtaactgcaacattccatgcaaatgaagggaaaaaggtaaactgagtttagagatggaaaaaaaaatcacattcaagaatctagacaaagaaaaggctgttatgctgcaactatgcaaaatctatgcatgtggaacctcttataagagtgggagatttgggctatcaattattcaaatgtaatacgatattgatgtgaccaacattaattattgtttacatctcacaaagaaaaactagtttattttatcaacttataaaagtcaagatggtagcgttagcagtaggtcatatctatcatgtctacacaaacaccttatgcaaaatagttgactggatgttaaccaatgcacagtttagaagggggaaatcagttttgcgagagtaagattcgttaggccccattcaaacactgcttatagctcaattctggatgtaagtctgcatacttggaagagcagctgaagtactccagctcattgaattcatggcagggcatcaactctacacagttaactccaagctcctgtagaggggttattccagatttaaattaagaataaacacacaactaaaaatataaacaggctattattacagctattcacttaatggaccactcatgaacaaaataagaaaaaaaatgctgggacactaagtaaatttgtcaatgcatagaccaaattttaagtgttctatcacaaagtacagcataggtcttagaaatactttttttcgccgggaaggtcttagaaatacttgattatggttaagttgtagaataggatatcttcagcaaaagccatgcaaaatctagatgtacgtgaagatcttataaaaaatgaatatgtaacagtcttataaattgctctgtggcccaatagcttcttgaccgaactaggtaattagtaaaatgcaccttcagatagtcaagctttgatatagccccaatgtaagtccctggatgttctacattgcttgaactgtgctttgtaaacccacgtaaatgcatctcatagattacaagatccttctgaggatatctcagaggtaggtcaccttgccaatcaaactgcaaatgcaaacattttactgtgagatttaatatcatagacagtaacaacaacaaattaatgcaattcatttttttacaaggcacataaatgcaattccacttcatagcagcaacgaataaatggaattccttcggaaaaaaaaaaatcatgttcttttccacttgcaaacaaatattattattattattatcaaaattacaatattagaaaaaaagatgcaaatcttagttgtacattcagcaaccagataatcggataatgactgcctcgggtagtcgggtatcagatcaaaagaggataaatggaaacaagtgggagttaaaaaaaaaaggaaactgattcgttggcataccgtactgtacggaagagggatcatgccagccatttgaggccagcaatcgccaccaggaccggggacaccatactctcctcggcttatcactgcctacagtaatagaaaaaaactgcagataagcgcctcccaaaactagtacaatcacaaacataggagaagaacaccaagaaggcaaaatgaagctaatgcatcaccttggcataaggatccaccacgacattggagacatcgaagtactggccgcagtgaggggcgaacataccatcgaacctgtacccgtacagcatgttgtgcagctcgccttcgatgaagacgtgccacacattccccgtccgattgaacagaggatcaagcggaacctcctcagtcacctcatcctgcaccatcccacacaatgcaaaaccacctcaactaatcatcggattaaaaaaaaaacagagccactgaaaacgaaaggagaacttcgcgaggaacgcgtgaca

SEQ ID NO: 22127 - DNA, 13843 bp, Oryza sativa
gcgcaccgtccacttgcacatgcaggtaggcggtgaggctgttgctcttttttcgggatggggcccacgtgcatgggcttttcgtgggggccgcgtgcagtcgcttctagatattttccctttctagattcagaatgtttttttttgtacttttttaatacagattcagatgctctttgtaataataaagtactatttaagagaacattttgtgagcaatgttgaacattcaactgaaacaatttaaactaagggctttgctttttttattaacatttttaacctaccaatttttggtaatgtttaaccttcaactaaaacaatttaaactaaggaatatttactttgttgttatttttaaccctactaaattttggcattaccaaattttaataggacaacaaaccaaactcattattgttattgctatcttaccaaattttgaaaaaacaggaagcttccactctcaaaaactctaccaatttatcccgttacactgacataagtaatgatattgcacggttctgatgtacgagaggtaaatttcatcagtagatagcacgaaaacgcctcatatgacataacttcaattggtataggcacaaccgtagatatagatatttatttgcctttaataaaaattgaacaaaacacagcattagctgtagacatatggccagatgtcacaggtgtgacgtcggtgctgccacatcacattagcatctataccgcacgtgcaagacagggagattaaaaaaaatatcaacaactgggtcaggcttgtaccattatctatatgattctgtttacttacggattactacaactaatcaagttcttttttctattggaattacatgttgattccaacaaccacctctctcctttgttaaaacttctcttagtgtgaaccattccttctaggtgtcgtgtgcttgttttgttttcagtagcaggatcagatgtaggcatgtggtgtggccgtctttttcttctcctaactagtctctcaatgctatagatttgtattttttttcctgctatatcaatagaaacgtcgcactaccgtatggcttgattcgaaaaaaaaaacctgctcttcgtgtgggttgtgctgatggcttgcgtggctgcttgtccatatatgctttcggctgttggtacgtattgcagattgtcgctacgtataactgcactttcggcggatttctttggagtgcagtgcagcgtgtacactgtcgtgtacgcgaagcacgggcaccagccgcaccacgaaaaaacgtgacgccgtagaaggccgtagcaatctgggccgtccacctcgcgcagcccatcttgaaatccagtgcgcggcctgcgtatgcacgtgggccgtgtggccttctccacgctgttcaacagacggcttgggccgagaaaaactagcccatctttgagccttgctaatgggcttggctgtaaagcggcacaggcacaagtaacggcccatgcccatgcaaaagtaacggcacagtgtacagctcctgtgtacaaaatttttctagcaaagggttacgaaagttactacatccttttcaagttaaaaaacattttgactttagtcaaagtcaaattgttttaattataactaagtttatagaaaaaaataatattttcaactcaagacaaattttttgtgaaaatatattcaactattgatttaataaaactaatttgatattataaatattaattactatatttatctataaacttagtcaaaacgtcttatcaccttaaacggaggaagtatttatttagcacttttagatatttgttaaacgctaataggctaaatatacaatgaaatttccaagccatatacatgacacacaagtttctaaaatctatttagtccatctcgagatccgtatatcacttcattgatacttttatacttggttcttaaaaaaatatcaactcgaaattttatgattggatatgagcgcctacatcgtaccgtaagcttttattccgccaacaccacaccatcaccatggatcgtatgtacggatcttttactttttaaggtaaaaagaaagagctttattaattataattataaaaatagcgattatatctctgatacaatagtctaggccggattcctacgggaacacacaatctcatctgtgcaagctcttaagcctcttttgcttcagcaatccttgcttcaattcccaggcatctctcaaagtctcaatggacaacttaaggggcttagacaacttcagtgatatccatatccaatattgttggaatatggatcaattccatcgccactaaaagaccttttagggtgtgtttggataatgaaaaatgtggcatggaattaggattgggaaataaatgaagagttaggattaaatggaagagggataatgaattgttagaatttaaagatgtcttttagtgggtgggaaatcattttcctatcccattagccaaacactcccttaaaccatgatagtgcgttggcctaaactacaacgccacacaaatataaggttctatgtgccgctaatgggcatgttcggctgcaaggtgcagcagctgtaccacagtgttactgctacaactacttacataaagtactgttctggccggctgcaccacagccgtatgagtgcagccgaacaggcccaataacacaaggcctttgcaaactacagtctccattaataattcatgaaccaaggggcagatctagaatattccaagcctagtgctcaataagtttgcttttatcctttttttttagttttgaagtgcaaatttcaatgcgtatttaagctcaggagtacgattgcagccctggctatctctcgccctacctgcccctgcttcacttgcttcttcactactccctccgtttcacaatgtaagactttctagcattacccacatacatatagatgttaatgaatctaaacacatacgtatgtctagattcattagcatctaaatgaatgtgagcaatgctagaaagtcttacattgtgaaacggaggaagtatcttcttaaatgcatcgtcgacatattgttcaagtggattatatgaatttctagaatcttgaaaactattggcggaactccatctcaccacgtgttatattttgaactactaattttggttttccctatggaacttgaaatccctgggcccttgggcaaccctgatggacaaagtacattagggaataggaattgtctaattttcatatgtatattatcttatatagtgaaagcagcaatctttcttacacgagaatacgccacatcgtaaaaaaacatatatcaaccattgaataaagaatttagataaataatagccatgggatcaaaaaggttacatatgcattaaaaaaataacaatgggataaacatataggaatttctggaggtttctagtgccccctcttagacacatggtacaaaaagagggcaaagataacgaagaaaacaaaaactagggggttatagtgatttctataactaaatctatagttagctagaccaatatatactttgtaaataaattaactcgtgctaaaaccttctgtaaactaatagaccgtatacaagttcttatacggaattaaaaatcacgcatcgcgtgactaagtggcttgtttattgaaatctttacaactttttatcgcttttcttgtccttgatggcagccacccctctcatagtctcattttccatgcgaacaaaatattttctctatcgaatgaaaggttgaataatgtaaatgtcctaactcaggcataattaactagacacaaacttaatgcatgtgcttcatatgtgcaccgtcccacaacattttcattagatattctctaatgcatgagagccgcacaatctggtggtacggttttgtacaaacaggctacaagcttcatagagtaccatttctgttaattaactgtataaagtaccagtggtcaacatcttttaaagtttaggccatacatcgattaattgcatggtcaatcacttgaagtccttagtcttacacatatagtactcgatcgttgatccaaatacggtgtacggaccaaggtcggcaacatttcttgatttgcatatggatgtatgtacaagtacacaaaacctgatctaagtaatcaacataaacgaggtcataatctgatcatttcttgcatggaagtatgcacagtggtattctttttttcattatgaccgtttttttcctcgattttcattagcacgctatccaaatcgttaaacggtgtccctgtgtaaaaaacttctatatataagttgctttaaaatatcaaataaacctatttttttaagtctgtaataattaaaagttaataagttatgcactaacatctttctcattttgagtgctttaattttatcttcatcttatcaatctcaaacataactaaactccatctaattaaggaagacgagtgaggtcagaatttgatcagacgataaagtgaggccaaattaaactcaaattaaactcatgggtatatgtcaagtagcaggtatacggccgtggcggccggcacagcctcagttttattggatgagatatacgttgataaggcaacagtggttggatggtactactccctcagcctctcaaacttataggtactagctgtagtagacggcgggtaaatacgtaatcgatgactttcaaaatattaactatagctaatacatagaaaagatatttttaggaaaaagtgactccaatagatttgtcatttaaaatgatttattttttatatgcatgattaaaattaaatgtagaaatgaactgagcgtaccttaactggtaaggtatcttacggggaaatctgtccacccggattcaagtcctcaacttgacatgggtaccgcatgcgtgttcatagagtcgcgcatgtgtatataagcgacgtctgtattgttttctataaaaataaagtatcatatatatgtacatagtacgttgctagaatgctaaagtacttcctggttataaatatttgacattaattagaataagatttaattaaaacttttaattatcaactttatgtaagatttagaagcctcttctactcattttgttgttgtttttatatcagattaagtttataagtctagtaacaaactttatggtactacgatggtattttaaagaaaaatctagctcataccattatttttgttttaaattaataattctcaagtaattaattacggattgtcacggttttaaaagtttaaccaaatcatacacctagttttcacatatcctaattaatcaccttttttgttttcaactataccaaaaatacatatatacgcacacgccacatgcgcacacacacccatgagtatatatccacacacacccatgagtatatcacataacacactcttaaaaagttaaatttggaaaccagtgacaaattccttttcttcactaaattcccatactcatgtcaatgcaatatttatgggcacaagtatttcaaccttggtggaggctcctgcacttatgaattcaccatcacactaccggtgcttcttcccagatcaacgcaggagaactttgttgcatctttcactataaccatatatatcttagaagcctgtgatagaaaatgcatatattcatgctgcactccaaaacagattgatctttccaggaagtgctaggttgacatatgtccactaaaacatgtcaatctgccctgacctaaaagatcaagtatatatatggtatataccgaagatatggaaactctccgtgtaaaaaaattccatgcatatgccattcttatcttctagatatataacactttctgagtaactttgacactcatcaaatgagtgcaacacaccaacaatcaaaatgcaacccatgcacgcgactaacaatatatataggagtacttcatatgttccattttatttgacaccggatactatatataaattaaactttcactgctcgtcttttttaaaatatatatagttatgaacatcgagaaagatatcatgctaaatataatcatactactgttgcattcatcacagcatctcgtaataaaaatcgtgattcaaaatttttttattggtgtaaaaggtaaaaaatcaaattggtcaacgtgtcaaataaaaaagaaacgaagagagtacgagtaacttccacgcactgccggccgttattctaccacgctagctaccaccatttctccattatttttgtgcgtgcatccggcggcggcggccactgcctccctcgtgccaatccaacgaggagatgcaatgcaaattatattgggacaggagatagagagggaaaaaaaggttaagatcaggaggagaagacgaagacgatggcaaagaagaatactacgtacactagctagtttctatcgtgcgctgtgacgaagactaacccaacatatggccggccggccgacatacacagaggcgtggctaaatggctaatggcattttcaggtagacagcgagctcgcttttgttgaggggtttatccagctcatacaacccactatatagaattttttctttttacaatgaaaaaaggcgtttacaattcaaccccactaagaattgctagcctgctcggtgaatatattatatactacacgtacccctttatttgatgttggtaagtttaattttgagctaaccacgagtatattgtaacgagagcattccactaatctgatatgaatgcatatgtgttacatataaagaatactactttgtaaggccgagggtcgatatggtaatatgtattgtcctattctatgcatgtcgatcactttttgaaatctttctaattaaatgtaatttaaaaatcgataataaattacatgtatactttatttcatatctaaacttttttaatatctaaataatactccctttatctatttttaatagtcatatttcatcatggcacacagaccaaggataagtgattctaattatcatccatttaaacatgctactagtcattcctcgtaaacaggcgatttattaatatttatatttctcgatgtccatgcagctaatcttgtgtggaagaatggagagtcacgcattaaattcaagaaaaccattaagatgataagttgttggattgaaatatgcctatcaaaaataaatttttcagatttgaaaatatgtctatcaaaaatagatggagagagtattatggtacagtgggacaacactaaatgcgagtgatttttacaatggaaacatatataattcctgatccctagactaactagaaatacacacagcggaatttatggatattgagatttgaacattgatgagtgtaatcatgcatctacgatttcactaccacaccgaactatgttttcccgaataggtaacaacagattgttatgagtttttgcccattgtggtggcatcgatcagcatggcaattaattaactcatacagtttacctgtcactcgctagctagctcttgaaacattcttcacaacactcggtggggaaccgaatggacatttctgctgcctcagcctgcacgtatgaacccatgatccgcacatgtatatcctgcagcttaatttacaattaaaggggtaggagaatgttggccaaaaggcaaaattttccctttccagggcacttaacagttaacaccttatcagttaacacaagattaattaattaagatttgcatgcaccttacaatacatttcaagcaaaaaggctgacttgtaaagtgatcttgttttattttattttttgggcgtgatagatttatattagaccaaaagcactaatactccctccgttttttttatatatgacgacgtttactttttgggatacgtttgaacattcgccttattcaaaagtttatgtaattatcatttattttattgtgactttatttatatcaaatattttttaagaatgacttaaatatttcatatttttcaaaaaaaatcgaataaaacgaatgatcaaacatcgataaaaagtcaacggcgtcatatattaaaaatggaggtagtatcacactaaacaaatccagatagactcgaaatcttttcctttaccagtaaaaagcttttctgaataaagaaaaccaagaacagaaaaggaaaaaggggaaattgaactaaaatattataacagcactagggagctatctccttcgtcacaactgggcggcaagatgaggtttggtcatctcatcagctgacccctctttttcagttttttcttgaccatttttttaggtcacaattgctttttccctatttctcgtctcgccttcgtggaatttgaatatgtttccaccaaccaaccaaccaaccgtatgtgcagtgtggtgcacattttgtcatctcctaccttttgctctagcttgctagctcatcactatataatctccacatgggagagaaaattaagacagtgcagacgccgaccacctcctcctctctagcttctccgacgacgcactccggcgatcgagcggccggcaaggaagaagaagaagagagagcaggttggagaggtcgtccatggcgtggaaggacagctacttggacctcgtgctgatcccggcggggatcgtgttcccgatcgtctaccacgtctggctgtggcacgtcgtccgccgccgcccgctctcctccaccgtcggcattaacaccgccacccgccgcctctgggtcttgggcatgatgaaggtaccaaccacgtcgatcatggtgttcgatcatggcccggaaatcgattggattaatggattttggaaacgcaggacaacgagaagaaggcggtgctggtggtgcagtcgatgaggaacgtgataatggggtcgacgctgatggcgacgacggccatcctcttctgcaccggcgtcgccgccatcctcagcagcacgtacaccgtcaagaagccgctcagcgacgccgtgttcggcgcccacggcgagtacatgatggcgctcaagtacgtcaccctcctcctcgccttcctcctctccttcctctcccacaccaccgccatctgcaccctcaaccaggccaccttcctcctcaacaccctctcttcctcctcctccttcgccgccgacatcgccgggctgccggtgaccaaggactacgtcgccgacgtgctcgagagaggattcctcctcaacctcgtcggaaaccggctgttctacgccggcgtgccgcttctcctgtggatcttcggcccggtcttggcttgcctctgctccgtcgtcatgatcccgatactgcacagcatcgacgtggtttacgtcgatgggagcagcaagggcgaggccaacgccagagtggagatggtgtacgagagcgatgagagcgtcatgcaagtttgaccaatttcggacacgagtcggactctataacctgcctaccctcacggagaatatgtggtggtgctctcgtctcgtccttcaaactcgatcttgaagaaaaatgcgggcaattcttgatccaacagtgactgcacctgtgttgtgtgtgtcatgtttgtggcttggattgttttgagtattcttattcaagacatgtttagcatggcacggccgggagagtacttggtgctgtaacagagactcactgatcggtcaactgttaacgcacagcaatgtactggttacaactgctgtaatctgtcagaataagatgttctcccccattgattcactatttgtacgtactatcgcaaagtctttttcctcctcgagaggaactcccatcgattttcatttcacttataaaatttaaaaaagtcacaagatatactaatatatgatatatcacaatataaatatataaattcaaattcatcttatataagtataaataaaaataacagataacttgtatataccccctccgtttctaaatattttacactgttgactttttagcacatgtttgaccattcgtctaattcaaaaacttttatgaaacatataaactatatgtatatataaaagtatattgttcaatgaatcaaattataggaaaagaattaataatacttaaatttttcgaataagacgaatgatcaaacatgtttaaaaaagtcaacagcgtcaaatatttagaaacggagggagtatatcattttttttactgggaaacttatttttcacctaagtggacatacacttgttttgtgcattcaactaaaaagctaccatgaaaatttttttaaaaagtaagatatatcaatatgatatatatcattttacaaacatacaattttacaaacatacaagttcaaattctaaaaaaaaaacagacacaaatatgatgatcaaaagtgtgtatcatctatggatgagatttgttatttttatttctactcatataagtttttagttggcatgcacgaattgagtgtatgcccactcgagtgatgaaaccactttcattttcatgtttgtgaataatatacatgtaaaatattgatatatcttaccattgtattttctcattctaaatagctttttaggtgatatgtataaaaggaggagatgtcaagcggaaaaaaatgcctccaacaagtacaaatgatctaagtatcatactccctccattttttaatagatgacgccgttgactttttctcacatgtttgaccattcgtcttattaaaaaattatgcaaatgtataagatataaatcacacttaaaatactatgagtgataaaacaactcataacaaaataaattataattacataaattttttgaataagacgaatggtcaaacatgtgaaaaaaaattaacggtgtccattttcatgtttgtgaataatatacatgtaaaatattgatatatcttaccattgtattttctcattctaaatagctttttaggtgatatgtataaaaggaggagatgtcaagcggaaaaaaaatgcctccaacaagtacaaatgatctaagtatcatactccctccattttttaatagataacaccgttgactttttctcacgtgtttgaccattcgtcttattaaaaaaattatgcaaatgtataagatataaatcacacttaaagtactatgagtgataaaacaactcataacaaaataaattataattacgtaaatttttttgaataagacgaatggtcaaacatgtaaaaaaaaattaacggtgtcttctattaaaaaacagaggtagtatatgtctggttggaagatgcgttcctctccaccagtaaccagctgacacagaggccctatatgtctgtacttcctccaccagtaatttgcattgaaaaagggatattgtagtacaaaattacaggaccttgtaccctaaatcctaccggacacggcagaaaaattggaactgcaaaaaagaggggggaaaaaatcccaaaacagacagaagattgccatggaattgaataaagaagaaccatataggccaaaattctggctaggaaaaacagaacagaactttacagccacagtggcacagcccagggccaaatatgtgggactgcataatatgaaaaaaaaaacaatgtgtgctttataaaattcaaagttgtaaacccctttgcgtttttatgagatttgggcagtactaaatgggttaacgtgaccgttggtgaaaaattaacaacaaagtgataccatctgttcttgattttgttatagtaaatggaagatatctaacattataattttatagagaattgtctgttatatgactcgctataaaagtagaagtttgcccttgcaatttcaagacggatatatttacatctccagaaggacactcttataattacagcttgatgtgctcacgtacgtgtaacacatgtctccttatatgagtcttttatgttcataaaatagttgcaccctaaaaaggtgacctttgaagttaaagacatgaccaggggctctgttcacaacaacaataacacagatcctgttccctccaatgacgaaagctctcaaaaacagaaagccaagttgtggcaatgtgcaaacaaaaatgcagggttttctcaaatgaaaaaccgtgtgccttgccaagttgccatgttgatctttgcatccttcgtgcaggtttgtgtagcctgcaacacacaagttgtatttttggtggatgctcgctacttccactcagtggtagtcaacatctaaaagatcacaatatgtagcaatcccaaccacggaaaggtgtggacaatgttaaccacctaggtagttaggtcgttgattttagataatttttacggtactcaagtcggtacaggaaagtaacaacactttatggtactcgcgagtttagaatccactctttttttcacacttcacggtactcgcgagtttagaatccactctttttttctgaactccttatatcatctctagagtacaatctaaccattcagcgaaacatgggaccgagggtacatggttcaattaattgagtactccatccgtcccataaaaacaaacttagaattagatgtgacttaatctagattcattgtactagattaagtcacatccagttttatgtttaatttttaggacaggggaagtatgcttgtagtgtgtaaatctatcgtgagacccactagtagaaaaaagaaagctaaaccatctccatttcctattcagatgaagtggtgtccaaccgataggcaaaaaaaaaagtaatttggatgttttttgcaagcatgttgagaccctctttgtttaggcttataaaccaatttataagtcgaaaagtttaagcctaaacaaacaaacaattttttcgtttggcttttttaaagccataagccactctaacactattaactcaaaagctaggttggagaagcttttttacttatgtgaggtatatgtatgaaccaccaataaatttaggacattaaatcatcccacttataaatcatataagccaataacctaagtcaataagcttaagcctaaacaaagaggacctgagagagaagagaaatggctcagctcgcgcacaattggtgcaaactaatttcaattaaatagacctagctagtgaataaccgtgaaagtttatagataatggggatcagttgggtctatttaattgaaattagcccgcaccaattgtgcataagttgagccattccttttctctctcaatacgcttgcatggtataagagcttttcatgtcgaggacaacagacacatgcgtcttgacgcttggaacgctgaggcggaggtagtgctggtgtcacgttggttggcactgcgtcttgggcacgaggcgttggtgccgtggtggcaagcaccacatcgcgcacgcccggctggacaaccacggtagaaggagaaggtgtcgtggtgattgtgttgtctgacagcgtgatggcgtcttgggccgcctgtgcttgagtgagggtggcgggaagatcatcggtcttgccagtggctgttgcggcatgggcagtatcaagcgccgtgacgaggttggcaatagcgtcttggggcggagggaggggtgataggagcgacgccatcgatgggctgtggagaagccatggatgcagcggaaggagagagggagagggagggggcaaaccggatcaatcttgctttgacaccatgtgtcggtgacatgggaccaggaatatcgtgactagaggcttgggcagccgcgttcacccacgtggcctgaccccctcgggggggtcgggcccgagggtgacgtggccaccccttcctct

SEQ ID NO: 22128 - DNA, 7547 bp, Oryza sativa
ccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgccccaagcttctcctgttcagcccaatggccgaacgggcagtggcacacaacctctctccgagcactagcggtgacgacggggagcaaaacccgcgccgtcgagctcgtactccaccgcccccctctcgctgaagtcttgggctggaggaggcgctcgagggggtcgaaagatccgcgacttcgccacctacgggcgatggagaaggacggctagacggggagcgtcgcctcctcgtctacggcgatggcagcacgccccagggcgcgctccaggctgcgggcgcgctcctgcgtcacccgcccgtcgtccccgatccagagactccagcccgacgttggctggatgacgtggccgacttggtcatgacggcgcagcagcgcctagacgccggcgggcggtcctccgccaccaaggcctctggcgctgctaccgccggctccgtgtcgtcgaggcggagggcgcggcgagcggcggccgtcaactgccgtttgtccgccattccctcgtcaacgcctccgacccaagaagatgtgcgtggggggctggatgcccgcctcaatatcgagcgccggcgcaatggtcgtcgtgctgcccatgcaacggagggcgcttcctcgtccggagcgccacttcggcccgggcacgggggccacccccccgtgtccccggttggcggtgtcggctgtcgagcctttgtggcgagtcttcggaacatccgttggcccccaaggttccggcctaccatcaccgaaaaatacgacgggagcgtcaaccccgccatgtttctccaggtctacacgaccgggatcgaggccgccgggggtgacgacagggtcatggcgaatttcttccccatggccctgaaaggtcaggcgcggggttggctaatgaacttgccacccgcgtcggtccactcttgggaggatttgtgccagcagttcactatgaacttccagggcacatatccacgcccgggtgaagaagccgacttgcatgcggtacagcgaagggacgatgagtctcttcgctcgtacattcagcggttctgtcaagtccgcaacaccataccatgcatcctcgcacacacggtgatctacgcgttcagggggggtgtgcggcataaccgcatgctcgagaagattgcctccaaggagccccagaccaccgcggagctttttcagctcgcggaccgtgtggctcgcaaggaggaggcctggacctggaactcctccggttccggtgtggcagctccggccgcccccggatccgccgctcggtcagggcgacgggacaggaggaggaagaagaggtcggcccattccgacgacgagggtcacgtcctcgccgttgagggcgcttcgcgggccacccgaaaggggaggcctgcgagcgacaaaaagaaggaggccggcgctcccagcagggagcgcccgaccggcaagtggtgttccgtgcacaacacctccctccatgacctcgcggattgccgcgcggtcaaaagtttggctgagcggacgaggaagtgggaggaggagaggaggcaggagcgccgtgagggcaaggccccggcggctcccgccggcaaccggcgaggtgaggccaagcagaaggccaccgccgaggacgtcgacgatggtgacgatgacctggggttccaggagcctagggccaccgtcgccaccgtcgatgggggagcgtgcgctcacgcttctcgccggagcctcaaggccttgaagcgagagcttctggccgcggcccccacccatgaggcgacgtggcgggcgcgatggtcggaggtggccctcaccttcgaccagaccgaccacccgccgtgcgttgcccggggaggacagatcgcgatggtggtttcccccaccgtttccaatgtgaagttggggcgtgtcctcatagatgggggtgcagccctcaacatcctttcccctgcagcctttgacgccatcaaggccccggggatggtgctccggccatcccagccgatcatcggtgtgacgccggggcacacttggccgctgggtcatatcgaccttccggtcactttcggtggttccgccaacttctgcacggagcgggtgaacttcgatgtggcggacctcagtctgccctacaacgtggtcctggggaggcccgcgttggtgaagttcatggcggcggtccactacgcctatcttcagatgaagatgccgggccccggtggccccatcaccgtccatggcgacctcaaagtcgcgcttgcttgtatggagcagcgcgcggaccacctcgccgcagcgtccaagcccgcgggtggcgacgagaggctcagcccctccgtcccagccaccccgaggcagcggatgatcacatgcgacgaggtcccggtcaaggaggttgccttaggcgacggcccgtccaagaccacacgaatcagtggtcttctggacgacaaataggaagacgcgctcgtctctttcctgtgggcaaacgcagacgtcttcgcctggagaccggcggacatgcccggggtccccagggaggtgattgagcaccgtctcgccgtgcggccgggcgcaaggccggtccggcagaaagtgcggcggcaggccccggaacgacaagccttcatccgcgaggaggtggcgcgacttctggaggccggattcatccgcgaggtcatccatccggagtggctggcgaacccggtcgtcgtccccaaggcgaacggcaagcttcggatgtgcatcgactacaccgacctcaacaagtcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagttaggacgcaatgttgaggcctatgttgatgacttggttgtgaagacgcacaaccaagagaccttactctcagacctagcggaaactttcgaaagtctccgctccgcccgcataaagttgaaccccgataagtgcgtgttcggtgtgcccgcgggcaagcttctcgggttcttggtctctgcccgaggcatcgaggccaaccccgagaagatacgagctatagagcggatgcgcccccccagtaagcttagggatgtgcagtgcatcaccggctgcatggccgccctaagtcggttcatatcgaggctgggagagaaggcgctacccctatttaagctcctcaaatgctccgggccgtttacctggacggaggaggctgagcgggccctcactcagttgaaggcgtacctcagttctcccccggtcctagtcgccccgaagccagatgagccgttgctactttacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcccgcttgtccaacggtaccaggcgcccccgacccccaggaaggccccggggccactgcgggaaggccgcgcctgtcgccctctgaccccgaggtcatcggcacagaagccgagtgcgccccgcgtggcctctcgggcgaagagcgccctcgagatgcggcccctagcgacgaggatcggccccgccgaaaggtgcagcggcccgtctacttcgttagcgaggccctccaggacgccaagacccgataccctcaggcccagaagatgctttacgctattttgatggcttcgaggaagttgcgccattatttccaggcgcatcgggtcacggtggttacgtcttacccctcggccaaatcttgcataaccgagaaggtactggacgagtggtgaaatgagcaatcgaactctctgagttcgatttgcactttgaaccacgccacacgatcaagagccaggccctcgccgactttgtggcagagtggaccccagctcccgagcccgtctccgtccccgaggctagctctggccccgcacagctgcctcacaccacctactgggtgatgcagttcgacggctccctgtctcttcagggcgccggtgcgggggtcacgttgacctcgccgagcggagacgtcctcagatacctggttcgcctcgactttcgggcaaccaataatatggcggagtacgagggactccttgcaggactcagggtggcagctggactggggatccgccgcctcctggtgttaggcgactcccagctggtcgttaaccaggtctgtaaggagtaccggtgctctgacccgcagatggatgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaaaggagtgaacgcgtccagcgcatctccaagcgctacgtgctggtggaagggaccctctatcggcgcgcggctaacggagtcctcctgaagtgctttcctcggaaacaaggcgtcgagcttctcgccgatatccatgaaggcgagtgcggagcccattccgcctcacgcaccttggttgcaaggcctttcgccagggtttctattggtcgacggctctcaatgatgcggtcgacctggtccggcgatgcagggcgtgccagtttcacgccaggcaaacccatcagccggcctaggccctgcagaccatacctctttcgtggccgtttgctgtctgggggctcgatatcctgggtccgtttaggcgggccccgggcgggttcgagtatctgtatgtcgctatcgacaagttcactaagtggcccgaggcttatccggtcatcaagatcgataagcactccgcgctttgtcgcgaccgggaaaattgccttttcccgaacgctagtgtattaatccccgtcccaggaaaagccggggtaccccatacaaacatgatataaaagacacatctttattatatcgataatatttacattattacaaaggcacttaaggcctgacaatcaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgtaagggagtacaaggggataataatataggggttaagttttgcagaaatccgcatttaaaagtcacttagttgcccaaagccattttataaggacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattcgacattttagttattgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccacaataatccaacaattccctactgtccaaatgatatgagatttcccaaagtctaaagttataaaaccacctaatgttgcctaattaaccagcgaagcttctacctaagttcatactagtggaaccataaatagagtacccactagttggggttttattttcctggggtgaacaaggtaataataacaatagcaataataatgtcttaacaatgataaataggcatggctaaataaaacagtgataacgcgggaatttagataaagcggtaatgcattaatttaaatcaaaataattttataaactgggattcaatatgctcaaggatgatgtgacttgccttgctcgctttcccaaacttcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagctcaaatggccaagatatggccatttgaagtttatatgctctttaaatggatatttgcgaatttcttcattta

SEQ ID NO: 22129 - DNA, 6057 bp, Oryza sativa
  unsure (1)..(6057): unsure at all n locations
acggcggagagagaggcagacggcgcgagctcgattccgacggggagagagagcggcgagcggcgaaaacggaggagggaggcacggggagcgtttatatagtgttgggagggggagagagcgaccggatgagggggaatcgcccgcggaagatccggccgccattgatgcgccggcgaagtttgcgggagggtttccgaacgaatccgagggagagagagagggaaaagtggggggaaagggagaggcaatcacggggagtgatttccccctctttattgcacgcggggacggcgggatgcggcggaatccgcggcggcggcggcgctagggcacggacgaggcggcgggtgcggcgcgaggacagggatgacaggtgggccccacccatcagcgagggtggcgggcgggcccgcccgtcagcggtgcgcgcgaggggagaggccggatgggccgcgggggagaggagggagagggagagagatgggccgagccggcccaagagggggagggaggggggaaaaagactttttagtgtttttctttttataaaattattttaactttgtttatttcttaataattattatttgtgctctgaaaattccactaaaatttgagggctcctttttgaccaaggagaatttaacaaaaattctccgggccacatttgaatttttcttgcacgtattttaatgtttgccaatttcttttcgaattttaattaattctattattccttttagagaatgatttttatttcgggatgaatttatcaggacgtgacacgcttaaattgatcaggggcatcactgctccgtttggggtgcctaaccgtatcattacggataacggcacccagttcactagtgaactcttcggtgactactgcgaagacatgggcatcaagctctgcttcacctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctaaggtcccctcgggccaccatgtattgcgagactgatcaagatcagcttcgcagagacgacctcgactacttggaggagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgacgcttctacccctagtcggagtcgggtgtcaggtctcgggctcgggccaaccccgcactcccccggacgtgcagggttggccgggggctaccacatgcatatatacttaccttttttctcttccatatttcaataaaagcattttcgatttcctaaggaatgtgtctgtgccattgtttccttttgaagaatcttggcttgaattagcacgctcgtgctcgatcctgccctcggtggcccgggccggctaaaatcgccaaaaggggcccagaaccgagccgtgccccggggcgtggtgaactccgggggggaatcggcaaaggcccacaatcgggtcacccataaccctcggtcaccacgttcccggcctggccagtctcgacacgtggatcttcccaggcactagccccgacccgcgccatttgaggctgggacctgggcacgagcccttgttcaagccaagatgcagaaggaccgcggcacagaccatcctcgtctcatacacgcaacaaatagaattgacacagaaatttcatctttatttgattgcagattaaattagtctatacaagaagggagcccgaaggcctcagaagaaaaaggaaaaagctattaagattggcgggggccctaggggctcacttcgacgcacccgggtcgccagcctcgtcgtcgctgtcatccgcaccaccgtcaccgccctcctcgtcggagtcgagggcgaacgcgagccgaggggccgtaccctcgaagctgtggacgatgtagtcggcggcgtcccggacctgcgcgcgcgcgccgtcctcggttccgggagggaactcgtccagcgctgcccacggggagaagtcggggtccctggcctggtagcttgccagtacgagctccactgccccccgggcgaggtctctcgaggatgacttgatcgtcttctcgagctcctcgaggagccgctggagggtcccagccatctctgagaggcgctgggcgaggcccccctggttggcggcgtacttcgcggtccgctcgccccagaggcccgcctgccgcccggcgtggtctaaacgggagacggcgtcccgaagcatgccgggccctacctcgcccgccaagcggagggcctcgacctccccggcggacgagtccagcgcgccctgcagctcggcgattgtgtgttcggcagctgcgaggcgggcggctaagtcgctgtcgcccgcggcccccccaccgttgcgcgctctcgcgtgcagctccttagcccgcgcctcgagctcagcggcccgccgagccagtgcggccctctcggcgcgggcgccttccagattgcggcgcgcctgctcctcctgcgctgcctcgcggaagaacaggttgtccgccagccgctgcgccgcggcctcggcctcctcgagagctcgctcccgctcggtgagcgtatcctcgcagaggcagagtgcggactcctcttcggcgcaggcgggctcgtgcgccgccagtgtggcctcccagatggcgagggcggcctcgcggtccgccaggtccctctcctttgcgcgggcacgctcttccagcgccgtggagcgagcttcaagggcctcttcgcgccgccgggacgccgcctngttctccgccgcccgccgttcccgggcagcggcggcgtcaaggactccccgggcggcgtcgagcttcttctctagctccaccgccggctcccgtattggagacggaggtcgtcccgcacctcgtcgagcacggcggtggcgatgagggcagtctcccgctcctcctccacctccctggcgatctccgccagctccctccgacgggcctcgagctctgaggcgtgccggcggtgtgccttgcggcccgcctccaccatggcctccaccgagcgtcgcccctcttcgacgcgtgcccacgccgcgtcgagctccacccgctccgcctgcaggacctccatctgggcgcttaacccgtccaacaccgtggtgttcgcggcggctaaggcctgcaggaggggctccgcgctcggtagggcagcagaaggcagaggagagagccgcctcggtgtgggcgccgcgcggctcggcccgccgatcgacgtgccggactcgggggcgtcccccgaagttggctcgttccgaacgtcgtccgaggggtcggacccgagcggtgcgcccgcggcctcgtcgtgggtggcctcggaagtcgccgtcgcctcgggcggagtcgggtcgggggattggcagaccgcctggtgtgcgcgtgccgcctccacctcccggacggactcctcggcccggcggagtctggcctcctcccgagcgacttcctcagcctggcgaaccgggacggccctcctgggcagcttcctcggcttcccggagacggtctgcggcttctcgccggtcagcttcccgcctccgggcctccgcggtcgccgcctcctcggcctcagatcggccggacttggaatggcgaggggggcgcgacgggatctcgctgaagcagaagaaaaaccagaagacaaaaagaaacgggtaagtgaaaactcgccttgggagataggagaatgagtacggccgcggtgggcgcggggacgaacctgcggggaggtcggctaaacgaccaccttgggggtgagatgaggtttccccggcatgtttcggtctcccccatcttgcggagccgcttcttctttcgctccccctcgggccgcggcgtcggcacggcactctccgggcgcctgctgctggcacgcaccgccccgccccctcggggaggagatggggaaggggtaccctcctgcttcctcttcccccgggcgtcggcagggcggctgcccctcgggcccccgtcgcggggcccagaagcacgaccccctcccggggtagattgttcccccctgcggctcccacccgcgccatcgtggcctcgaggagcccgctcctccgacgccccgaccgcctgcatgatggtcaggatgttggcgcgatctggatcgctgcagagggggaggactccttgggggatgagggatgcctccacggagctgagattcaacacccgttggaccaccatcttgaagtcctcaggggcccagtcccatctgcccccctggtgggtcctcatgtaatcctcggacccggtgtactcccaggcgccccgggcacgccgctggagcggcgcgatccggcgacgaaggtagtcgccgtacaccatggcccctctgagcccctgggatcgcagacccgccaggcggtcaagaacgacgtcgtagccgtctcccagatctaccggcgcccgccagctggaggcctgcgccaggggctggctcggaagtcggaggcgcgcttcgtcggcgagggggtgtagaaccagtcgctcttccagtcgtcccacttcttgcggaggacgcagggaatgtagcggctcagcaccggcccccgcggctggaagtagcagccaccgactaccgacggcggcgacaccggctgtgcggtgaagaaccaccggaacagccgaagagatgggcgcaccccgataaacatctcgcacaggtgcgcgaagatggccaacatcattaccacgttgggggtgaggtgcgccatctggagattataaaactccataacatccatgaagaaagaagagaatggcgggaccagccctgccattgcgaaagagagaaagaagacggaccgccccgggtagtgtggcgccgggcgtccctcgcccagctcgaccacctcccggccggtggcagattccggcatgaatcggcgcagcagcccggcctgcctctcgctcacgatgcgagaaggcggcagcatgcttccgtcgagcagtgcggagccccgtgccatgacgccggcggaggaaaaagcttgagagcgagcgagagcggcaagggtagggcacaggaaatgaagagttagagcgcaagcggcgaaagcaaggggaatagtggcgagaggaaggaaacaaatctcttcctcggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggacagatcgagcacgcgttaactacactcgccgaccgaagcgccatcatcatgtctccaggcgaaacgaatcagcacgattcgcacgctgctcgactaatgtagcggtcgcgaagagaccgctcattattgtcagtcggttttcccttaccgatgcgcacgatttgcgatcgctggctttctgcccgccagtagagaccggccccacctgtcaccaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggg

SEQ ID NO: 22130 - DNA, 2258 bp, Oryza sativa
gccccgaccccctatggtgttggcgccacgtgtgtgggttaggtgagcacagcggcgctcacctaaccgcacttattgcgggttggacgagcgcgccacgccgcatttaatacaagcgcagcgcgctcgcttatccggtccgtgaccggtcgcagtatgtgaccggtcacagaccggtcagatcgcgggttaggtggcaacaggcggcttgacactcgtctcgccccgtcccgtcggaatgatgagagcctccaggcactcgtccctagccggagccggcgtggtaactcctggagttggcacgtcagtcccggccagattcatgccaggcttcatcgcaaccattgcaaggaagtcattgtatgaagaaggacagatgtgcggcatgctaaactgacgcgtggtggacaagaatgaccggtctgtgactggtctgacgccggtcacgtcatcggcagacaaaccgtgctcccatgttgtatttgcttccggcgaagtggaggtaggtatgacccatcccatcggagggtcattcggagcagccattgtaaatcctcacccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccatgctccgtcaccatgcaagtgtatcgagagagaagaggaatggcttaactcatgcacaattggtacgggctaatttcagtgaaatagacctagctagtgaataatcggaaaatattacagagaacggaaggtaatagtggggcttactatgcattccccgttcaccaaatatggaagatacgatgccaaaaataggagggacgacaagctatctttgacaggtttgaacgaagaacatggttccattttgccttgtaccgatttggtttgctacctgtagtgttgtgtgcttgttggtacaattttaagtgcgatggttcgatttatttcatacaccgatgatgccctaattagtagtgaggcataacaaatttaaactaaaatatacgaccttctggaccgtaaaatcgctcatattgtacacgacatgaacatactgtgccctggcctttgtgccactagcaaaaaaaaaaaagagaaatgaaatgagtcaaatgctaacgaaaaaaaaatcgaaaaagacgtacatgaagtacagaatgctagttcagatttagtgtgttaggcatcatttctgtatactttacataatgagctttttaacatatcatttgatgctgcttaattacaaccgatgcgcgcgctaatgtgggttgatttccgagttagttgatggcgacgctggcgaattcgtcgccgtcgatcgaggagtagaaggagtgctcgtcgttggcgtcctcctccttcccccccttgagctcctcgatgctctccaccgccgtcttgagctcccaccggctgtccacggcggcctcgcagcacgccatcccgatcttgatcagcttcaccatctcccccttgctctcctcgtcctcccacttcctgatcatgtccgcgtccaccaccttctccagccactccccctccggcgtcgacgccaccgctccgacgaggtcgccgttcgccgtcgccgcctccggctgcggcggcgggtcgtaggacggcggccggccggtgaggatctcgaggatgaggatgccgaggcaccagacgtcgctcttcttggaggagcggccgaactgcctccgctccggcgacttgaaggccaccatgagctgcgccgagtgcgactggttcatcaccgggaccagcgagtagtcggtgagcagcggttcgaagcggtcgttgaggaggatgttggacgacttgaggtggccgtgcggcaccgtcagcatcggcagctcgtcgtacaggtattggagcgctcgcgccacccccttcaccagcttcagcctcgccggc

SEQ ID NO: 22131 - DNA, 2228 bp, Oryza sativa
  unsure (1)..(2228): unsure at all n locations
ccccccccccccaaaagaaaattagcttcaatgatgaaaaattatagaaaagtaaatgaaacaacttaaaacaataatttacgagtcaaaacttttattatacctaagttatcatttgttggggttgaaaaataggtaaatttgatccatgccattacaaatttaccgtattaaaaatattattaatattctgaaacatgttgtgggggcattgaaattttctaaaactcgaatcatcctcatggcagaaaatttgacggcgatgccatggtttgaaaatttagaaaattctggtggcacgcaacaagttccacgaataataatgttatatttctaatacggtaaatttataatggcattgatccaatctaccaaaaaaaactaggataaaaggaatactccaaaacaaactttaaaaatcaagtttgaaacctggaactctgattgtggcttaaaattaaaatttaaacattaaatttgagtgtggattataataagccaacaaggaagctaataaaaagaaagaaatgtggtgtgtgtggattaccgtggaggaggtgagcaaggctcttgttggggacgtagtcgtggatgaggagcttctcctccttgcggtagtagtaggagatgagcgggaggaggttggggtgggagaggccgccgagccgccgcatgtgctcctcgaagtcctccttccccacgcggttcatctccttgaaccgcttcaccaccacggagtggccgccggtgagcgtagcgcggtagcacacgccgaggttggcggcgccgagcacctccgccgacgccttcagcaggtcctgcagctcgaagaacctccccctgtcgtcgtcccgcacgaacgtcagccgcccttgctcccccgccttcccgccgccgcccctcgccgtgctcccgctcacgctgctgcttcgcgcgccgcctcctccggtggtggcggctgcggcggtggcggcggcggcggcgtgcgtgggcttggttgctggtgacgcgggagctgatggcaatgtgggcttggttgaagctgcagggccgaagttctgggtgttgtactctcgccgcctctggagctcgaccaccgcgaagccgatgatggccagcgtgccgaggaacgcggcgaggacgccgaacgacgtcgatcccttggtgggcttcgtcgcgccctgcgtcccctcctcggctggcactgtgcccgttgtggttgtctcggcggcgcccgtgggagacggcgaggtcccgatcttgccggatgtcgccgccggcggcgacgtcgttgccgctggggatggcgcctcgcatttcgcgtcgactggcgcgccgcagagcttcttgttgccctcgaacatctgtggatcgattgatttgaggctcgccgggatctccccatccagctcgttgttggagacgtcgaacaccttgagatccttctgggggaagtcggggatcttgcccgtgaacttgttgtcgttgagctggaggtcgaggagcctcggcacggcggcgagcgaggccggaatggcgccggtgaagccgttccgcgacagggacaccttcttgagccagcccatcccggcgaacgcgtcggcggggatctcgccggagaacttgttcccggacaggaagatggcgcggagcccgccgaggcccttcacgtcgggcatggcgccggcgaactcgttgtccataaanctgagcgtgcggagcccggtgaggctcttgagcggggcgaggtcgagctcgccggacaggccctccttctccagctgcaggccgagcacgctgcccttgctgcacaccacgccggcccacgccgaggtgccgccatcgcaggggctcgtgccggcggcccaggtgtccagcgcgccgccgccgtccacgatgccggccttgagcttgagcagcgcgtcggcttcctccgccggcgccgccgccaggaggcgcgcggcgtcggcgaggaggcagaggcaggaggagacggctagcacgcgcaggaggcacggcgctccggccatgtccagcccgccggcgccagcgcctcgacgacggcggggcggggtggtgggggtggcgcacgtagctttctccggagaggaaaagtaggagagatcgcggggaagagagctgattcaggagagagctctcttccgcgcgcgcgcgcgttggagagagagagagagagagagagagagagagagagagagagagagaga

SEQ ID NO: 22132 - DNA, 16295 bp, Oryza sativa
  unsure (1)..(16295): unsure at all n locations
tacctcaattagcaaattcaacctgtcaatttcagaattgccacattactaatccaaccacatgatctgaatctttttttttacatttatacaccagaagttcagaatgatactccctccgttttagattataagtcgttttgactttggttaaaatcaaactaatttaaatttatagataaatatattaatatttacaacaccaaattagatcaattaaatgataatggaacatattttcataatatatttatcttggattaaaaatattattactttttctatacaaacttgatcaaatttgaaataatttgattttgaccgaagtcaaacgacctataatatgaaacggagggagtagacgattatatgtacatcgtccaattgctgaaacataccacactcataaacatttactgacacattgcataattgcgttcttgcaaactggtgaggaaattttaacaattaacacgagctaataattaattaagagaggactttgcttagaatccatagcacgagagtcatctcgaaggcgaagatggtgtggagcaatcccctgtccagcgtgaacccgaacagtgtgatcccgccgctgttgtggcacaggtacgtcactgcaacgacaaaaaatggcgcgagcgagtgaatttaaatctcagaaaaaaaatggcgcgagtgggggttcatctggtgttaccgagggcgtgtctgcttctgtaggcgcacgccgccgtcgtcgtcgtcccgagctccggttggtgcggcgcgtccacgtcgctggccgacgagctgggcgccgccggcaatggcgccgacttggcgtggtgcgccacggcctccatgctcatgtgccactggctcgcgatggacacgatcctttgcgctctgtgcgtgatcctcgccgcgccgaagaggcacatgaagaagccgctgagctgcaccgacgagccgacctgcgagacggcgagggtataagcatcgtgtcgtgattgctacgcctgcggcggcggcggagtggctgtgtggtgttaccaggaggtcgccggagttggcgaagctcttgccgtccttggaggagagggcgacgacgagggcgccgagctggctgacggtgatggtgacgaggcaggagaggatgaatgccctgtagcggtggctggtggcgagaagctgcgtgcggatgcggcggtgctcggcgaagatctcggcggcggcggcgcgcgcctcgacgtcgaacatgtggtagatcccctcgaagcggaggatctggagctcgcacgtgaggcggaacagcacgcacaccaggaggaacacgcccgtgcggtacacccacgacgccaccgtggccaccagcgccaccgcgcgccacggcacgccgacgccgggaagggggaaagccggctcgacgcgtacggtggcgaagaagaatacggcctgtgcgcggcctcgacgcagagcgacggtagaagcagcgcgtcgaggagcggtaacgcncggtccagctcccgcgcgtacccgcgccgcacgaacgcggtgtcgtcgcggagcccgccgtcgaggaacagcagctgccggagcccgccgccgcggcggaagaagcacgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctcggaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctctgctaggtgaggtggagggcccacctagtgggcccaattgttttcgcgggggcatatacagcggaggacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccccgggatggtgcgtgcgggagtgggtgggcgtagaattaggttaggttggatttggacctgttgcttgtcgatcagccatgggatctcgccgcaaaagctcacgcttgcggtgtttgtttgtttacaggtcgacaaccgtagccaatctgctgaaagcgtgccgcaccacgtagggggggttttttcccgggggtttttttttttttttccccgggggcccccccccggngccgggggggggggcccccgaaaaattttttaaaaaaaacccactttttgggcgcggggggggccccttttttcccccctttttttaacctttggttttttaaaagggcctagaacaatgcttggaagggggggaaaatttcatttttggtatggatgacgactcacaggtgggcggcgtgaggacgactgggtttgccccagctgccagaacgtcaacttcgccttccgcaccacctgcaacatgcgcaattgcaaccaatccaggcccaccgactatacggtacatgtgattgccaccgatgcgcgctcatgtggttgattagttccgctcatcgtgatttttgcatttacctagtcgtgctgttgcctcctctccagaaggatatgcagaaacctatgcagacaccgccgccccatttccccatgtcagggggatacatgagcccagggacgccgccatccatgtacctcgggggtggtgctcccccttatggcacctccctctatggcggacctgctttaccacgttatggtattgctcagttccctgggggttctggatatccatatggctatggtggccgcctgccaatggggagcccctatgggccgccgatgcatatggcagggcctccatattctgctggatccatgatgggaccaggtaggggtgctacaacaatatagactctactaactgctgagtacttgatttactagatacaatgggcaaaatttttgagaccatttatgtccttttatgcaaaccttagtgtggccagaatgagattttacaggaaatatccttttgcctgacatttattttctatagctacaggatagaaatgctagtatgcgaagtatgtttctttgggaactaatttactcttctacgctctagcatgtaaacttttataggcaaattagttattaccatatattttttttgggtggttgttgcagtttatgaattaaatgcatacgagataaaaattaaaaagttaccaactctttgtgaatatgtgtcctgactcgtgtgagactattcctcacattttttctcttatccattttcctgtcctcaaaataggtggaatgtatgggatgcccatggacagatatagcttgggcttacctgctggtcctggtccaatggtaaacttttctggattattagtatttgctcatgcatattagcatgattcaattgtttttcccttgcataacaaactattgtgggatgttgtcagtggtcactctgtgctctgtgggtctaactgtcgaagggcttcctttaagtgtcctttgatattatagtgtgataaatcacgataggaaatgtttcaactctcatttatacaattctttgatgaagggcgcgagggctggttcatattccgaggaaggatcccagaagaagcctgcaggtatatattttcaaatgaattttgactgttcattgattttgttgtccattggtttatttttcttatgaactttattttaggagctgggcgtgataatgattggaaatgccctaattgcaacaacattaactttgcattccggacagtctgtaacatgagaaagtgcaatacaccaagacctgaaaaccaggtacaattctccacttcttgtacttgtgcaagttcccacctattgtattactactactaaattatgaaatatctttctttctataaatctaaaattggtcaaagtttatgtgcaaattctgataatgaataaatatttttgatttgcttactaaaaggtgtactgcaatatactaacatcgtaatcatgcttaaagttgaccttgttgccacaagattagcaatgtgacagccgtttatattcgatgctatagtaactggtctgaactgttcattaaaacctcatgccatgcaattcaacacaatttgcttgtgccatgtattaagttgcccattgtttgggcaccaggacctaaggtattaagttgcccatttcgtgtgaactgtcattgttttctcctcaaaacaagatgtactaaatttctctccatttggcaaatctggaacctatacttagcaatacatcgtccactcagccttagccattaatcaagtcacagctgacatgcagtaacaaaccggcgattttcagtactgctatattaactgtgttctgggaagtctgtagcgtgtcaaagtattctaaaatagtttgagctgttctcttcgtaatttcactttcatctatcttctgaaattgttcctcatgctttgacttctcttgtttttcctagagttaaaccatcatgcttactttgctgatagcttgtgtgtcaactcttatgcaggggtccaaacctgatggtgcaagaggtccaagtaagtttaacactaactatgcatacatgcggtgccttgtttgtaaaattttttagtgtacctttagtacctcgaaaccagtaaaattctgagatcaatgccatcttatttccacattgcataagttatgcgtgtcacttagcactagttcttgtaatggctttgtcctttttaattctatataatctttacatctaatatttcatggcagaaccaaagatgccagaaggtagttggaagtgcgagaagtgcaataacataaactatccattccgcacaaaatgtaaccgtccaagttgcgaggctgaaaagccatttcagacaaacaatgctaatgagtcatctgctgatcaggacaatcaggtgcataattagaacctccagtatgatcatcattatatgccatgcctttctttagaacaattcaatataaattgcatatcttatgttttctatcaacagtttcgtttatttgcttgtcttcatcatctcttgtgcatggcttgatatatcatgtccttactgttacagtgagtcctagaacagttatgagggtcaagaaggtccagcgtcgtcgtcaaggttcagtctgaatgtctggggtctatctgtgtcagtagtcgctgctgtatccccttgagaccttagttgagtcgtcgtcctaatggtaaacgttttggagtggcaactggagtcatggatttctttattgctacagattttggttaagaacatcccttgtgaatttgtcatatacttctgaagcttggttgctttgtcttggttactggtactctgggaaaatggcaatttatgatataaatttcaattagctatctgtgtcttagattgctacctgtgtgctatgaagtactattagactgttcattgcggtctcagttttgtcaattgtgtttgtggtctttgtttcaacgtaagggtttggtatctcagataagttggttcttgctgatgcctatatcttttttacccgttttaaaaattttcgagaggatcttggaaggtagattctcagtttctcactatatgtttgcgtggcatcctcttcacaagtttctctccacattttctttttgtactgaaaattgatttggagagcctctctggtgctattgtttgaagtagcaattgggtctaagaaacaagttagctcggtaccatggaattgatacctctgtgtcagtatatcactatttcatcaacggtatcagcctttggaataaataaaaaatgaacttgatctaggtttctgccacaaaatttttatatgtttgtaaaaagaggataacacccttctgtcctcccacaatgttggtatattggttaggagacctataaaaccattgtctgaggttaatcaggttcatttgaaccatggaccttagcttagtttccatcgttgtcaatggattgactcctacagccaatgtagaaattaattgaaaaactatgattatcccagtgctcagaagttctataagtccctattgtttgcttttacatgtgtacggcaaataggcatgcatgttactttctgccagactcgtagagctcatggaatcctgttatatgttatcatgttatctgtagcttagcattttcaagttaccccattctgatgtgcttgattcaaagagagggcccttgatgaaacaatgaatccatgtgcatcatcacattgtggagtggtagactgggtaccattgcatgcttggttcgactctgactactcgactgactggatgtcattaaaattagttgttgtcatgtaatattgtgaagcttttatcaaagctgcaactttcacatgactttcaagacaataatgagcaaacaaaggtggatcctcccggtggccctgctggagtaccgacaagttcgcacgccctgcgaatggcagctctcagtgagttgcagaacagtgttaagagctgatacccttttcattttccaaacaaggtgagaactttgatccatgtggatgtgcttctatcaggagcagctgacagtattgcatgcagtgatcttgctaaggaagttggagatgggaaacatcgtgtgatggccagccttgatgtaagaatgcaaatcagtcttactccgtaccatatctgtgtggagtgtgcacaccggaagcatagtcattttttgaatggtcgattgcttcttccacagtaaagtctataataccagtgtgcaggtgtttttttccctttctttcagtgtgaaggtgttttttaccccctttctttcgttcattcattctttttctttttccttgttgagacggtatcctggagcactttgtaatactctaatgtgcttcggaaagtagaatataagttgtgcttatgggcgggccaaaatgctttggccgttagttgcatgacagcctttccaacatgctgctgcctagccgtagttctcccaaaaatgaaaccatcttgagatccgtttgcggttgaactgaaattagacggtatctctggtttcaacatcatcctttaaaccctggatgaaagatttgcaatattcctgcggaaatctcaacgttcttgcctatttgtttgcggtttcgagtttcgagtatacgtagaaacggaagccggaacatgcaccacgctactcttcaactctatcaagttcatctgaaagtttacgcggcatgccgccatgttcttcgtgacgaggactcagcggccaacgcaaatcagtattcaggtgcttaggtaaagcttttttatctttgggtgcttcttgcaccgatcgatgagatgtgctaagaaccacatatatttgatggcattttgcggtactatgtttagtatgaacatccatctttcaccaaccgattgatttataaggagtaatagtttgcaaccaacaacatcagtagtagggaggccaaaggtgttgtcatgcaggaaagggaggcggtggagcggcgctcaacaatacacatggtgcagcaatgcgtcatgttgcactcgtgcaatggacacgcactaaaaatgtttcttatggctagtcaaaattctccaggaaaatacatttcaaccataatagaaaggtcctaaatgccacaaccaaaacaaggagtcaatgcatgtagattcaaaagaaaaggacgataaatttcatggccaaagtaggaatacttgttataacattaacaatatatttcaattagctacgatgacagtggattaaattataaaaaataaatctacaatttcgttagaaccctcttattactgacacacgaggcccacgagtcatacataacctacttgcaatgtgacacttctcatcatttcgcttccatctagtagagtttgtatggcatataagccaggtgtttaagtgacaagagggtctggagagttacagttttatgataattttattttgtattatcgtagctatctaaaatatgtcatttatattgcagcaagttgatagtttaatcattaaatatgtagtaatctgaaattttcccaataaataaataaataaaggggccctgtacctaacattgcacatgtggagatataacataggcaaacccataaaattgcataatagatggatgctcattaaataccctaagaaaaaagaataggtaataactaataatatcctcaagatgatatacatgtccagaagatacattgatagagtatgaagtaaccaatcttcaagatatttagtattgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaatttccaacattttctgcgccacctgttctctgacaaaatggtaatccacttctatgtgttttgttctagcatgaaacacaggatttgctgacaaataggtagctccaatattatcacaccataattgagaaggtcctggatgcaacaaaccaatctcttctagcaatttacgaacccacattacctcagcagttgcattagccaaggctttatattcggcttcagtactagagcgtgatacagaagcttgcttcctggcactccaggatatcaaatttgatcccagaaatactgcaaaacctccagtagatctcctgtcatctagacatcctgcccagtctgcatcagagaaagcactaacaatataagaaaaggatttgtcaatctttaatcctagaccaagagtaccttgcagatatctaagtattctctttactgctgcccaatgtacaatagtaggattctgtaagaactgacacactttattaactgagaaagatatgtctggtcttgtaagagttaagtactgtagagccccaacgatactcctgtactgactggcatcatttgcacccaaaaattcaccatcatttaaccacagtttttcagacacacagagaggagtactcacaggcttacaattactcattccagttctcttaataatatcacctgcatacctttcctgtgtcaacagcagacctttctcagttttctttacttcaattcccagaaagtagtgcagatccccaagatctttcagagcaaaatctttctcaagttccttgagtaaaactgtaactgcttgaccagaagagctagcaactataatatcatcaacatatacaagcagaaacataacaagtcccttcttattatagaagaacaaagatgtatcagccttagatgaaacaaaaccaagttcttgtagccttttactcaacctggagtaccaagctctaggtgcctgttttaagccatacagagccttatccaacttacagagatagtgtggcatctttttctcctcgtatcttggtggctgcctcatgtacacatcttcttcaagatagccatgcaagaaggcattctgtacatcaagctgtcgaagactccatccctgtgacacagccagtgacagaacaagtctaatagtagcagccttaactacaggactgaaggtatcctcataagcaataccataacgttgtttaaaaccctttgctactaacctagctttatatctatctatagttccatctgcctttcttttaatcttatagacccacttacaatctattacattcaccccctgctttggtggaactaggtgccaggttttatttctcactaaagcagcaaactcgctatccatagctgacttccaattagtattacttaaagcctcttggagattacctggttctcctgtatgtgtgagtcctgcataccttactgtgccatctgtgtacttctttggtttgtggataccacgctgtgctctggtcactggtcgagtcggctgagcggcaaactgagcactatcatcatcatgcgatgtggaagaagcaggagctgatgcagacgtgtcttgatcctcctgcgacgtgtcttgatcctcctgcgatggcccacgtgaacccggtcccacaatgtctcccgacagagacgaggctgccgcgtgtgacgacgcgattggcgcggttgccgcgtgtggcgcggccgagggactcgctgcgtgtcgcggcgtgaccggttctgcagatcgagatgacgccgagttctcctggtccgcctggttctccgtgccatgcatggtactgtgcgtcagagagtcatgatggccgccggtaggttgcccgccggaactctgcatgaaatcatgcccgtgctgcgcccctgattttgctccattgcctgcactgctgcctgcactattctcaataattggattagcaggattagaatcatcaatcagcggttgatcatgcatctgtacacccccgtgatcaagcagcggaagaagatgcgccgggaggagattgatctcagcccggaggcgagcaccggcgttgggatgaagtttttcaaagggatagatttgctcgtcaaagacaacatcacgggaaatatacacacgccctgtagagatgtctaggcacttaaaacctttgtgaagcgtgctataacccagaaaagcacactgtttagaacggaaagctaatttgcgggcgttgtagggacgcagattcggccagcaggcacagccgaaggtgcgaagcagagaataatctgggggcaggttaaacagacgttgtagaggggtctcaaagtttatcactttggttggggtcctgtttatgaggtaagcagcggtggtgaaggcctcatcccagaatttgagaggcatggaggcatgagctaacaacgagagcccgacctcaacgatgtgacggtgtttgcgctcggcagaaccgttctgctgatgcgcatagggacaggcaacgtagtgttcaatcccaatgcgctgaaagaaggaattaagacgttggtattccccgccccaatccgtctgcacagctttgatttttctattcgtcaagcgttcaacaaggttttgaaaatcctgaaacttggcaaaaacctcagatttgtgtttaaggagatagatccaagtgaatttgctaaagtcatcgatgaaactaacataataaactttattgccaacagagtttatagcaggaccccatacatcggaaaacacaagttgcaaaggttcaatagaaacactactggacttagggtagggtagctgatggctcttgcctttctggcaagcatcacacacaaactcttgactagaatccctaacaactgggagattattttggctaatgacgcgattgacaacagaaaaagaagggtgccctaatctactgtgccaccggaaaagagagggcttgacaacaccaaaagcctgcttgttggagatggtttggagcttgtctgttggcagaggatagaggccggatctacacctgcctcgaaggagtggcatcctcgttacctgatccttaaccaaaaagaagaaaggatgaagttcaacaaatgttttattgtcacgagtaaagcgatgggcagaaacaaggcttttgcatgcatcaggaacatggaggacgtttttcaacgttagatcacgagtaggggtacgaattgcagtatgaccaacatgatcgatattcatacctgcgccactagcattgtggacttgatcattgccggtgtatttgtccttcaccatgagcttctccatctctccagtgatgtggtcggtggcgccgctgtcgatgtaccagttcgtgtcgatgccgtaggagttcactgcagcagtgttggcgttcttctcttcaccggtgaaagagggatcaaacctcttccagcacttggcgacgatgtggccgatcttgccgcagagttggcacgtcggcttgggcttgccgtcattacgaccgcgcccgaagctgccgccacgtccagggttgccgccgccgcgccctctgccatcacgaccgcctccgcctcgtcctcctcgcgacgcggtgttggcagaaggattggccgcgttctggagaagttccagccgcgactcaaagccaaccaggagcgcatagacatcgctcacagagattggaccggtgcgtcccgtgactgacgagaccaccgagttgtagtcgaaatccagcccggcaagaatgtaggagatgagctcctcatcatcaactggttttcctgcagaagccatgtcatccgcaagagatttcatcttaccgacatactccgccatgctccggtttcctttcacggtggtggagagcgccatgcgagtgttgaggatgcgggcgcgagattgagatgcgaagaggctctcaattgcctccatctgccgccgttgtgagtgttgccacctgagtgagcacctcacgcgacagagacgacagcaggtagctgagaacctgctgttcctgcgccttccattgcaccagcgccggatttgccaccttctcggtggtcttgccatcgtccttggtgatgatgatcgttgcagccggtgcctgattgctcccgtcgaggaagccggccatctgtgcgccgcgcagcgcggcaagaacttgcgctttccacagcacgaagttgctcttggtgagcttctcagaaactgtctgcccattgagagcagatgggttggaggaagaagacgccatttgcgtcgggagttgggagattagattgaaagattgattggtggagggtggaaggctctgataccatgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacaagtatgatgataaaccaacgataataatggaaatcgatatacatactctggtacaagagtcaaactgcgccgatcgatgggagtgacgcggtagtaggcgtcaatacggagcgttggggttatacgtacgtgtatactacatatctgcaagcacataattaatcctcatatcttcaaacgcgagcaaagacagtactactcccttcatccgattcgatattcttaattttttggagaacgacataatttttgaagtatatctttaactatattgtctattatgacatatccaataaataaatacaaataagtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaattttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccccgcctttaaaacccgcctccgatcccctctcccccaacaccatctcctcctcgtcatcgtcatcgtcttcctcctcgcgtcgccgatcacctcgccatggtgccgccggcggcgcacgcgccgaagaacctggggctgaggggggtgcgccgccggctg

SEQ ID NO: 22133 - DNA, 21897 bp, Oryza sativa
  unsure (1)..(21897): unsure at all n locations
cacgacgtcggctccgtcgtgttccgcccgctccctccgccgccgccgcccgtcgccgccgccgccgtccccgtgttcgccgcacctgcaccgcccatggcgccggcgccggccaaccatgctgccgatccttactactgcaacgagcctgacaccaccacagacgaggacgtcatggctgcggctgaccgcctcctctccatggacatcgaagaggtcgccgctttgatcgccattgttcagcaaggagagtgaccatatctacaacttcttagctagctagttacaccttctatgtagcatgtgtactatgcacttttgtggttgtgttgtgctgtcctaatggtgtaactagccatatcaaggaagacatgcatgatctagagtctagagtactctagccatggaataaattaacttagtctgtacttggtcatgcaccttgtgtatgatccttgtgtaagagaagtgtaataatcggttcttgaaaaggaactgttgttatatatgagatggatgttgtcatgaaatggaaatttgcagttgtttctctttgcaatccggtgtgattttgtagtggaaattaacagaggaagaaaggagaaaaagaggcgcgaaatcgacccatggcgcgaaagtttgaatttgaaaatttttgagtggaatgtttaattttgcggtataactttcttacaattcattctgggggatgacagaagcattctatatgaaagatactagctatcatgaacatatgtgaactttggcagggtcgaatgtgaattaatcaattacccttttcatatgctagcttggagtatatatatggggtcaaaatctcatgcatgtaaataagtccaaggattatgaagcacatatataaatgcatgaactgaacatatatgaaaacaaatctagccataatgagttgtaccatcaaagtctatagaatcaagaacttgtgttaaagagcagaagggctttcatgttaaagagcagaagggctttcattagaatgactgatgtcttttttcttcctattttccactctatccggaggaagatagtacaagagatttaggcaagggctgcaagagatttttttaaaacttttttttgaagagattttttaaaactagctagatagaaagtgaaagaaccaaattaataatggaattcccgtttcatcataaacaaaagtaatggactcctctcaccgagcgctcacgtgaacattatagtcataattttgagccgaaaaaccccttcaaaatatgctacgtatagtacaaaaccatatatattgttcagtccgatatttgccatgttttttccttctttttaagcttgtgttaagggaggggactcactcgcgtggtgtacgtgtgtctttgatgtctctgtgtaatcatacttgtaagttcatgtatttcacattttgtttgaaaaacatatatagtgttaacaagtttcaagcagagttgcaattaaagttaccgtttcttttttactagttgagacatgtccaagattgatgcaactacagatgtgggtgaggtcaggaaatgatggcatctacctatcctgaagatgtcatgcacaaataaataagtactctactgatgagtctactcatcaattgcaagcagttttggtttatgctaattttcaaacacatcaatcattcagctatatctctcttttgtactcgtgtgcacgtcattctagctttggggccttggacaccacaccgtgcatgctggtagcgggtagcctcgaatcgaacggcaataatatccctctgtatcattttgtaataataatatttatataatttgtatatgtacttccatcagcaatccgttgtagtctagctggttaggatactcggctctcacccgagagacccgggttcgagtcccggcaacggaatttctttttggtttcataattgttgaaagattatttgttaacttttttgtggttttttttatctccgatgtatgatcaatgaatccaaaattcttgaaagattattggttttcagattcagatgtttgttacttcaccttttcatctcttctccgatgtatgatcatgtagtgcgatcaaaaaattgttgaaagattattcgttttcagatgcttggtacttcaccttttcatttctctctctgtgatatatgatcacgcaagctgaaattcctaaaagattattcattttcagatctttgttacttcaccaaaagttctcagtgcaatgtcccttttcctaattcttgagttcgtctttttttacgagaactagtgctgaagaaaacagagattgtaagctgtgcagtttgatgcctgagtttcactgaagcagtcataatggaactatattacaaactgcaatttttagttacatcggcaaccaatttttctccaaaccatccaacatattttctcagaattctttcgtctcgctaaaaatctctgaattcgatgaagccatccgactatgaagcatcgatttcagcagtttctaatgaggaaatttcaggctgctgctgctgaagctgaacccacgaatggtagtctctcagcagctgctcccccagcaagggcacgagcctgtccaggaggccttgcatcagcctgccaaatgttcagttctaatgttaaaccaaaatgaaactggtaatactgaacagtgattcagtttcagtgtaaaagatgtgcttaaacatcttgatggggtgattggattggaatttagttctcatcagcatctggtgagcacttgtgtgtaatttctttgagatattttgccttttttttttactactgaactttcagaaacttcagtgattaatgtagggccttacaggttgcctggtgtctccactgctgacaatggaagcatgctgaatggcttcgtgtaaacctgtaatccacatatgaagaacttcagtgtacgttaaaaaaaaatcagatcatctcttagttccgtagaatcagtaattcagtgagcaaaacggttgaggtgctctgttcatccagatgctgtatcttctcatgtaatatacctccagagtgacctccaaattgacatcaatgtccaagcatggttcctcaccatcgtctttccaagttatatggttgctcataaaagctgcaaacatcaaacctctaaatcagacacacattttattttgttgccccggaaaggaagttcagagttcagagttcagactaagcagtaatgattcgcatggttacaatggttagcaaaacagatgattgacaacgatgaattgatgaccaatctactaattgcacagataaatcagatgtctccactcaaaactgcaaagaattttcaagaactgcgagccaatcagctaaccgaagaacctgaatttttttacctgaaaagagctcattctgctgctcaactgagcctgaaccctcaaactgccaccaacaaaacgatcaaatcaaaccaagattaaccgtagaatcgatcaattgagcaagtgattgagacatcatgcagagcaattcgcttaattcagtagtaccctgcaggagagcatctcgacggtgcagtcgtggcatgtcggggcgacgcggaggtcgaggacgggggcgacctggaacccgaggaagccgatgctctgcagcgtgcaccggaacgtgttcgcccccggcgcctagtccaccgacgcgaagctctgcagcgccctcgtgttcagcagcgactccacgccggcgggctgacgcaagaactcgccgatgcccccaacgccgccgccctccaccaccacgatcctctcccggcgcctcgccgacagccgcgcccgactgcccctcgccctcgccgacagcgattggccgtcctcatcgccttcggcttcggcgtgcgcattgccgctcgccgccgcggctcgccatggccggcggcgaccggctgcaacggcggcgacgcttgagattcggaagaggcagcaaggtttggcagccacgagcctcattccatcgtccactcagctgagctcgagctcgcgcatggagtgatgcgaggttggagttggagaggagcagcggcgacggcgagccactgatcagatggcttatcgtgttcgcggtttggccatctctctctgtgcacaagtggagctcgatttgtggtcggctgcgtcgcgttcttgctgtcgcggtcatcgtcttcaacctgttcaccagttcaatctttagttttcgacatttttttcggagggtgcaatatatatcgaatctttagtcttcaacctgttcaccagttcaatctttagttttcgaattttggaaattttgataaattttgttaaatttgaacaaattattaccaaattttaaaaatatttttttggccgaaataatattgtatcgcggatccaatagaaccgaaattttagaaatttcgttccgaaaatttgaaccctgcttaccaccacggattcaccacttccaacctaccaacgccactaccccaactcacacataaaaccacttgtgttttcttatctaaggatgaaaaaggtccgaaaatatggaaaccactttcatagttatatttctttcggaacggaatcgaaaacagtaaagaataaaatgaaaacggtatcgaaaaatattggaaaaaccggaaacgacgtgttggaaaacgataataaatatcaaaaacattgaacggcgaaatcacacatttaactttacatagctatataaaatataataaattcaagattatacaatgtaaattataattgtctctttttttagccatgcacttgatttgggtatggagttgatgggtatcagtcaaataaaaaaaaatgggtcatagatgttgacgtatttacaaatatagggtaatagatggtaattttcatacaattatggtataaaaattcggaaacactcgatataacaataaaatagttttcatttgcatttctatatttttctactatttctatttttaattttgttggcaacaattttcacatagctcagccagtcaaaatcgagaacaagtgtcggtcagtcaggaatttctacgattattttcacccctagtcttatcttctctctcctttcctctttaccatcaaactattctaaattttaattggaacttttaaccatactaattggagtaaaatgctatcctaccaaaatttcaaaagttttctcaatactatcaaaatttaaaaaggcatcaaactaaacacatagtaaaaaactatcaaaattcggtaacactgaatcttgccaaaatttggcaatgttcttgaactgagagcgtattacatcaggccatcaatattcgattctagccacaatcctagccgccggtttccagcccagaattaatttcatttaatttgggcaaaaccctggcttaattctagacacaaacaggctctggtctcttggacccaaattcaacttggataattccgacacaaactctatcgatcgaacgtactcacgtgtacatattccgaggcgatcgatcgatctccacgcgcgacacgacgcgacttgcatacgcagttacgcacgcatgcaggcgagccacctcgccggagattcagcccgttcgacaaccctaccgccggcgagcggcggcgtacgtgcgccggccatgtcgatgtcgaacttcgcgaagatggggtacagcatctgcgggagcttcgcggccggcatctacgtcggcgttaaactgcgcgtgaggcagcaagcggtggagcgctcggaggggaagaagtacatcagcaacatcgagcaaaatctccagagcctcaagaatctgtatgagcgcgtcgagtagccgccgccaccgttcgtcgtcgagacaactgatccggccgccgccgcagctgaggagactcgccggagcaggagagatgccggcgagcattagacgtcatgagaagttcagacatgcatgcaccccgagatgatatatgctataataatattagcaacagatttacacggctgattttcagtctatttaatgattaatcatatatatttgtcccaatttcaatcggcttaattcattcatgatgtgtttttaaatggatgttttttttatgtgttcgattgattgtgttgtttgttacacaccgtacatgcatgatcacattaaagtatgagaatttttactgtacatgcaatttaagccattgatttcgtttgatccaacgggtgagaaagagttgtacctagtagtactgtccacgtgattttacatagcatagagaggtgctaaagaagtaagggtagttaagtaatttcacgtgtatcttcttcatcttcctcctgtcttttctctctccaaaagatgctgcatgcctgcatcgatcgatggctctcaccaaggatggataggctagccggagtggaggtggaggggccgacgagcctccgtgcatcacttcccccaagctcgctggtgacatacgcctaccgcggccctttccctaatctcgctgccggattcgagcacataggcgaccgacgtaggtcctagtcgcctccgccgcggcgtagcagcctccgatgcaggcgcctccgttcaacaccaccggcgccgaccacccctcctgctcctcgttacctcgccaccatgcagacaccgccggcacccaacgcgccgccgtccaacaccccgccgctgacgcccccggcaccaccggcgccgaccacccctcgtcccgctcccaccacgcccttgctcttggtttggacttgctcagttgctcttggagtcttcgttcacacagtcactcagtcaaagagaaggagcatcacgagctgcttagcgtgagattttcaatcttaccctccgtgaatgaatggccggatttaaattggtacctcaaggtaccggtacctcgaggtacaatatgctggactggagcaatgctcttaaagtatacatgcaagcatggatggaagggcgaagacccaaagacctcctcgtacccctagtctacgcaatttctaagaagaggagagagtccctacaccaaggaaaggagaataatgtctgggtcggagatttagccttggagacaaacccacatatcacagtggccctcgtggagcagcttgtggcctttatggaccgcagtccgtggtgtgtagctagacgaggaagagtctgaccaaatctcatggaagttcacaccccatgactagtacttggcttcgtcggcctataaacacaatgcgttggcgtgctcgacacaacctttgattcattgatctggagggtctgggcgccaggaaaatgcaaactacacgcctggttcatcatcctgaataaagtctggacctctgaccgacttgcgaccaggggatgatagaacaacggacggtgcccactttgtcggggagaggacgaaacggccttgcacctcgtcactaggtgcagatacactaaaaggacggattgggtggccaatcatcagcttgagccttgacactgggagactactcagtcggtcaatgaatggtgggaagtgccagccactttggctggcattcccaagaagggatcccgtaccatgatcctcctcatcgtttgggaaatatgaaaggaatgaaaccagcggatctatgagtacaaggaggccacaacttcgtatcttctcgcgagaataaaggaagaagtcgacatgtggggtttggcgggcgctaagtgccttagtgagcttgttccgcaccttgtatagtgtacagtttttcttggcttttgccttttctttgctcttaggggttgcatttttctcccactttatttaatgaaaaaagcacactctcgtgctggatcgattaaaaataatggagtcgtctttatctgtaactagttgaaaccccgcgcgttgtggcgggcacattagaaaggatgaatatgcatgtaagtatgaataaacatgaataagtgagatataagtgagtagttctgctacctaaccaaacaggaatatagtttagtatagtatacaatttcaaaagtaagcagttctgctatctgatcaattaaagatgatatttgcatcatcaattgctaaaagtgccaagcacaaaaaactcatttcgagtccagggagttggaaatttatagtcacaatgacaacaccattcagatttactggaaacattgcaagcagaatattgttaggaacaccaagatcttcaccagaggataaatataagttgagtgaaacacatgcaaatataaaattaagttttgtttatttgattacagcaaactgtaggtaggtagtaatactatgagctggaaacagtaggaaactgtaaggtctaaatctcattgtttgtgacattttctccatcgagaatgatatgcatgtgaggaagtttatttttcatgtaattcacaacatgagcttgagttggctgcagcttggagaggtcgtcggtggatgatttcccttggagagtgatataaatagctattgatttggatgcagtaatcttggaaactgcttgcaggtagttggtgtggatgagttgcgcctcatggttcctgaagaagagtaatgcgtttgatgatgtatagataggcatatacaatgtacagagcactgaaatgcatgaagcatgttaaatataaaatataagcttgaaaactatgtaattaggaagctatagctgaacctggatagtgagagctaacctatttttttctggttgttggtccatctgtgttggcaatggacgttgtgtttgcagaagaaattttgtgaaggaaggactgtggtatgagaaattgagcagtgcacatgttgttgtggtgttgtgggtgattcttatagtatttcagtggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaatcgttagcagtgatggtgacagatttggtgcaggtctaatttttttaagaaaatctatatatgttgctgataaaaggccatgttgtaggagaattgtgaaggatttgaagagttgtacctgttccttgtgacccgatggctgttgatcagctatctttggctgctgcagctggttttcctctccattggtggaggtttccgttctgaatttagcagtcaaattagtagcaaaacatacatacatacatacatatatatatgcacgcgcgcgacacacacatatatatgtttataggctgaaacttaaggtgtgcacgtacacttttttatggcacttagaattttgtcctgagaaaattctgttgacggttgtttttccttgctgagatctacttgttggggatgataaagttgatttgttgcaacctgaatagtgtttgcaattgctgggctgatgcatatatgaaaggaatttagttgaagaatagtttgtatattctggaaaaagaacttgtatcagtgcagtaccttggttgatcaatgtgtaactccttttcaaattgaagagctctctttgctgaaggtataatttggtttactgtattgttgtctagagttgtttctggaggttgtagggatggtggcgtagtgggatgttggtcttctttgctgctattagttgtagtcataaatatagaaatgttaagcagaatataataagtaaaaaaggcatatgttggttaacctgcaatgttccatggtggttagcccttcatctgttgcaagttgtttggtggctgattcctgaaaaaagttatttttagattatagatggttggtagaagatatggtaaggacaaacatttgtatacctttgctacctttgtattttccagagtaggtagtatcaaacttgtattttcattttcaacgggataactcttcttgaggacataattgatagtgaagtgtgaagagtactttgtattcatggcaatgtgaaacaatcttgttttcccaatggctatatcaagagctatggcatgttctgttgcatcaattttcaagttctgggtagcttgagtagcatttacctcaaccaaatcctcagccacattgtagaatgctactgcgtccaaagttcctgattcatctttaattgttaaaggaagtttgtacctgaaagtttgtttgagtatattagatttgtttatagaaatgtaagacgaattaattaataagaaaaattagtattatagatatgtcacatacattggttttggcatggaatgctgacattgacatcttggagtgtcggagttgctattgtatgatgcagtacatgatttgcatattttgtagtaccaatttgtatatggtactatcgctgatacctttgcaatgcaactgtatgaattccctccctagtgtgtaagaaatattgaaatgattatttaattagattagcaacttatttagtgatgtagtgtgaatgaggtacctcgaaagcagaaatgggcagtcttgatatttcttcaagtttgtatagcttaccagccgcttgaagtggagttaaatgttcaactcgtggcatttgttgttggagagttggaatatcccattggtagcttgaaggaagattgatgcatttttgaagcaaatataaattaaaatcagtatgacaataagctatataagttacctgctttgatattcagcaatctctgttatatcggagtcaaaatatatttgtgttgctgaacttgatgtagcctctgttttgccttttaaaattgtagcacataagtgagtagtgttgtttatgagagggggtattaaaaagttatttgagggactgacctaaataagtccctgctgtaagtccagcaagtatagctactactattttgtggtctgtagatttctgtagaacaaaagcttcatcaaatgaccctccatattcaccccagaggactatttcttgttcttgttcactacaaattggtgaaacaaaaggtataaactactgtgtcatatacatttggaacataaaaatataatgcatatgtgatacatactctttgctacggattttgagctttctgtttttcttggatgatgttttgccagcataatcatatggcccaacatggctgataactcctatcagatctagaggcaaaatgttcgagattagttgtataataattaaataaaagaagatagaaaatgcaagtattacctatcaatggttttgatattccgcttttagatggtatctgatcaaatgggcagaattcaaaaccatagtttgggatggatgaacctcttgattctaggtgatgaacctttgtgctggacttaaactgcaacatgtatttttggtggtggtaaatatattttttgtttttaatgtcaacagtattgacatcaacaaacatgtagacacaacctagagttagtgatggacgaaattcattttcaagtttctttggaatagtaaactgcaccatagtgccctgcaagattagaactggtataagtctaaaactgcatcgttttatcagtaatatttagattggaagttaagcataggataaatcattttttggtgtaggatagtatacctcttcatcaagaattaccccatcgatgttgaatattgttggtgtactggctgaggccatgtttttagcatcccatagtctaataagtcgtccgaaaactttgaggttttgctgtcccaaatttatctgtttgagttttgttgctgatcccatctatggaaatgttcctgaaataagaggtctaaggttagctagtagacaatatcagaaaacatacattgcatataagagataatttgtttacaaaataccttggtaactaattcatatcattgttgaaacggtgaaaaatctcatgatatactacattttgcgtgcaatgttcatttgatgaactattgctgtttataagtatccgcaagccttttggagatgttactcgtgataacgcaacatataattgtccatgagaaaaaactggagatggcaagtatgcaccaactttttgaagtgtttgaccttggcttttgttaattgtcatcgcatatgacaaacgtattggaaattgacgtctttttagcttgaatggccacttagattgggctgatgtcgttataatacgcggtatgtatgcttttgaacctttggcttttccagtcattatttccccttcaatgatgcgggttgtgagctgtgtaacaataagtctagtcccattacagagacctctagaaggatcaaggttacgcaaaagcattatagaaacaccaattttgagatgcaaaacatggtctggaagtccattcaaagatattgtgttgcggaattctgttgggtatagagcctctagagttgaatggtttgcacagctatcatcaatagtatctgagctataatatgaaatttcagcagctgttacttgagcaatgattttgttgtttatttctgaaacaaccttatttgttggtgataaaattgcacgatcacaaaaatatgttgtaatattgcttggttcatatcctaagtcatacacaaaggaaatcaagctatcaagatttctggaatctgagggcaacaaaagagattggggtatctctatgaaagtaccattggtttcattttctattgaaatatgaggctctgtaccatttcctactcttaaaacccaatctgcaaatacccgtagttcttctttatcggatggtgaaaggttttgtgagctaagtctcatattttcagtcagttgaagaactacacattgatgccataagtatgaattaacaatagaagctcgcagaatttggtgccttgttgcattctgaataacaggaagtgtttgccgaaaatctccaccaaatgcaacagttattccaccaaattgcctatgctgtgcattaggtcgaatgtccgataatatatatctaagtgtgtgatctaatgcttcaaaacaatacttgtgattcacaggtgcttcatcccaaacaataagagatgtttgttgaataagttctgctaagtgtgtgttcttctttatactgcacatagaattctcacgtatgtccaaagggattttgaagcgggaatgaggtgttctacctcctggaagtaggagggctgcaattcctgattatgcaacagctaatgcaattttcccttgagttctcacaaggtttaataaagttgtccataagaaagtttttccagttcctccatgtccatacacaaagagatgttcttccctcattattaatgactgagttagaaatagaattgaatatttccgtctggtttgtattcagactattgatgtcattagcagatgtagatgcaatgctggtaatatcatagctgagttcatctagtaataatctattatctgcagatgcactaccaatatcatctgaaagtggcaaattaaagtgtgataaagaatatccagcatttctcaataatttatccaattcaaataatagggcattgccaacaaaagagtctgcaaatgaattattactttgtgatagattttgatttgttctgtatctaaaatcttcactcatatgctgggcatgttctgtaaaaagcctttgtggatttgtcacctcacaaaacagtaagattgttacaaataactgacgtaactgataaggtaaggcccagtgcactgcatcattgagagcatgggaccactcttggtcatcaccaaggagacctagagcttcacatgcagctcgaaatgttggatgttgctgtccagatatatttctgatttcagagaaggtctttggtcctttaactatatggagtaacatcctcaaataatacttctcccctttggttggatcaacatgagctatacgtccaatcttattgtaacaaccacgacgtatatcccaatatttttcacttgcatgccatgtaaagtattcagggaattcaatatatgtatgctctctagcttgaggaaattgactattagcttctaaccatgcagtaagtttggatttctgatttcctgggttttcaatgacttcttctaggtcatcatcctctgtgtacacaacattattctctaaagggaggtggaccggaaggcgttcaactgatgggtctgtatggtgtatatcaaactgaagtaaacgccaagcaacatcatttggggttacacatcgacattcaagatagttgtctatttcatttatagtttcatttgctgaattacgacgaataccagctctagaacaatcatagacttttgtaacgtacttaaaaagatacttatgcataccatcatgattaacactttccaaatttatgtgatcttggtacttaaccaccaaatcaacattatgaggaacaatgactctgttgtcaatgtcaaccccattttttgtaactatttgattgtttggtcgtgcgtattgggtaaaaccattttgcaatatataagtgtgttcacagaattcctttggataaaatttggagcaccttccttcagacatgcatggtgaataggaaattccaggaccgcaaggcccatggatcataaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatctgaaggttgttgtccaggtgctagagcttgtagaatttttggccaagatgcatttgatgtgaatgtgacaaaaagatctgggcaaccatacttcctacaaatagcaatgcagtcttgatagttttgatatagataccgagggcttccagtatgagaggctggtaagataacccgttggccagccgaagaaccagttgtaatgcctctagacacagagctggctaaagaattgaatggtgccaatctatatttgtgttgaaaactgggcaacctatagtgttgtatgcgctcaccttcaacacaacaatagccatcaaccaaataagattgggttaacctcccacaacgtaatggagtgttgaattggcccgctctatcatgcattatataagcaaagaattcaaccattgttgctttgttacgccgcaaggcagatgaacttgctgtttggttatacatgttggattcatggaaaccatcttcaccatatgggaataaaataggatattgcatggccataaattttcggtgtttttcatctatacgctgcaattgtgatgaatggtgttgtattattatatcccgaccaatatcagtcaccccaatatccccaacaactaattctacaacctctgctgcaactggtgcactgtatatatctccatgtgcatctgtcgagccaaatagtcggatcttgtaatgatcagattcattttcacttaatctttctcttgctgttcggaataacttcacaatgggattgtgtgtatcgaacatttctattagagagcgaacaatttcttcattggcatggaaggagtcgcgagaagaagaagcaatgttgattatgttagagatttcattttctgtatcgaagatgtatagctgagcatattctggccgacgaccttgtgaaggtattaaagagcctactctgtggcagatctatccactaattttgaagacatatggtccatggccgtcgttgatggattcaatganttnnttaagcccccccccccaaattttttgggggcgtatagaaacatggaattgtatcgatgaatatgctgcaagaaatgatttgaaagggagctcgcagaagttaacaaattcaatatgggttctggaggtggattacaaattcaatatggctgccaagattaagtggagcatagattgttcctaacaaagtatatgaatggaagatggcagatactgttatatataagatgtaaggttggcgtatgtcaaattttacgtataaaggatatgataacatacggtgatggcgaaatacttggtttgatgtagacacagatgaagaattattactctcagctgactgtgaatgagaggatattccaataattcgttgttcattagccaatggaggagtagatgcagatgaagagcctatttcagttatgttcaactctcgatgcaaagaccgttgttctgaagataatgctatatgttgtgaagggaatgtgggtacataattagataggctataaccgggtaactaaggtaggtaggcaacgataaactttacattactaaaaaaaaattgaaggtgtaaattggggaaccaacctctacctctatgggcatccaatatgagtttacgttttcgtcgtgattcagcagcagtagcatgatcagggtgaggtaccaaaatatgtgccagtggacgtcttgaccggcgacgtcctactggaaaacgtgaagtactttgcccagcatccatgggttgaaccctttgttttttagttttaatcaacaaagcatctgatcatatatttacaaatatcggatgtaagtttattatatttgaaaatgtaggagtatacgcataagatgtaactggaatatgaaatcagaaaagagatgtacaaaaaaatatgaaaaatataggatgagttgaacaacacacataccgagcaaggttatctgcttttatgacaattgtcaggcttctcctcaagtgatgaaacaaatgttcttgtatctattaataaaggataggtgaaagaagtataagctgcaagcaccatttttttaaagaaactaaaacagtactcaatgcataggtctccaacatgtgcaaaaaccacaatgtatgctcgaatataatataacctggcaaaattcatgtgaaattcacacatactgaactgaatcaccaaaccaaccaaaagctttcattttatcacactttttgcgacaaaaatgcatcataacatgaactatggatttgcatagtttgaaaaacagtataagctgcaggttctatttttttaagaaactaaaacagtacccagtgcataggtctcctgcatgtgcaaaatccacaatgtatgctcaaatattgttctgagaaaaatcatgtgaaatttacacatactgaactgactcactaaagcatccaaaagctttcattttaacaccttttttgtgacaaaaacgcatcataacatgaactatggatgtgcatagtttcaaaaattttgataacatttaacgtatgttttttaaatgattttttttcacattttaacaggaaacatgaatagcatggggtgagctcaacagaagacataccgagcaggttagtagcttctcgctatgtcaggacatctatgtagcaatcctctggctcctcaccaactgctcaaatacattaaagttataggacatataagtatccactgcaaatatcagtttattttttcttaaaaaactggaacaacaatcagtgttgaaatcataatgtttgctcaaatagaatatggagaaaattgatgtcaaattcaggcttatcaaatagaataaattctcacacttttttttcagaaactaaaatcacataggacatataagtatccactgcaaatatcagtttatttttcttaaataactggaacaacaatcagtgcataggatagggattatttctttaggtgtagagaatccaatttacaaagctttcatagtgatcttgcctggttgaaatcataatgtttgctcaaatagaatatggacaaaattgatgtcaaattcaggcttatcaaatagaataaattcacacattttttttcagaaattaaaatcagtactcagggcaaagaaccaactcaattcagacatatttttttcagaaactaaaatcagtacttagggcaaagaagtaagaaccaactcaattcagacatacaaaattagtaacgaagcctacatacaatgatctgacaaagtttgatccacaactaacctatcttgccgtgatcgcaatcatgtccgaattggagaatatgcttgcaggatgaagcgatgatgtcgagggaggtatggatctgaggcttgcggatggatggatgatgtctgacggagaggcacaggtttgaggagacgtctggtagcactggggattgcaagaggattatcaaaaggtttggaagaggcttacgaagagaaattgcaagaggcacataaatcgtattaaccatcgtgcctccagtaccataatgattttggccgtttctaatgtaaatgcacatcattaagggcggggaatgggaagaagcatggtgattaccgtttctgctagccaagaagatggggagggggcgggtgatttcaccatggatggtgccagggttccaaatgcttcttcccatcggatggatggcgctagggtttccgagtccagacgcttctccccatcgccgtatcgctggttgccgagtccagacgcttctcccccatcgccgcatcgatacacagctccccatcactacctcctactgcgaccgagatgagcgcggtccccaccaccacctgcgcgccatcgccgcctcctgcgaccgagcgccctgtccccaccgccacctgcgcgcgatcgcgacgcggtgggcgagcgctagggtccgtcgcactacgccgctgctgctctgctcaggaagtcaggaggagatgagacataccgaaccctaaaatctctcattggactgacttgggcctcctgggcctcacgacttgggcctcctgggctgcagtatatgtgttgtgttcgaccccgaggcagattgcatccaacggtgcagatgcaatctaatctaccgatctaagggctataaattaatgatgacgttgatcattgaggtttaagctctaggatcttaattgcccgtagtgggggataactttataggaaaaagggatactaaaaaaaaaagctaaaaaaaagcgcgctagctgtgcagcccagcagcagctaggccttgggcccttggcccacgcgtgcagcaacgcagcaagcaagcgagcagtagcggcagctgtagctagcttagtaccacctcggctagctagctccatctacactagcttaaataggaaatgttgccggtgactgtaacatatcgattccagaatttatgcagcgtgttacagtgttaggtgactaagagtatgttggaaaactctgttcattttttaagggtatgttgtcttatttctgcatgtctcttagaagtcaaaatttataaatatttagtaacatagatcaatttgtgatatgtcactatagaaatatgcatgttcaaattcaacttactttgatctatcttactttttttatggcattttaaatgccatgcacgaatgttcccttgaggaatttttttaaaaaaatccacttcctgtttggtttgctaccaatttttattcacgtagttcaatctctatactaacaatttgataacgcaaaaattgagtccaaatcaaacaagttaatttcgcgcatctggatcaacttggatcccgacagaaactcctaaactccattaatattgttgaagtaatccggttttgctggggatcatggcgtgtgtatcgctccgacgcatgctgcgttcatgcgggagctctttccagttttttagtgagtgcgtgcgcttcgtgtgttctccgatcgtgggatggcgcggtctagtcaggaggcatggcgaagtggcgggagtttaggaacgcatggcaacagcttcggtcgtgggatggcgcgatcaagtaggaagttgtgggcatgtaatttactatttaaagtttcctaatacaacagaaaacgctgccaagtttcttctcgctcgttctgttttgatcggctaaacttgcggtagttcgctaacaatcttcatattatatatgcagcctgcctccatcacgaccacgacgtactcacaacctcgccggagatccaagcagcccgttcgataataatcctatcggcggcggcggcgatcaccgaccggccaagcagcatatataccttcggtttcgtaatttttctctcttgttcgttctccatggcggcgaatttcgtctgcttcttcgccggcttgtgcatcggcatatcgatccaggcgaacgacgaagagcagcagcggcggcggcgcctcgtcgagctggagcggcgcggcgaggagcgggagaagcaggtcgccgagatggtgagccgggaggaggatcgcgagcgggagcggaagaagaacctggacaagctcgaccagatcgtccagatcctcaggaatctgtgaccggatagccgccggccgccgtggagacgaggctcgccggagctaggagagatgacaataacagtgttattactactgtactagattattactccctccgtcccacagtataaggaattttgagtttttgcttgcaacgtttgaccactcgtcttagttatattttttttgtaaatataaaaaacgaaaagttgtgcttaaagtactgtagataataaagtaagttataaataaaataaataataatttcaaaaaattttgaataagacgagtgatcaaacgttgctggctttctctgtaatcatttgtcccatatttttcgcttttctttgtgatcacttgtagtaccaaatttaggctttgttctaatgtgcaagtcatttataagcttttcgccaaccagtgcgtaaaacgagagaatcaatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggnnnnnnnnnnnnnnnnnnnnnnnnnnnnnnnnnnnnnnnnnnnnnnnnnnnnnnnnnnn

SEQ ID NO: 22134 - DNA, 1090 bp, Oryza sativa
ctcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaagaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctctcgttaattaaatgtaggagctggtaatgggattacaatttcccgcaagatttggcggattctattggaatctgggtgggtgtccggtacttttgtactaacgtttcatgttgcgctcttcctcttcattgggcacgggcacatccaaggctacatccgtatctgaaagatggagggaatacaaatagagaataagatgatgctgggcgataaggtcgaccttaaatggatttaatacagcaacaaatgcttcagcaaaaaaccacccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaat

SEQ ID NO: 22135 - DNA, 67934 bp, Oryza sativa
  unsure (1)..(67934): unsure at all n locations
agcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggttagaaaaaaattagatagaaaaactcaaaaaaataaaggcttatgttggattggcacgacataaatccagtcaaaaataggattaagaaagaggcaaattatttctaaatagttagacaacaagggatactagtgagcctcttctagttttttattcatttaggtcttcaattaactcaaagttctttctttttctttaaagaatatgccctttcttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggattcgaacctccgagtaacgggaccaaaacccgctgccttaccacttggccacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttgaaagtgatataaggtgctcgaaaatggttgaagtaattgaatagaaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaagcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggntattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccggttttcaagaccggagctatcaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaattacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacacctggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaagacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcagannnnnnnnnnnnnnnnnnnnnaggactgaaaatcctcgtgtcaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatataaagatttcttgtcaagatgaatattctctaatagtagaggatatcctgtgatctgtttcttataataacaaaccaataacaagcgggtatttgcttataagaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccttacttcgcttcgctatctaataattttttctacccctcttccctttttctttgtatcaactaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttcccggagaacctgaaccggtaaaaacttctgccacaaaaaagggttgtgataagaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacaatttgagccctactctactttcttatctaggacttcgatatacaaaatatatactactgtgaagcataaattgctgtcaacaaaaaattttcccagtatttaaatatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagttgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgtttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctcccc

SEQ ID NO: 22136 - DNA, 20033 bp, Oryza sativa
gaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtacctggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagctttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatgaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttct

SEQ ID NO: 22137 - DNA, 2002 bp, Oryza sativa
  unsure (1)..(2002): unsure at all n locations
cattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctggtttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgtatgtaaataggtatatgttcctttccattatgaatcgcgaatggatggccaaccattgcgggtagaatgctagatgcccgggaccacgttactattgggtctttctcctccttcatattgaccttttctatttttgccaataaatgatgagctacaaaaggattcgtttttttcgtgtcacagcgaatactccttttttttcatttaaagagtggcattcgatgtcaatatctcgatcgaagtatggaggtcagaataaatagaatatgatgaatggaaaaagagaaaatccttaagctgataaggggcggatgtagcaagtggatcaagcagtggattgtaatccaccatgcgcgggttcaatcccgtcgttcgccatcccattattgcaaattccaaaaatgcatttttccatattcctagttacgtatttacttgcggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctatcaaaaaaccccttcccaaactgtannnnnnnnnnnnnnnnnnnnnnnnnnnnnnnnnnnnnnnnnnnnnnnn

SEQ ID NO: 22138 - DNA, 2586 bp, Oryza sativa
  unsure (1)..(2586): unsure at all n locations
agggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 22139 - DNA, 739 bp, Oryza sativa
  unsure (1)..(739): unsure at all n locations
tatatcttctaccaagacattcaccgaggaagcggaaatccttttgaaggaagctattcaggaacaactcgaacggttttcccttcaagaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgt

SEQ ID NO: 22140 - DNA, 586 bp, Oryza sativa
  unsure (1)..(586): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccccatcgtctcactggccgaccttgacccctgttatttttgggtcatatctagtattcagagtttgcctcgatttggtaccgctcgcgcagcccgcaccgaaacagtgctttacccctagatgtccagtcaactgctgcgcctcaacgca

SEQ ID NO: 22141 - DNA, 15126 bp, Oryza sativa
  unsure (1)..(15126): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcaaaccagcttttttttggcattacttcccaatatattggcagaagaaaaccatgcaccattacaataggcatatggaacacattattactcaacagtcaacaaatgccgcagtaaggaaagtaaaaaaccacatatttttacaagagctacagtttcagatctaagttcaatagaattgccatagcatataatctagccacagggagtgagcttcttgttgcctgcaccacgagggttatcgtccttccagtcatcccatgctcttgctttctcctcttcagcgtcctcatcctcttgggctgaccgactgccatccttgtgccatgcggagtttgattcttgaatcatcttagcagttctttcttgccatttctccatcattttcatctcacgtaagccagcttcttctatgctcatcgttggcaacctaatagtccaaatacaggaaaaatggaaacagaataattggatcaaaggatagtctcatatgcatattttcactaacttttactgaacaatgcaatatcactttaatagagatgatctacagctcaacacttagttgctgcaggggaaatctaatgttttttatgagcaattgcagaatagtaccatttcttggaatttttcatggattatgactaaacataaggtcgcacctacaaatcactatctcagcatctatacgattgcaccaagcgttcgtagtcacaacagagtacaagacaacagtttattgtcagtgaatctagtattgcactgagtagcaaatttaacatggtgcctttccagcatgaaaaaaaaagaatgatatcaacaatgtaaaccacaaatttgtcacagacttatggcagaacatacaacaatagaacaaggaaacacctacgattgaataaacacagtcacatactaatgtggtgaagcaaatacaatgtaaagaaccactttacaaatttaccaagaaataatttgctcatcgagtaatgctcaatggaataggaggtcaaagttcctacaaatatatcaaagtatgactaatatgatgcattaaaagttgccacaaataatgccccctccacaaatattaaaagaagcagtgcagttttcagccaggtacgtagcagtattttaaagcatacctgtaacttggctgaaaaacttgtgctgccattctctctctttcactggttagtcctccaccaacaagacttgcagggccaaatatcagcggctggtgtttgtgctcatgtgcttgtgaaacacttgctctaccttcaatgacatcttgagcaaatgttgcacaagtgattggatcagctggcttggaatatggtgcacggttggcagcattatggtgccatgcttcagccttttttgtacgttcatcaagcatttcacgagcaaatgcattaccatcctaaaacatcataagcaggcaattatttcattactaaaggaaacctccatgtaagtgcaaagtttattgaaacagatatgcaacacaatgggagcaaagataaaaaaaatcttcttttttttcttacggtagaatatctaccatcgagtgctacaaaaggatcatgaaaacaaaatcaaatatctaatattacttgcatgtagtaacaacaaaacactcagcactctgcacacacacacacacacacacacagagagagagaagtgtgatgaaatacttgcaatggcaagttattatcatattatgacaattaatttaattgtatgtccaaactcagaatccggtgtatattttttttcaaacggaattactgtatacaactatccagctatctacttggtgaaggtaagccctactacaacataagctcaaggcttatccaaagcgaagttcaatanttgtataaggtacnagaacggtacaagaagaaaggttaaaagggcaatatgatactggaaaggatcaaccaaagatactattgacaagacattggcaaagtttattcatttgttttaccttcgcttgcctttcttttactgccagaagcatttcttcttccttctttaacatgtcaagaaggtcaaaagcctataaaatgaagtagaaatgagtacgtctgatgatcaggataacaaagcgagcacagtagcttaaaagaatgcaaataaacattccaagcagtataagagaatcattcttgcccacaaaacacaaaccttgcatagagccaatgagatagtagctaaccatgcctgcaacatagaaccaaaaaaaagaatcaaaaccacagcataaccgtttgtcatttgtacatcaaagtaaagttatgacaggcatggagcccaaactttggaagcacacatcgacagatcccaaaaggttgattgcccacaaaagtaagagattgtatataaaaagcataggaaagacattaagcatcatattgttacaggaaaaaagattggtggtgacaatctggcactacagaacaaatctgttgtgtgtttcatggccacaaaaatgggctaattcaggaaatgcgatcagttccctatgagatttttaaaacctatcttgaatcatcaaatttgtcaaattccatcttctattgaacagaacaaagcctttcctttccttttcttttctggaaaagtaaatatttttcttccacttctagtacattgtagctaattttagtttggagtattttcaaatatgctatgtggtaatttaagaatatatcatgatgtttccatttggtaaacaagatcagatttgctacgtaaatgggttctaaatgtctggtgctaactgctaacctctctttcttcctctccatcatcctcaaaagcatcttcctccccagcttcaataggagctgataaagcagctgctctcaatgaccgcctacgcctttctttcctctccttgatttctaggagctttgtttctgcagccttttggcgcttgaaccgtgcaacctaggtttggtcaaacaagaaaattagagtggaaattaaccgactttggaaaaggtcaagcagattatgagtcccagattttgcagtctcaataagagatttggatcccagcttattgtgtttgtaaattgcagaatgattgatgacccctttaaggctttaacatattcgagaaaaaatattttgccaaggctcaccttctgtgctcttcgatttgccatggtatcaggttgcttctgcctagacaattcaagctcatcctctgatataagctccagtgcttcacagatagaaatgaattcctgcgtaaccgtagtgattaaaacatgagtgttgtgatgacagagtgctcccaattgaaaagggcataagaaagacatgacaaatatgcaccaaatcaactaaatgtgacaggacaaactgatataaccttcaaatgatcctgcgacgccttaaggactgggatccgatcttcctgcgctaccctttcagtcatttccccaaggtagtacggcacctgaagaaaatcaatcgaaatcacagatataaccacatgtcgcagatgcacaaacatgatatgataagagaaacggaactaaacgcagatgtagtgggggaaacaagcatacgagtaggtatttgaggttggcagtggagacgtcatccttggtctcgttggaggagaagaggccgagcttactgaccatctcgtcgcaccgccgcagcaggtcgacccccttgcggatcccttcctgcaaatatcccaaaccaaaccaagcagccacagtaagcgctcgcatgaaaccgccatgagagggttgatggggatgaggagaagggggggtgaatcgagggaaaacctgatcgaggaggagctggaggcgaaggagtggacgtgagaccccttgtcgaacacggcagggagcgtgaggtcggcgtacttctactccagacgcgacgcagngtggaggcgcatctgcgcctgcatcttgttgctgacttgctccacctcgaccattctcagtcgcccagcgcgcgagaggggagagatcgccggctaaaaaccctaccggaacagcgccgcgcggaagaagggaaacgggaaacgtccgaaggggggagggggaaggcnccgcatttgttgacgggcgcgcgttgctccgatggagcgttgatgatcgatccaacggcagagatcgctgtgttccgcgcgctgacggactggcagtaatgtttacaaaaaggcccttgtttcgggctatttttgtcatgaaggtgatcctagtttttgcataacaccccttacggtttgttttcaccctaaggtaacacaacactcctaactccatttaatattataaatctttttgatacttttcctagtataaaactaaatttatataaaacttagcaatatctataataccaaattagtttctttaaatatgatattaaatatattttatttgttttgtgttagaaatgttgctagattttttttataaacatgatcaaacttttagaagtttgactaagtgaaaagtcaaagcgacttgtataatataaaatggtttttaagtattatttttgttaaagcccctgtttcagcatcgaacattaaaaaaagatcctatttttttgcaagcgaatttatgtgtggaagtttgtgtgtatgtgtgtgaaaaacacttttatttaaggaaagtgtgaaaaacactttgtgatgaatctagtattaacccttgacagttgcgagtacgcttatggttaacaaattaatcagatgaaagaagacttagggcattcccaacccaatgactaggatgatgtccatagcattaaataagctgccacctaggataaaaaatgaaatggcaagtgaataaatgagaaaagagaaggaaaccatatattgcatgagatatggtttctacacaacgtccaagatatcatgtgagataagtagcattaaatttaagtatggaatagtagtgtttgcattgaaagagtagtgtctagtactagtttcttgatgatgtggagtttatggaaattatgtctagtgtcttgggttggaaatgcccttatggttgagtacacttgcacacaaatttatgtttggtagttgcaaaatttatgttagtaacacatactgtaccagactctttcatctggttatgacttatgagtatctttattagcactagacacgaattatcaatatatcagtatatgttagtactaacatgctaccagtacatgaattctatgtttcacttgaacaaactacatattcatggagcttgaaagaaagaaagagaaaaaaaacaactaacttatggcgatcacctttacaacgaaatggcagcattctgcttccattacccaaaaacatcatgtctcaagcgacatgaagaaactttctttctagagaaggaaaaaactcgagcatctctttacatagatcatttgttctaactgccaactattgctaactgctctagtctccagacaaaagttcattctgatccaatctttcgcactactaagaggccacattctattgtgtggtcatttaccccctttacactattatcaaatggagaccattctcttgtcttatatggtctcaccatctaggagtacttccttggtagccctcagtctggtttctctgtctactgtttctttgctgaatgtgcccaccactattccttttccttccagatatgctgtttgggtcctggtatctattcctgttgaccccattgaagctatccctgtagtctccagacaaaagttcattctgatccaatctttcgcactactaagaggccacattctattgtgtggtcatttaccccctttacactattatcaaatggagaccattctcttgtcttatatggtctcaccatctaggagtacttccttggtagccctcagtctggtttctctgtctactgtttctttgctgaatgtgcccaccactattccttttccttccagatatgctgtttgggtcctggtatctattcctgttgaccccattgaagctatccctgttatttgatgaatgatgattgttactattattccaattgccccaactagaatccgccaaggcactagaatccgccaaggcactaccccaaccagagcaatttttactccattcattccaagattcatgctttgttccccagtccatgttggatcttgaatcttgctcccacttgttaacttcagtgggcttttctacatagatgtcccagtttccagattggttctgcttctgctggcacttgttatctgtatcagtgctgcccaatccatcagctgggagtaactcatcatccctctcgaatggtaagcgtaccatcttcaggtcagctatcaactcagggtcgatcttgctattgtggtcaatcttgtcaatatacatatcagggtctggcaaagatatgtctgaaggttggccatggtaattagcccagaatctagcctttgcattcttaaaattatcaaaggcttctgagtcatcccattgctcaatgttcttatacatgcagacatatctcttgttgtcacagaacctgtgccaagaaatgccgccaacataaatgcaaaattccctttcccataatgggactgggtggcaattgtgtcctgtaaatacaaaagcaatatcagattcattgtagcagcataaaaatgcaaggagatgatgaattctaaaatgtttatacaaacaaataacatatacaaaaaaattctggttagattgcttaagactactgtacagattagaaatcgcctgcagattttggacgggtcaaatccaaaatattagcatcccttctaaaagtatgggaaacaaagacaccaaagcacccaacggttacttcctaacaggctaaacagaagaaccattcaggctactggataaatgggttcagtactaaaacactagcattccttctaagggatgctcctttgtcgccacacaactgcgcctctcatgactatgtcagttatctaatagtttatttttaatagcaattaataacgtctccttacgcatatcatggatttaggatccggctgcttgaggaaaaaatgtaatggccacgtaagaagttatcaatagccaatttaacattttgtgtcccctcattttttctgaagatatgtgcacacaagtgctccctctattttttttatttgacgttgaattaaccaaagtcaaataaaaaaacagagggattagtttgcttattgcaataccattacagttcaaactatgaactgatacttggtagtcaaataaaactagcattttctgacatttgggtaccttttcaaatagtaagacaaattagaccaaaaataataagcctaattgtaaaggaagtcgcagtagcaactctggttctaagcttaaattgaccgcatcacacagtacaggacagtccaccatctacaacagttgtgtcattgttagggtggcaggaagcaaaatgatattcatgcccattccgagacctccaatccacaggaaaatcgtcagccaacaagaaagtactagacctagatatctagatcgaaaattttccaacccgagtcttccctaacaaattaccatctgaacaccactgtacagatttagaaatcgcctgaaatagcagcatctcttctaaaagtatggaaaaaaaagacacccaacagttactttcataacagactaaacagaagaattattcaaagtactagataaaagggttcaatcctaaaatactagcattccttctaatggatgctcctttgtcgccacacaactgcacctttcatggctatgtcagttacctaatagtttattttaatagcaagtactaacaatgtttcttcaagtatatcatagattaagcatactgccgcttgaggaaaaaaatgttacgcccacataagaagttatcaatagccaacttaacattttgtggctcctcatttttctaaagaaatgtgcagtaagtacagcgcttcgtttcctttctccattaagtacaacctcaaccagatgactgtgatatggctaatgcaaagcaacgctcttttgaagcttctagaattatcctaattttagagaaataacttgtatgatcataataacataactctgccttccatctcctagggtaagcttactcagatcagcttactcttgatgggtcaaaagcagatagagtaattcactgttaaatctttttacaaagatatgaaaatacgcatttatttttcacataggaaatatggaaattcaagatccccttgaaaaatcaaagtgttcctgcggcttcttttgagaaacagtatactaacaaaagataatttaattataagaggttggcagaagggggataaattttgtcaattctgtgatacagcagaatcaatgcaacacctttttatcgaatgccgaattgcaaaagtgatctggaatgttgtttgtagcaacttgaaaccttttagagatataaatcatctttttggtagttggatggagagctttcagaaaaacatgaaacatcccatttgggttggtgtggctgctattttatgggtcatttggaaaacaaaaaattctgcttgttttaagaaacaacttcctggagatcccacagatttgatttattatgcttgtcattggattacatgttgagctggtttgcagatgcaggaggaagagcgaagagggctgctgtggggggtccagctcctaaagcaatttgtaaatgacatcttcaacacaaggttcgggtggagggtggggatgaagcggctaccagctagaaggcttcactctggagtttgatttcacctgaagcactgacccggttcttctcactgttgacaaaaaactggaagtctctcagtagggtgggcttttgatcaggttgggctgctgggttctgtttggctgagtccctagagtggctccctgtgtctttactttgtgctggctgctggcaattaggaggttgtgtgttgacacccaacccaaattgaccaatgaaaactctatcaggatagttggtggtttccttttatgttttcctgaaatctgtagctacatttctgttaatggaaatgtgggaactgggaatggcccttgctctaaaaaaaattcctaggctaggctcctagtcatgccacattaaggtccaggtgagttggaaccccccatgtaataacgaaatgagctagggcaatttagtagtgttcaaaatgatgctaggcgagtgacggggtaacatggtggtgtctagttcctagttagcaatagttggcctgaatggcaaccgtgctaggtggcaggttggtgtctagcaagattcaagtacagaagtggtgcaccatggttatgtttcaacatttatatttcttctagtgattcgttcaaaaaaaaatttcttctagtggataaggagaggcggtgttttaaattttggtgggaagaaaagaccatcctaaattattactatttccattaggccgttgtatattactttggcgggaagcggagaatatcctaatctagaaatgcatcaccactatttccgttacatattcttgtcggaacagatgacacactgtgcttactgtgtggttggatcaaatgaccaactcgtatatacaaagtttgcacattagtagatggcaaactgcaataccattacagctcaaacgacaaattgatacttggtagttgaataaaactagaactttctgacatttaagcaccacattttgaaatattaagacaattagacaaacaataagattattggtaaagaaagttgcagtagcaactctggttctaagcagacagtccactatctatgacggttgtgcattcttaggatggcaagaagtagaatgatattcatgtcgattcctaaaattccaattcacagaaaaagcattaaccgacattaccagacctactgactagatacctagatttaaaaatttctaaccctattcttgcctaacaaatcaccacctgaacttaaatcgaatcatacaaaaacgcaatccaatccatagaaacaaagggaacagaacaagcaaatcagtcatccataccgggatgcggaggaggtgaaggcggaggcggagggcgttcgtggcggctcctcctgtgccatggccgccgatggtgattccagttccccatcgccgggaggaagaggaggaacacccaacttcaaaatgattcgccgatgctctctctcgctctcgacggcaatctcctccggcaaaccggaatgctatctcgccatggaagaactaggcgccgcccctgcaccgcgagattgggcgccgccgccgcaatttcgcaaacagggagatgagctgaggcgacggcttgccggagaaagctatagctttaaatgaagcccaaagaggaagctgctatagcttcacactgactcgtgggccccggcccatcgaaggctacacgtctccccgcgggcgtgtggccttcttctccctttgacccaagcagaagcgtctcttctccctcttctccggtatccttcgctccatccactcctccgtgctctgcgtcgccatggccgcgcgccccgttagtagcaccacctccacctgccgcccctgccgcccggcgcaggccgctgcttccaagccctccacctcctcgtcccctggtacgggtgtgctcgtgggtgtgccccgcgagcgcgggagctcggtttccaaggcagcgattcgtggagcgagattggaggccgcggcgaggtgctctctcgtccgccagcgccccatgctgctggcgaccgtggcgggtagagtgttagctgttgactgctcccttcatgtgttctatcgctggcaatctgtttgatgaaatgtctctgacgttagtgagtggtgtttcttggtcgcagtggggagtctggttggttgctgctggcgctgcaaatgctacagaaattggtgattctctggtgagggagcactatgtgccttcgaattttctgtccccttcttgctgatcacaaaagagttcgtgatgcctgtatcaagttgtgattttaacatgtcaaattgtactactgcgtagaaacaataatgaattgtagtcaacagtgtagttatctgtcataggaaagagaatatcatatattcctttttattacattgtgatggcatatagctaatgcgtgcataaaattttattatgatcagttagggtcatctggacttgctttggctgaccttagcattggagattggtttggaaatttgctttattcagcgggtcagcaagccaacgaggctgttcaggatcagctctctgctcttagtttcactaggtaagcatttttttcccctgcggtcaattgcctatggacagaatctgtttacttactttctcagattatattttatgtttcatgtccatatttttttctgacatgtttctctattctccagcttggctgtaattttcggtgctggacttgtaactagtttgtctccttgtacactcagtgttctaccattgactctaggatatataggcaagtatagcgattgccttttgagatgctttttttttgttgcccaggatcagttacaattgatggcactgatctgatgacatattctttaaaatctttcaggtgcttttggctcgggcaaagatcgatctgaggtatattctattatttataaaataacttatagaaattaaatagagcatgtatacccaaaacctcgtatgccataacatccattcaccatgtagaagaaaaaaacttcatccatgttattcttgatgtaaattgatatgtttccattctatctattaggttgttggaaattcagttgctttttcattaggactggcaacaaccttagccatccttggtgttgctgcttcttttgctggaaaggcctatggacaggtaggacaaggacttccagtggctgcttcagggttagcagttatcatgggattgaaccttcttgaggtaaattcatgatccaatgtgaaaactcataaagcggagcatgccaattaatttttcaagctaacttgttgccacaattcaaatcaagtatcagttgatttgatggttttccttttataaataattgtaaatcctttgccgcgatggtaatttatttcaatgaaatgtgtatcactcctgttatagtagatattagctcactgccttaaactgttctctatgctggttatcttgtatttacaggtaattgagctacaacttccctcatttttcagcgattatgaccctcgagctgctgcagctaacctcccttccagtaatgctttgacataattttctattttgtatcaaagtaccatatgcctcattatgtttatttcagttacggtaaatgatatcttgctgtttccctataggtgtacaagcataccttgccggacttacgtttgcattagcagcatcaccttgcagtacacctgttcttgctacccttctgggatatgttgccacttcaagagtatgcataacaggaacattcataagttacattaatattttattactttttcttaaatttcaaaacagtaaaactgtcataaattttaccatagtgtctttaattactaaagttagtaaatcacataccgtacgatatgcagtaattttgatttctttgtttctaatatatgttacacttgacttagcaatctgtcataattgttggcaagaagtttatgttcgcctaatttattaattttctgacatgctgattacaatacattttctgtcaggatccgattgttgggggaagtttgttattgacttatacaactggctatgttgcacctcttctcattgcagcttcttttgctggagcactgcaggtataaatgccttctgatatacacatctggttaagtatagataagatagttccatcaaatatggaactttaaatctcacttagacttgactaacagtttaacagcacaaatcctagaacaacaacacctgttcattttaagtttagtgcctgataaattatttgctttctgtagagtttgctttccttcaggaggtattctgcatggataaacccaatcaggtatgtgccttagctctttctggatcttgagaggttcctggtttgtaatttgattgcaaaagacctgcacgttgcaattaattatctgtatgaatagtaataatttttttactaccttttacaaaggaaacactgaaaatccatatttgttaattgatagcattcgctacaatttcactgtcttggttcaaagagcttgaaatcacatttgttgggcatgcttctttcagagaatatagcacatcaaatttaccttatcatccatttaatattcttttgtaagatattgttctaaacttcttgccacaattctgtcatgtgctttgcacagttccaattcctcagaaacattcgtgttctttcttttttaaaaaaaggaaggatctctaaaaaaatataagccattccttctttaaaaaatctgccttttatactttattttttttggattaacgccttgcgctaacatttgccatttgcttggtagtggtgcatttctactgggtggaggggtttataccctactggacaggctgtttcctgcaacatcaatggtgatgtagaatgcatatcatagtcgaacaagagctgcagtacgaggatcgccattgttgaacatgcgaattatgtcagagttgaaatgtaaagtaggtaatgataaaatgctaacgaactatcatcagctcttcgtagcttacataggtatatatgatatcttagtctcagcaatctgtatagaacgagataagttttaccccccacacccacccacaaatgttatttagcttccgttgcttttaaagaatacgtggaattttgtagacagaggcaagagcagaacagagaaatatatatatatatatatatatgcccttctacttcaattcacaggctgcacaagtcgatgctaaacacgatgaccaaaattgctacggataattcatttcggtggatgcattaatgctcttggaatgtaacgaattctttagagacctcataaactcaccacacatttctgctaagacaataacaggcactaggatacttcatcaaaactgtaaccctcgtttggttgtattgtgctccaattcatttcattcatccaccccatactcttagagcattacaaattcgttctattatttacagccacattcagaacagtgcgattaacaaagagacagaggtgccttgttgaaaatggataagaatttacttgttcattgccctgtcctatttgtcgctcttgctcttactcatacccaagaactttgtagtaagtgctaagatttcaccgtcaaaattataattaggagctgtaaacttcaatatagacatatagtgagggaaacatactattcccctacacatatattcccaggccaacttcctttggatcagtctctatcatccaggaaggcctgtcaatcaaaatttacggtattgtgtcagctagcatactcattattgattattagcttactaatgggtgttgaaattgagcagagaggacatcacttgttcatcacgaagatcgttgttccttgagacgcccgctcaagaagcaccttccttgattcaattgctactccctctggctgcattatgaataaaagtggtgattttagaaaattaaaacaatactcccactgttatgggttaggattcatagggggtaaacaccgccgagaggatagccgggcggcgacggctgctagggatgagagggggacttaggttgggagagactaatcttgattcattgcttaattagaatgatgatacaaaccatccttatatagatggagggaggacccagtctaatcctatccaaccaactctatccttatccctagggcctcgacccctcggcccactacctatgacacccaccgtccctaaatat

SEQ ID NO: 22142 - DNA, 21877 bp, Oryza sativa
aatcccttatatttagggacagagtgagtatattgtgtcgactagtgtgttattttgtcctcccattagtgcaccactaacctcctctggaaaccatacgccaggctgtgtgctgccctcaagaactgctaaaacaaatgctgctgttgcatagcccaccgatctgaaaatccaataaaaattaatgctaagatgcaatgcagatagttgtaccaaatgattttgtttgttcttaaaatttaaaactgcaaagtaaatcggaacttctcaaaacaaccatgtagtaagatcgctccaagttttgagtatgaattcctaggatttagggtgttagcattacaaaaatgctggatcattcaaatgctaaggaataatcactctgggaagtagataccctgttagcttttaaatgaggacagatttacatggttttctcaggaatccctttttgaataaaaggaaactcttatacataggatgtaagtttttgaaactggggtctcatttagagagcacttatgtgaagcttcctgcgatctagggcaaaaaatgtgatagttatttttttaaaaaagtcttgatatttgatgactaatatggtaaatatcaattaggtaatggaccttgagaatgctcaactgcttgtgcagaagtgcgtacttacacagatagctttctatgagaaaataatccaatagtattctttccatttgaacaatctaagtctacctgcatataaatgaaataaatttgatcaaaaggtagtgatcagtagctacatatacaactttggacaaagtttgagtataattaatttactcttactccaggtatggcttgaggaaatactagaagtagtatgcttctaggctgctaacctggaccaaggaaacaaatcttggccagtaactagtaaaaacaatagtctcagtgtaccaatattttgtggaaatcgatggctattgagagttacatggtccatacttcgctccctttttgaagaagtgataaaatcaatcttataattgatcaaatcaaagtttagaaagtaaattattttaaaaaactgaagaaaaattggctgaacaaatattttaaaactggcattcaaatacctattctggccacagcttgaaagagtatgcagttaactctggaaatagcttggagccttggaagaaactagtacttctaaaacacacaggcaaaaaatttctatacaaaagttgctttaaaaaatcatattaatacattttttcaaaaaaaaaagtaaataattaattttgcgggtgcatgaagtgagttcccaacctcacctccagaacacagctttaggtacttactctcatggaaacacgctctccagcaataccatcgatagctcggacaaaaggatcaacaaatccaaccaattttagaaccttatttctatccctcaagaattcctgaacacgaacaagttgcagtcaggtgtaatccgcattagcaccaaatcaccagtttaatattatcccatttttaagatttcagcagaaaacaagcaaaccatgttggtttaacagtaataatagtattagttgatttcaccaactacataattaaataataaaataaaatgtaagcaattggttgcttaaaagttaaaacttctattttttttagtagagtttactagtactagaatactaatagcaccggttgtgtctgaaagaagtaaattgatagtgcataatttgagaagtaagacatacaacaggtaaaaagtttgcgaaggcctgcattccccaattccagaaaaaaggagcagtaccgaagcgagcactaacagtaggcacacctaaaaccttataagcactcttcacctcaggcaaattcctggattagtggcataatataaaatttattagcttccattttgaattctaaccaaagtggtttttccttattgtggtaagatctcaaaaagtaattaatgttcagtgcctacagtaagtaaacatctttcttcctaacccctttgccaaaatcaatgctgagagctccactgtagggcttcaactttatttcttctcctgaatttgtaatgagaacaaaacttagattttcctcatagagaaatcctataagtgcactaataaattatcgaaaagtacctttgttatatgcgattacatcctccgcaagaagcagaaaactagttgttaatattgttggcccagcaccaccagtgcctgcagtataataaaagaatctagaaaaaggatttagcaacatactagcatagattctgatgaatacgacaacgctttccatacttcatgactagtttgacctttaatttttacaggaaataaataactcctaaccttaatctttcaggttcaccagcattttcacttctagcagcatgaacaagctcagcagccatcactgttccaaaagaagaaaacagtgtatttctaagcactcaaaaaattaagatatgaagcttacctagctagatcaaaacattgtcttcatagtttactgctagatcatgtctctaactctctattatgtactaatacatggcattaatcaagttggtgattttacacatatgtaaactgcctcaaagagcaatggatactatccatgagtactgatggacattgtgaaagagcacatgatgatatctggacagtgtaacttgaaaaatttcaaagtaaactgatatgtttgatagaaatgcgaagtaagaccattgctcactccaggatagatgccggcagttgtaatagctgggataccgcaatcttttgcttgttcatggaaaccctttgctctccacgaatagtctgtatcatcacaaacatcaatatatgccgtctgtaaaaaaaaaaaaaggttaaggatgtcactgatttcaacgtgttattaaacttatgcatttgatgatcaggcgttgcacatttctaaccttggtcgctattgctgcctgtaggacagtgcactcattctccctttggaaaggtccagcagcatgaacaactaaatccacatctgggaaaaaaaaagaaaaactagaatggtcaaacatcagaagaaatttgtggatgacttttcaaaatatttgcaacaattttttgaaatcatacggtgtttcaacttaaaagtacaacataagcaggtagctccattactaaccctgtagcacttcctccaacatgttcctgtcgcgaatatctacttggacaaactccgattcctccccgagtttagatgccaaagattcacctttctctctggccaaaaaaaaaaaaaagatactcgacaaatggtcatactactataatcgtctcattgtacagatggaactgcacaagattgcaggcatccagccaagatgctattgacagaagaaagaaactgttcccactattgaagtgaactacgaaatggctagatgaggtttgcattcgttcaaacgtaagaaattgcaacacaagtgaagcaaattcattctgcagatgaaaacaggcgaggaaagtatgtaacagactagtgcggtgcggaggaggcatagcatatagggggcaccaaccggttcctgccggcgatgaggatgttgaggtcggggcggagcttggagagcgcggtggcggtggacccgccgacgcggccggtgccgccgagcacgagcacgcgcgcgctggaggaggagggactcctctgcgcctgcgcgtccgtggagggagcggcggatgaggaggcgacggcggcaggtggcagcggcatgcatgccctcaccacggtggccattcgctctttggctcgctccgctccgggcctccggcgaagatagccgagtggtgttagagtgctctgtgctctcagggatggctggcgcaaggcggtgcttgtttggttgggtacgtggaagccggtgggccgttggttcggtcgcctatcggattatccatccatctaactgctgtttcctccctccctgtagatcgcttaagatgggctgacttaactctgggccaatttggattgttaccctactaaaatttgccctaccaaaattttagtagggttgcaaactaaacatttctactaaaactctacctatgccataaatttggctttgcctatgaacttatctcttatgggcaaattttggcttcaatccaaataaacattttcaactctaccctaccaaaattttcgtagtaccaaaacttgtccaagatttggcactaccaaaattttggtagggcatcaatccaaacatacccagaaatcttgggcctcagtatgaactatccggaggtgagatgacacaacgtacccaatgacaaagcgggatttcaggttgggtgtgtaagacctaaccagtgtcaataggaaaggagataaaatattcacggtcgataataatcaatgtgtaaactagtcctcttcaaaagaactaaattttagctttttaataatatcattggcagtttaaaactagtccttattgctaaatcctctcaaggtaaactaccaataatatcacaaataaccatcttctattttattttgaaaagatggaaaatcacaaactgagtactcagtctaactacaatctctagattagggataggaaatgaactaaaggtcaagtatttaggtattgccatattgcaagaccgatggctccgccactgaacatatcaaggccatatgtatatagggaccgtggccagaggagaaatttgagggtatgccacctcattcgcatgcctttgaattttcgccacctaatctgtgtgcccttgcaaaagtgccactggaggtgctaatcttttgatttcgtgccattttcgtcgaaggagggtaggaggcggtggtccttggtggcggcgggcggtatctgtaatgccccgatttttgttcggggttaaaaatcattaaataatacattttctagaaattaaataaaagttaaagcaatttaattaagtgaattataggggaaattaaaattttcctttaaaaatcattggccggaaatattttataatattctctgtgccctaatatactctccagattttcccgcgaattttcggagctcaagaagtaattttaaagtcacaaacatcatttatccaattatataaaaagaaaacaaataatttccccttcctccctttcgggctcggcccaagtcctccccctcttccttcccggcctggccgccctccccttccctctctctctcggcccgctcggccccctttccttctcaagtccacattgcctcccccagccggcctcgcctttccctctccgacaggtgggaccggtgggccccacctgtcatccccaacctccctccatccggccggctgcaaccgccatggccgccggtttcaccccacgacgccgcgcttcccgcgctccacctcacctcgcgaacgcgtggactcgatccccacctcctcctcccctatttcccccactccgccccgcaaaatcagcgccgaaccgccgccaacctccccacgtcggcgccccacattgccggccgatcccacctctcctggccacgatctccatccccgagccctatataaagcaccctcgtgctctcctcttccgtttccccctcctccccgagctcctcgcaccctctcccgtgctccccgcgcgagcccgcgctccgccgctcgtcgccgtgcctccagccgccgcttcccgctgtcgccgcactgcgccgccgccaccactagcttcgtcacgccgcgctgcaccccgacatccattcgtcctccctgaagcctcgccgtagcgctgcttccaccgccgacccgagccacttccgcctcccgccggcgagcgtcgtcttgcccggccatgccgccgctacccacagcgccgccacgccctaccgcaccccgtctaccactcctcttccccaatccatcgccggagcgccgtcccaccgtcatcccaaggcgcccgccgtcaccttgctcgccgccaaccgcctccttccgccatttggcctctcggtgagcactcccctccctctccctcttcctccctttcgccgaccgcttcccgggcctgctcgtgacgcgccgccgccgccggtggccgtccggccggttcatcgccgctgcgctccgcgccagcgtcgctaccggcaatgctgggcagccggctgccgcctccccttgccgcaccgcgccaccgctccctctcgtgcgccaccgcctctcagctgtccagccttgtgccgccgccgccttgtcgggttggccggcgagccagccccctccctttttgccgatctgggccgccgcccgtggacccgtggtggtcctggtccacggtgccgccccggccgcggtggaccgtgaccactgtgcgccaaccccttgtgtgtcgctgactcgtgggacccgcctgtcggcgccggcccctttgatgacgtcagcagcaggcctttcctctgggaaataattaataattgcgcaataattcggatatagttatagaaattcatttaatgactcaacaacttctaaaattcatatataattcattcgaactccaaattgggccattcaacttgcaaaattcatctaaaattgagctctacatgtttgtttacttttcatgtactgttttcttggtttttattagtgtttttcctcgttttgcttgccagcgtgtagaatccgtcgtttcggaagatcgcggtcgcgaggaaaagagttcgaaagattgttttgaagaagcaaggcaagtcacacattcctcttgagcatgttgatcccaatttataaatgttttaccgtttacaaataaacatgcatgtcttgctaattacatgggatccgggtattacctatctgctcacttgtgccatgtttacttgatatctgtcctttgtcgaccttgagtgataaaccgactagctggtattacttatgttgacctagctagaactatatgcttagccatgcttaattaccactagctcagttgatgggataattatagtattagaccttttagtatcatgacgagctgcgtgctcaagacatctggccatgtttcatggtcgtaattatccaactaaaatgcgactgaatggtgggctgtgggtgcatggttttgcgagtcgcacccatggcaattaaggactggttcacgggaaaccctggaagacttacagtgcttaccacaagcgggagtgggtaactgcttgatctgaagtatagctcgaccctttcctaggcaccagtggcaagggtgggcgtgatggagttgggtcggccggggtgtccggttgtccagctgtcggattcaccgcggcgcacgaggggactgcccgctgccttgcgaggagtgtgggtgaaaccttaacgtggtgtggatggttaggggagagttatatgaatggtcttgtcacaatcactcgacgtggtgacgtgttcatcatgggcacataatgacacggtgacatgccggtggattgtgtcttgtgggtacagttgtgcacctctggccagagtaaaactattcgaatagccgtgcccgcggttatgggcgatcgaccagatttaccgtgattagtctcacacttaataaatcgactcaatgcactgtagttcaggtgggttggttgggcttgttcaacgtggtgtagcgttgatcaatggagatttaatattaccttaattactcaatagttttactgttttgctcaataaaatgctttacaactgcctttatgcaaatagccacaaaccgtccttatgttctccttgcacgtctgcatcattggtgtggcttgctgagtatggtggttgtactcagccttgctattgtttccccattttcagaagtgtactacttctgagctgaagatggagttagaggaccaaggctcagaccccagttgagttttgcctgtggagtggagctgaagcctcgctaggatcgccttttttccgctactgctgcttttgtttcggtgcgaggactaagtgcctcttctgtaagtatttacgctttatttacgtttggatctgtatattaatttgtcgttttgtgtaccctggctgatgcctggacagagatttaatacacaaaatagtctagaaatttaggctaaatttctgggcgtgacagtatccctcacagcaacatcaacgataacgcgacagtcagctaccgagtgaagcgaaggcggcaacgcctcattgtgcgaagcttggtgaagcgaaggaagacgaggtggaggaggtccctaggtagcggctgtggaatctggcaacggggaagaagccggtggaggacactgacgatagcaatggtcctaggtccgtgcgtgcgtgctggagacccacgcgaagcccgaagaaggggagggagggggggctaggggcaagggcgagctcggtgtgccagcggcaaagctaggcctaccctttgatgaaggtcgttggccacctcctttgcatagatgccgagtgagcttgagcttgaacaagctcgccgatcacctcaacctctcttacaggcttgccccccctccccctccctcccaggtcccaagctccgcacattgccgttgttgtcgccgccgcctcttgccctcctccggtgaaagtagtacgaaatcaaaatattcacatttcaaaagcacgtggattgggtgacgaaaatttagaggcagacaaatcaagtggcatgtcctcgaatttctttgggccgacggtctaactgagggatggaccacttccaagcatgaagcatgcgttcattggatcatcccgtattcccgtgtgccagtcgaccaaacgcgtccccgatgcttcgtgcttatcctttggttgaagaacgaacaatgaaacatgcagcgcaacggtaagccacacactcaattcgccggcggccgcgcggccgtgccgtcgctgcccacgcgcattacgccctttcttctaccaccttcgacccaacggtacgtgacatatgtcccggtgtcctcaaatacaaggtatcgatcgacgtttcacaactcacgcgtacaccgtgtgtcctcacctcttcaagcctgcaactaccgcatctacttcccacgtcatcatcctcttcaatatatgaacccgtaccgtactccactgctttcttccattttgaatttcgaaacacacaaaatatcagaggacgcagacagcttgactttgacaatccccaaatttccccaagctgcagctgcgcatcgcaacctccgctctctcctaaaccccctctctccaatggccggctacccgccaaatcccggctccggctacccctacggcggcgccggcggctacggcgccccgccaccgccgtacgggttcttccccgcccccttcggcccgccgtacggggcgaagcctcccaaggaaggtaagacctcctcctcttccgccccttactacggcggcggaggcggctacggtgccccgccatccacccagccctacggcagcggaggcggctacggcgccccgccctccagccagccgtacggcgcgccgtacggggccccgccgccctcgtcggcgccctacggggcgcccggcgggtacggcagcccgttcgcgtcgctggtgccgtcggcgttcccgcccgggacggatcccaacgtggtggcgtgcttccaggcggcggaccgcgacggcagcgggatgatcgacgacaaggagctgcagtccgcgctgtccgggtacagccagagcttcagcctccgcaccgtccacctcctcatgtacctcttcaccaacaccaacgtccgcaagattggtaagttcatcgtttcatcctctcacccgcgaattgaatagttctggccttggggatggtgtgcgttagtctgatcgctccatggttgctatcgtgcgcgttgtcctggtcagcggcatacgtaatggtggttgtgctttgggcgatgtgtagtcaaacgagtggcacgcgattggcacgtggctctccgcgggattatcaagcttcccacggtatttgcgatgccagtatgcgacttttggcttccgatgcggagatggagtcttccagccagggctgtagtcagtgtttgcatcatacggccaggacttgtcgtttgggaggaagacgggggaacgtggtgggggcaacgatatagtggcaacttgttaaaagctggagtttacttttaggtgttgggatgcgggttcttttaattaagtttcttaaattgcatcaatttctttgtgggataggattcaatagaattgtggaaaatcctagctcattttgttgtggtctactttggtacagcatagacacatatactggtttatttgcacaatgaacttgtaagttctcccggcttgtgatgtagaaagaattttgggtttactccagtaaaagggcatgctactttggcagtttatacatgttaccttgtatactaacttttgtttgtcagttctatttacaatttcaaattactgctaaactgaaaactagatatttgcaactttaatcaatgccatttgtcctattcttttggcatctgttttctgtgtagagaactagagattgaatcatgagctttgaattgcttgagcagtgtatactctgaaaccagtgctatgtttcaggctatcagctagtgagcttgtatatggaattttggacttttagttctaacctgtgaaatgcacctgatttaacaaatactggattgctagatactgtactttgaacttaagcatttcttatattattcgtttttatgtaaaccacattgaatatgtgtctttgatcctttcaggtcccaaggaatttacctctgtgttttacagtcttcagaattggagggtgagatgctacagcttcagctttccttttcttctgtgcggtggaactaatgaagttactgttgaaactgaatacgtgcattttctgcttgtactgtgcagtccattttcgagaggtttgatcgtgaccgaagtggtaaaattgatgcaacagaattgcgtgatgctcttctcagtctgggatattcagtttctccaactgtgctagacttgcttgtgtcaaagtttgacaagactgggggcaagaacaaagccattgaatatgataacttcattgagtaagatgactccaattatgttttgcagattgctttcttagtaattgttcaagctattagcttatccaatcatccaatcattatctaaaaaaaatccaaaacttggttagcatatgtttatatggtcagctaataataggattggttcaaattcgtttcagccttatttttaacattttctgtttggacatttgttgacacaaaagtagtctttgggatcaaatgtctggttaaagatgatatttcctatcaaatataattgttaaattgtttcttgcacattttgaggcaataactaaaaagataatgtatgcatcaactagtctttctacttctgttttctgatgcaaaactttgaattgatctagttgttttttcatcgttctatttttcagccttggattttaaaccacttaagtgtagaaatataaaagtcttttgttgctttggtcacgtgtcatggcttattataagccacagccaagcaagtcctaacctcaaagttaaatattggatatagtttaaaatcttgatatcttctatcattccaattcggcctatataacagtcctaacactattttgtttgcctttgcagatgctgcctcacagttaaggtaatacactaatgccttcacaggcgctgttaagtcctagcacaatgttctgttttcactcttttaacattcatttgtaacaattttacagggtctgactgagaagttcaaggaaaaagacacagccttctcgggctctgcgacttttacttacgaggctttcatgctgactgtactcccttttctcattgcataaaatggcagtgtgctgcacagtcgacctttcaggagaccatgcccattgtgttgaaacggttctgtaacgtgtgttcatcgacttgtttttaactgagtttattgtttggatttgaaatgatacaagtgcttccctgatcgggcatgttacaagttacaacgctcatgtatgtgaggatatatagctccgaaaatgatgtcatgactcttccgatagacatcacatatcgatcagccgacaaattcaatgcatttgtgaaatgactcagagagaggacgaagccgagtgaaatgaaagtttcgaagtgctttgatatcgcttgaattatcagttgtagctgatgtgtagtctttcagtccgggtgattttggggttaactttaattgcagtgcagaattccatcgcaacagggcaacggaaacaaaaatgagtagcgtcttccaggtcttggttgcatatctcacatattggagagttggcaaatgttctttttgaatagattttgcgttgttggtagcctttcctttgtggatttggatctgatggactgtttgatgtaaatccaagggtccaaattatatgtagtactattcacacgcggagaaaactatagaggtactgtaacaataatagaattgtagactgtagtatcagatctcaactatttgctgaaaaaaaatggatggttgaaattacttgcagcaaagttaggactgcacttgatttcaattcatcttttccgagtagccacgcaaagaattggtactctcttgggaagaagttccgacaaataaagtgctagttaggacatgtctatcttgagctcatttttacccggcatatgttggtttggggcatagtgtaaaaaaccggaccggagaggaccgaacaacctctcggttcgccggtccgatggtccgaccggaaaaccgccggttgaaccacggttcaatagatatataaaagttgtatatttcctgtataacaaagtggcgaatgaccggatggctagagccaagtgctctcatcgcacagacccacgttcgaatcccatgccgcgccagccttttctgcgaattttgaggaaaaaaacaggcgtgtggccagaccgggccggtttaacatccggtttagtgcaaaaccggccggttcagccggttcaatccgggtcgaatgcatgtccggtctttgaacgcgcaaccgaaccgtgtggagacctctggttctggttttttccggttgaaccgttgacccggtccggttttttctactagggttttggggtggggcgcgttaatgtgccataaactgcaaaaactgtattttttgtccaatagatgtctgaagatgtggccaaataaactgccaatatatgaatatattaatgttaagctcatttttacccggtagatatatgaagatgtggtcaaataactgcattttctaaatttgtaaaaaaaaaaaggtggtggtgtgctggagcagtcactcggtctaggagtgaaggcgacctccggggtagctccgtatagatttccctaaatagaattcctccaaatttgctttgactctggttttgaatccggcccatggccttatcaaatttggtcgttaacacccacacaccaccttgcccccgaaaacttgggttacgacgctagcactacctggcctagcgagaatccatggatgcagcagtgtatttgtgcccgccattctccatgtcactaaacagtgcagtactaaacgaaatggaacgaagaacacagcttagggtgtgtttggttgagctgtggcttttggaaaagctactgtgggctgtggaaaagcagctgtgggaaatcagttgtgggaaaagtagaaacccgtttggttagagcagttgcaaaactgtaggttgtagaagaaatacctgtaatgcccctaaaggcctatgagactgtttatatgctaattactcgtaaaaacctaatccgttcaatatttcgtatttaaaaggctaattggaaagaaaaaaatttataactttttcatccatcaaagtttttcatcaaaatatattagtttttcatatatcaaagtgatatggtccacataaacagagcaaaagataaatggttcatacaatgatgccatatctcaaaataactatcctcctcatgcactactcaatgcatcagctatcctagtacaaatagtattcatggtatcatcattctctgcatcttcactctcatcgtccgtcgtcggagcacctgtcaagccatcgtcgggcgggctgcggacgccgtcgtcggagccggggcggcgtcgggcggcaagggcggtcaattagaatttaaaatgaaatgcgatgatgagaataatagtatatgtacattaactgaatataatgttgtacactgaagatgtgcaaaattcttgtcctgataaacaagatcatgtaattgattattgtcttgctgaatgcagatgagtgtatcattctgttgaatcatctgcatctgcatatctaattaagcagaaactgtctattaccagtgtactgatactagtatggtcagtgaggtccccatttctaatctgtcaaccattatgtacagaacttttttacaagattgcttcttttgaaggacacaactacagaattatattccattttgcattactagtagatcatgaataaatacataattaccccacttttacatttaagaagacaaaccaactccatttggggaatgtgttgggtgcccattggctgacagtatggaaatttttctgatggggacaaccaaccaaaccccaaaccttgcaagaaaaaaagattatgatgctaacaactgacagcaaccaaggtgtcaccctaaagcattagctgggtttttgctgctgtgttcaaggtcctaatctgattacttttctgcaaccaacgaacacaacaaacatgtacctggatgagtggtgccggcgtcgggctccgggctgggaggagcaagtcggcgccggtcggggaggagcagagcggcgccggtgtcgggcggggaggagcacgctcggcgccggccggggacaagcagagcggcgccggcgtcggacggggaggagaaggggcggcgtcgggcggggaggagaaggggcggcgccggcgccgagcggggagggcggcggccggcgcacaaaccctagatgccgctccacccctagcgaacgcgagaggagacgggaaagggttcttgccttctcggactcgagattcttcaccgattcgaactcgaaccaacgagatcatgccaaataaattcaacaccaacctgtgctttcctttcacagcgacacggatcgatcgagcgcgcgcgcgaaaacctagttttgaaacgcacgacgaggatcaccatcaatggcggaagaagatgacaagaagcagaagggccccgacgtgacggtgccctcgggatactttttcgtgccgaagccggagcagctcatccgcgactacctcaaccactggatcaccggccggccgatcgaggagctccgggacatcgtccgggaagccgacgtctacggctccgacccggcgacgctgacggaggcgcatagggcgtacggccacgacggcaagtcgtggtacttcctcaccgtcgccaagtggaagggcggcaggggcggcgccggcaccgccggccggctcaaccgctgcgtcgagggcggcggcacgtggcacaactcgcagcgccgccgcgtcatcgagggctacggcgaccgccaggctttcgagtaccgcgcccccgggaacaagaagacgaactggctcatggaggagatcgccagcaacctgccggcggcgatcaccgacgagggcatcatggtcatctgcaaggtctacctctcgccgagggccaaggaggcgacggccgacgaggaggaacgccaagaaaccaacgtggttcccgggcccaagaggctccgagaggcggaagccaccggctacgacgcgccggcgccggagacgccacagcccgacgtcggatgctcgtactccggcggcggcgagacgtctcaagcgaccgcctcgatggactactgctgctcgacgacgacacacacggcggacgacacggccaatgccgccgcctactactacggcgacgttgatgccatcaagccagatgcttacgacggcggcgactacggcatcggcatcaacgcagacggggagctggttctctgcggcaacggccacggtggcatcgggacgcagggacagatgccattggcaatgcagaacaccaacggggagatgaccttgttctcaccgatgaacggctatggtgttggcttcaatgaggaggtgagacaagaaccacaagtaggaggtgaggtggagatgaatgatttcttcaacgatttgttcgtcgacttcgacggcgccggtgatcccaatcccaatcccaacgagggtggagacagccacggccacatactatgtgaatgaattgaatcgctggggtagagtagtcgatgattattcatttatttattttttctttgagacgatggaagaactgaacatatatctgatgattctttgtcaatgtagttactgatttgtagacagatcttaggagattgttctgttctgttcatgaatgatacttctagttctttatttactctgttttatgaatttaactcctgttcaggaccttaagggtgctaatatatatctgtttcaaatggcatatatggcatcaaaagattatttcagagtgaatccaaaccaccaaccgtcataatgataatatgaattcactgatacaatgaagtctgaagttgaaagcagagtggtaagggtgcacatcagtaacgtgtgatgtagtaacaattacatgacaggagtttggcaaaatttgaacaaaatcagtggttggttagtgtattccaaaacaactgaactgagctgggcagctggatgctgtattgcaccctggattctactttcccttattagtgattactcttcagctatatgtcatcagggccattggcaagtggcctgtatccatttggagttgcagaggtttcacctgaaccaactggtatacacttcaagatgacaccaacaatcagactgatggagccaaggccgacgctgagcagccaatgttgccagttgagtggaacagtactggcgaaagtgccaagaaactctatgatcaccacttgaaatgctacggttgctgctatgactgcaatgaagatccaattgctgatgatgccacggaaaacattgatcttctgcatttctctgctgtttatttcattgaatacctggtacaacatttgccagaacatcatcattagaacaagaaattccctttgccaaatcatgattttttttaaaaaaaaaagataactctatcagttcaggattcttaagcatgatattggaaatataagctgtgaccaaccaaacacatattgtggcagacttcggaaagacctcagtttcaccataggtcttaaggccaaaaaagaaacatcattttatgtgagtggtttgtggaaatactagcacggttacagtgttccataatgcactaacctgacaaaacacgaaggagttgaatatcagtgtatttatgatggatttggaatctgcacccttgatgttcagaagcctttccccaccaaacatgagagctccaagtacaaatagctgatataaactttgccccatgatatttctccacatgaacttggtaatgaaactttccccttttcggacaggtggcctcttcatcatttcatcatttggaggctctgttgctagtgctaaagctcccaatgtatccatgatcatattaacccacaacagctgcacagcagtgagaggagcgctccctgtgacggaagagcaaaacattagtactgtcttggagatcatggagaaccacttaatggaaatacatagcatcagatgaatactataatgttgccctcacctatgatgcatgctgagacaaaattgatgactaaagcaacaatattgacagtcaactgaaactgcacaaacttttggatgttaatataaactgcacgaccccatcttgcaacatttattatagttgtgaaattatcgtcaagtactatgacatctgcactctccttggcaacctgcacaaatacaagacaaaattactccatttcagaagatgaaaaatggattatcaggatcaacttaattcagtaagagtgaatactgacatattcgtcctaaatatctgacttttttaatgtctattgatgctacgttcataagttttgaactgcataggaaacagtacctctgttcctgcaatgcccatagcaagcccaatatctgcttcgtgtaatgcaggagcatcatttgtaccatcacctgtcacagaaaccacctcatcaaacatacctcgcaagtttgtcacgagtgtatgcttatccaatggtaaagaacgggccatgacctgcaaaatatttccagatataaagtttggtcaagattttagtaaacgcatagactgaggaaaacattatgaacctgaatatttagtatcaggtccctcatctcttctgtgctcttgctatggaattctggtccttctattgctacaccatcttcagtcaatattccacactctttagctatagctttagctgtatttatattatcaccagttaccattcttactgtgataccagcagacatacaggtcttaacagcatccttaactccagggcgcacaggatccttgataccgaaaatggctattagagtaaaaccacttgttggactatctgcattgtcatcaatatcatcatccacttccttatatgccaggcacagcgtccttaaagcgtctgaagcaaatgagttgatagtatctaagatgttctttctctgagcttccgataagggaatagcatttccatcgccatcaaccatcatgtcgcacatctgcaaaataatttctgatgcacctttgcaaaaccatctggacgtgccattgggtaatgaaatcagcactgccatcttcttcttgactgaattgaaaggctcaaccttaaccttggtgcaggccctatactcagcatcatgatctcctttcaagcccaagccaaattctaatattgctctttctgttggagttcctaagacagtttgcttgccatccttttccttgaccacctcagcgctagtattctcaaaaattccctgcaaaagcagactcaatgtgctagaagaaaccacagaattaagttctcctgaaatggtgttactggtaactgactttgaaacctcagatatccatattttgtcaacaaccatatggttagtagtcaaagttcctgttttgtccgtgcagatggtaccagcagatcccattgtttcacacgctgaaagatgtctaacaagtgctttatcattcattaactttttcattgcaaatgcaagactcaaagtaacagccaagggcaatccttcaggtacagcaacaactataatggttactgctgttgcaaagtagtttactatagtcaatgcatcagtagaataccatttgagcaaaccaaccgtcatgcctttgtcaatgagaaatctaaccagcagaactaaaaatgttaatatggcaaataccagtccaatctttcctataatggtcgcaactccatttagcttaacctgcagtggtgtctcatcctctcctccctcactcaatgtgctcatcaattttccccattcagtgcgcataccgacagcagttactatcatcttagcagatccatcttgcactttagttcctgccaagatgaatggtttgtcttgagaaacatacactgggtcactctcaccagataagctggactcatcaatcaaaagggagtacccatgtatatacagtccatcagcaggtacttgatctccaattgacagatgaactatatcaccaactaccaagtcatatatagagatcttttgtcgacgcccatctctggttacatggataaatatctttttcttttcattgtctagctccttaaactgaagtgactgcttataatcactaacagcagtaaccataacaactaagaaaatgctgagtattatacccaagccatcatacatgccctttggccaaccttctgttgccaaaccaactgcaacagatagcaatgcacataccataagaattataagggtcatgtcctgcaatgcatcccaaacaaacatccagaaacttcttgaaggcttttctgcataacggttgacgccatatatgttttgtcttgtatctaactcactagcatatatgccatgatcaaatgatgaacgaacttttatagatatcccatctaccccaccatgcatctttaaagcttttgaatcatgcttgcttgtgatcaatgctagctcatctggattgatggcatatccagctttaataatatcccctgttagtttgtattctttctttttggcaccttttgtttaaaacattaagattaaatcaagttacagagagttgataatgcaacaaaatgaacaataacgtaaaaaaggtatcccataccatcactaaaaatgagtgcagcctgttgcacatagagggcaacccgaatcttttcctgggacaacaaacacaaaaaatggaaacgcttttactggttatatatatgttataattattttcctgtagctgtgtgataaaatcacatactgtataatgtggaaactggtagagattttttttcctttttgagaaagagagccagccttctcttgtttccattaacagaaacaaaattacaaaaaggtaactgataaggaatagcaatactgttgtttagtccatgaaaatgaatttaattaatccaacacttcggatggcaacaatataaataacttcagtcgtgcacaatattcaaaatatagtagtgcaagatctccacatttgattgttcttacaagaaatatggttttatgcttgtgttgcaaacatgatagtcggctactttattgcagtttctttttctcctattacatgtgaagtcacattgccactatacctgcatcatactgggtcattttattttaatatataaataccatcactacttttctaggctgaaaaggcagaccaaccagtataccgaagctgatgtttgcgaattttcccagcatgattgttaaaattaaattagttgacttgttaagcataaagtaatgacattccaatcaaaactatcggcatatgagagaacaaaatgttaagcactcaatcatctagaagaatttataaaacaagaaggtccctagtgaaactggagttagatggttcatatgaataaaccgtaaaatagggggacttttgtgaatttgtgtgataaaaataatactccctctgtcccattttaaatgcaaccatgcttttccgtgctcaactttgatcgtccgtcttatttgaaaaaattttaaaaaaaatttaaaaacataagtcacgcataaaatactattcatgttttatcatctcataacaacaaaaatactaattataaaaaatttcaaataagacggacgatcaaagttgggcacagaaactaatggttacactcaaaatgggaccgagggagtatctgatagggtggctcagaagtcagaaataggaatctgcccaccctatccaccaaacctagagcacatagcgtatacatcactaaaatatacagcacatagtaatgtagaattaatccctgaattaagagtatcaactctgaagacataggccctgtttggatccggagggctattaaatagccctccggaatcttgctatttaagagtattaaa

SEQ ID NO: 22143 - DNA, 12176 bp, Oryza sativa
caaacaaacatagagttctttattcttttcccatgaagacaagaaaagttgaaatcaatagtactccaaattagggactttaaacaatgatctcatatttgcaaagactgaaaggtggagataactatacatactcctacataacagaatcgatgtgatagggtgatatatttgtccttttctaacaccatttatttcgtacttttttgtaaggttgcttcgcggaagtttccttgaaagtaattgatcttttatacatgtcaacatgatacggacctactgtgcgtctgtgcccagtacgatggagcaatagcataaataacctgattttttgtcttaattgtttggcaccgatgagcaaatgaacgggacgaaacatgtagagcgatctaaacaagaggagaactgtattatgtgtcacgatctgatggcaaaagacaggacatacaacggttactgaatactgaacaatgaacacacaaaccaaaagcagttcttttttgttagctaaatgttgttcttgctaggcaaatcgacccacgagcacgatgagatgcggtagaaagagagaggggatcaaacagaaaaaccgtgatatcttgaaatggagaacgatgtgaggggaatggattagagcggctagttcgtggttagttagtacctgggtggagcggaccttggccttgtccaaggagcggcgctcgaggtcgggcacccaacggaagcggcggcggcgattcttgacgatggtgccgacggcttgccgccatcgccgctgcgcctcctcggacgggttcttggccggcacatcgaagttctcctgcaggtacctgtccagcttctccatctccggccgcggccggtgagcacgcacacgcagcgcagtctaccactccactttccactactactctgctctgcccggccggagaggaaggggagagagggaaaggagttatttttttctccaaagcttacaacttcttggtctaataaaagaagacaactgcatatgccctgtatgtttgggataaagaatatggaaaatggcaggcgatcggatcgccattttctaattgaatctttctttcctgtgtgaattgtactgaattagattcaaattcgtttgtttttgacgagagattgatattgaccaggcgattccattaaaaaaaaaagatattgactaggcgatggctaggactttccgttaactcgaatttatggatggatggatccgacgaatccggtggactctgacggctaagggcacacaactgattttgcttgccttgctgtttccgtcctctgatggaagagcacagtaactcggcgctttgctgtgttcgcccgatgatgaatgaatgtttaggtactgagcgataatgctgagaaagcaccatatatatcgccgcaggagtagttgcaaagtgaagcgacatggatgacatttgacgggtaccactcacactgtcacaatgctttaagctactgttggttagcttggtgttcgtcagtaagcctcgtctttggaatgacagaaaagattgggacctaaacaagctgaatcaaatttttatcaggaaatggcacaaattataacacaggtatagattgtcccacaagataatgaagacagactttgctggactccaacaaccacatgaatttgcacttccaaaagtgcctacaaacaggtttctagcaattctcactcaaattcttccaactttaactctgtacatcgcagtatccttctaaaaacttggtctacaaaatgcattcctcctaaggtcaaaactttcatttggagacttataaggctcttcacagtactcctagctggagggttacctcgtttgccagctagttcaaaatctgatgtgaatgaaaaaaggtggcgggacccatatctttgctaaggattgcatcccctagccagggtgcggtttcctcatgccaaaagggaaactgtgagtggtcccctcacatgcttgcatgcatgggagggagagatggaagtgaaaagagggatgggtgggtcctactaatatgggtgggacccactaacatagatactgtctaagacacatgcattgtgaggtgtggttctctaaccggtttctagtctagctggaggccttgggctcctcaagtgcgctaccgcactgctactgccctaagacatgctcttccaactgctgctaaccttcactctaaagtttcaaacatttcagattcttgctctcgctgcaacagcccagaaactgatactcatctctttttccactgcacctttgctagactcacttggaaaatttctgagctatatttcaatcattctatcattgactctaggcataatgtttctgaaatcattgcctatctgtcacaccccgaagttctcctcccaagccgaaaatttaatttataaatgaccctaagaaaatgccggtgcaaatcaagagaaaaccctaaggaagtaatacaaatagtaatcgaatctggcatgtggaatttttcttgagttctacatgtcgaaattcactaacaggatttttagtggaattttcagagccctagaaataattttaaccaattaaaattgagcaagcaatattttaattctagggaaaatccttttctcctttttctttttctttttcccttccctttccgaatgggccgccagcccattctctcctttttctccccctcctccccgctgggccggccgcaggccgaggcccagccaggccgccccgcctccctcctctcccggggtcgccgacaggtggggcccacctgtcgggtcctcccccaacctcctgccgcccgcgctggtcaccacccccgaaaccgccggcgccgtgccccacctccccgctttccctgcgcccacgccgcgttgcccacgcccacgctacgtcgccgccccctctccccgcgtctcccggccgcgcccgcgcacgagaggggcgggattcgattttgaatcctccctcaccttctctctctccttccccacgtcgccggcgaaatcggacgcgctcgggtcattcctgaccttcccgcccctataaaatccatccccgagctctcctcctcgtttttccttttggcgcctctctctcccgagctctccatcgtccccgcaccgtgcatccacttgccgccgccgcccccgctactccggacgccgctagccgccgctagggtcgccgccgcgccgcgccgccgtcgccgtcaggtttgcgaggccgaactccatctcgtctgccccttccccgtcgggattcatcgccggaattcgcatcccctcgcgctccggtgagttcaacctctaccgccgccttcggccatgaatgccggtcgccgtggttcatctccctccctctaatctctctcttctccttccttagggcaccccgaatcccgtccgccggttgccgtcgtcctcccgtggctcgttgtcgccgttcgccgtcgtcttcctccgcgccggccaccctcggtgaggcgccctctcccctctattcccctccctctccctcctagccgccgctttagcgccgccgcccgttagccgtcgctttagcaccaccgcccgtcggcgccgcctttgcgccgccgcctccgccgccggttgcagtcgccggcaacgcgtgtgcgcgcgccgtcgccgtcgccgtggccgcttggccggtcttgagccgagccgggtcgccaccgcccgtccgatcggccccgagggcgatctgggccgtcggtcccgtggaccggcggtggaccacccgcgtggtcccggtccacggtgaaccgccccccctgagccactgccgagtgggcccgcgtgccggcgccccttttcctccctctcccgagccgctggccagtggggcccgcatgtcggcgccgcgtcccccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatatttgccttgtatgtcgctagattccggttcttccgacgctccggtgtacttcaaaatagtcgccgaggttcctccagcagcagagcaaggcaagtcatgcttgtcacttgaacatgttgatcctatattgcaaatgctctattgtttttcttcaaatattgcattgttttataatgttactatggggtgtttacctattgttacagccatgctattttgatatcatgctcctttgttagcttgggttataacttgaatagattttggactaggaattgcttagccatgcttagttccactagcacacaatggggaaagctcactaaaatatagactttaggttcaattggtaaggttggtttagtaccaccattttggtgttggttaattaaaatgaatcacatggtgggctgtgggtgcatggttttgctagtcacacccatgacagttaaggaccggttcacgggatgccctggaagaacttatcgtacttaccacaagccagcgtgggcaacggctgggcttatagtgtagctttcctctagctgacgcatccaggcaagggtgggcgtgatggagcggggcgggccctgcgacggcctctgtcgcttccggattcacctaggcacgagaggggactgcccgctgccttgcgaggagtggggggtgaaacctgaggtgtggtgtgcttggttagatggggttatgcgaagggtcctgtcacggcctctttccggtatgtcgtggtggcatgtcggcgcacggaaacgtgtcgtggggctatgtcttgtgggtacagttgtacacctctgatcagagtaaaactattcgaatagccgtgcccgcggttatgggcggtcaaccagattcaccgtgattagtcttaccctagtttagtctaatgaaattggatagtataggtggatggttggccctgttgcaacgtgggatagcgttggacagcggatgatcaatattaattaattattgcaactgtttaattctttcaacttctgtttataaatgctcgttttatgcaaacgaaccactctagctctcctttgataattccctgcatcatacccctattccggtatgacttgctgagtacagtgggtagtactcagtcttgctctattttttttcccaaccccagagtatgagtatgtgtcagatggaggtttctccgaggagtaggcttcgtccgtgccgtcgaggatgcctgtggagtggtgttcccgctgcagttctagtcaaggcttagctcttgttgtctttcgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacactatctccttgcttctaatagttttgataataactttcaaattatctctattcttctttggtatatttggaaagctaaaaatgatcacttcttcagaaaaaaagattgggaacctttacaaatttgtaatgcctccaatgccatgtctaagagctacattactgctttatcaaatgatgatgataataatgacactcctatcataaatgaaaatcctactgtttgtctaaactttttaccaggaaacagatgcttctttgatgcttcttggaaggacaatctaacaggttttggcctctttcttcataatccaattaatcatcaagctatctttgtgcaggggaaatcaagtctctacaaatcaccaatgcaagcagaacttgcagccttcaaacttgctctcttcatctgtgatttccttaaaattgcaaatcctctttttctttcagacaatcaagagctaacactgttacttcaaaatactgattacatcaatcagaattgccactggagccttttacctcttcttgcacttttaaaaatttttgcaggtgatggcccctccaacatcaaatggattcccagagacataaacaaaatgacagactacctatctaaaaaagctagaacatcttctgaatctgaagtgctaaattgtcaaaatattagtcatacttgtaataacaatacttgtcctacaaagcaactcttacaagctgctctttggaaagacaatcatgtatctccagtgcacgttttgtgcttttaatgtttaatatattgaatgttcaaaaaaaaagtgttggttaagcacagcacaaagtcactatttttctttctctcttatacttacttttgctgtccgcagaagtcattcttcatttcgccgttaaacttgtgaaggagaagaacctaggcgaaattgtgaacgtgatttcccacgatattttgggggtaaagtgaaactaaaatgttttcatagccgacgacattttaaggcaaatgttttcatagctgggtcgttgacgtaccaggcccttttcagttttcatggactcttaacggattgggccttgcaggattggccaatttaatttatgggccttccactgtatttggttcgcggaccgaccgacagctcgctaatgattccggcgtgatgttgctgcgccgcctggccgcgtccgccctccgccgtggcggcgccaacggcggcgtcctggccgccgtccgcgccgagatcgcgcatgagctctcctcctccaccccctcctttcccccgtcgctccaatcccaggtacccaccaccgcatcctcccgcccccaatccagcgccactcacttccccctggttctcgcaggacattcccgacttcgccaccgtgtcggacccgccgcgcgggcaggaagtgctcctgcgccgccgggatgcttccgaggaggtcctcgtgtcggcggtgctcgagccgctgcggttcgaaggggaggagcccctgcccagggacgcgctcatgaaggtgttcgtcagtaagcctgatgtgaagccggtgatgcggttcgactgccgcgcgtttgcagatgaaggtgatggcggctctgctgactatgatgttactaatgcttgttatcacccgtttgctggcgacgctggggaagacaagtatgaagggcctgagttcaggtgatgtttcttcattcatgtgattttaggggctgtttggttcttaactaacattgccaaggctaaggaggtgtggcagcctaaagtacggtgtggcaagttgaagcaatgaaccaaacacaatgtttgtggatattgtgatgcgcgcagtgggctcataaacttggagttcctccaagaaatctggaaaaacaagcactttcatggcattttggtggagctctgtaattctagtgaccggtagaaaaaaaattagcacatgatcaatttcaggagagcctatgccttccaggaaattcagtaccacctatcttttctttctacaaaagtagaggaacatgcgtatatttttttgtggtttactgttctaacgcgctgattgttgattacattgtcttacaacatagtatcttggtagactgaaaatctattactatgtattattttcctacagtcttgtcatgacagtgaaccaagtatctgtccttgttattaactccatgttaagccgcagggtcttcatttgctagaatatctagttataccctattgtcaaaattcaatgtagaatttttcttgcgttctatcttgatggatggtttttaaaaggaactttggtaaacttggtggagaggtctcacgaattcctgttctccattactcttgcttgcacctgcaattctcagttaatttttttatagagtaaatttatacgatgtcttctgttagagattttttttatattggcttgcaacgccatgtccaaatatgttcaacatgaatgtggctggattcacatgaatttgttcaaacatattgattacttggccatactgtgagtatgctcatgctaaaatttggaaccttcacatgttcgcctccatttattaatttaaagtgcaaaatgaacaagaaaagcttgttggttgaaagtgttttgtagcataagggcgatgctgatctttttggaggtacaagtgtagtaagaaccaactaagcagcatataactatgaaagtctgaaaatcgatccttggtttcggattaaaatagatattctaaaataaacaaggaggaatattggacctttttattctatttaatcaattcctcatcccaattttttttggattttattgttttgactggatttaagcgagtcagtacaaatttatagaatcagtgggctgtaagcatctcatcagccacttggtacacgctacatgtgttaacttgggactagactatgcttagatggctcatcactacatttgtattttttttgttagcaaaatgacctcaggacatgtcatctcaaatagatagcatcgtgatgtgattgtttagggactcaatggtctataatttctaggtaatgaggcttggtggtaggatttcattgtcaccagcagttaaagtaaccttagccattacttgtatccttactatctggttcaatggcaaacatgttttatgtttgttgagctataatgtttctatagttctttttactgctcattcatgaaatggtacttatgaaattgaaagttgactgtatcacattgctccactgaaggggcctatttctgttcccttaaacatcaaatagcctttgtttcccttttttttggcaacataagaggttagaggggtctctattcctgttgtttcgattaagatcattacaaggttggtttccttgtacctatttgcaatcaatgacagtgttccccattgtttttgcagagatttggatcctcggttacaggttgcactgaaaggatatctggtggcaagaggcgttaattccaaactggcaagctcacttcaccaccatttggttgagaaggagcggtggcaatatatgaactggctgaaaactttggaagacatgttcagcagtcattgacaaaaatatttccagcactgaagaccattgaaatgttccccgtcaaatacgcacactttttgttgtggaaatgcatagatcagctagctttgtggaatgcaattgtcgtgcttaatttagttccgtggaattgaccacgaaatcaccatagtttggtcgaatctaattttttttaaatttccagctatggttggaacttggaaccttcgtgaaccagcaaccatccaaatatcgatggttgatcaagtgtgaacacggtttgtttcggttgaaaaacaaaaatgacaaataatttatttttactgtgctccatggaagcatggaagatggaacatgacgtaaaatcacagctgcacaactggttgctgctaacgacgaatcatcgaggattagccgattaggacggtgaagcgtgtctgcttcggctagcgataagaacgtcctctaaaaaaaaagaaaaagcgataagaacgtcctctaaaaaaaaaagaaaaagcgataagaacgtccccaccatgacaccggaaaaagcgccagataacatcgcctagtctcgtctccgactccgaccgcgacaagaataggcgggcgaccaccgattccgctcgcaacccggctccagcccaccgactcggtttcctcctcggtggttctcctctccgctcctctataaatgcagcccgatcctcgctgctttttcttcgttgaggatggtcccatggcttccttcctcttctcgcgcggtcattcttccccttttcccctccgccgcgggtgggctggtaagtcggtaggtaagggatcaatcggtttcgatctcacctcgttcgctgccgtttgttgattgatgatcaggcgcaccaactagccggatagattgcccgcttgctcgtccttttctggtgcttgatccgttcggtttggggggggtctagtttcggcgatttgcttctgctgttgtgttagttttctgaacacagtatctctttcgattggtttatggctaattgtggtttgctgtgttgggtacaatatgcgcgatcggttggtttgtgtcaattcatgtttggtgcgatggatttgtcatggatattttgggcttgatcaaaggctagatgaactgaagttttcgctctgaattggtcatggttaggattgctcactggcctcagattattgttcggttcctttcaagttcgtgatgcttggttttgtttgagaccgttcgtctgcttgcagctatgcagtttttccttcggatctagtaatttttatgataaggtcaagtcatatcagaaaatttaaggtctgttcagagctttcaaatcaccggctttaacttgttcaatttcggcaagacatactcttcagattatcttgaatatggttgtgtgtcatcttaaccggaccatgtattgctttttggctttgataaaaatcgtcactatgtgctagggcgttggaatgattcttctgtgtcagttcttagttaaagtttaacatcaggatttctcgcgaggatttaaggagctctttttgaccgccttccctgtggattaatttatcctagtacaggaactacagattacttgctgcttgacctgctcagtttgaggtacagatctcgtgatttccctgtttactggtgttagttttaggaaccttgatgctttggtttagggctatggttaattgcaatttattgaaatttcaatatgtcaatattgtgcagttggtttgcttccattacaagcaactgtccaagaacattttatttgtaatacgaacatttataaaccagagaaattgaagcttgttgtatgggattggtcattgttaggaatagtctttggtgtataagatgttttctccattccattcaagactgctgctacgcttttgggtcaaaataacaagtgagattgatattatttggaggccatttgtctgcttggaaaactctggttatttaagtccatcctgctgcgcttttatggttgtcttgtcagaacatagacatggccatagttctccgagaatttgacgttaacttgtttacttccggaaaagctatatcagtcagttattaacttgctgtgagggtggttatgtagtaactaagaagacacatcctaaagtttctgtggtagacgattcatttggcagttctttcgaacaatattacaaggttgtgaaggtgattctgaaatcttttgactactttgggtgaaattaatttgaagatttatttcaagaacatttatggacctcaacattataaagccatctgtttgaagtttcttctgagtagaaacaattgctttatgaaccatggaggagttctcagtagcagtatttgatttctacttggtccagcttgcatctccagtagtatcctttacatatgggcttgtactgttccataactagctaggatatgggttcatttcaacatatgattggccctcttgtatgttggtttggtgtcatcttgtaatttgtgtgttcattaagcttccctctgatgttggaaattgtaattatcaaatgatatagacgtccatatactgatttagtctgtataatagttgtaacatggtaatttgttttgataatcctgagttgtaacatggtaattttgtccatatactgatttagtctgtatagaatgaaactctatggctcttgtggcattgttctctcttgctttcattttgtgagtgttgaatgtagcattgtagcacttcattcaggaactaggatatttccaggaatattttggatcgtcttgcagcttccacagttttgaaagttattcatcttctatactaacttggtagataactgaagtttacagtgtcgaggcaatttttgcttacgctcataaaagatggaaatgtggatgctttttaaatattatgcttgataggaattggcctaaattatatatcttatgtccagggcttttgaattgaggagaatcccttgaacttagtttgttatcacaacaacac

SEQ ID NO: 22144 - DNA, 263 bp, Oryza sativa
ttcccccctccctctcggtggcgtgcgcgtggggaggatgagggcgcgagacaagaaggcggcggaggaggcaaggtgaggcggcggcggatgaggcgagcggcggcgggagcttgcgctgctcgaggcgaggcgagcgcggtggcagaggaggaggcgagcgcggcggcagagccgcggtggcggaggaagccgaggcggcagcggcggcgaggcggttggctgggggacgacggcagaggaggtgaagcgcggttgacggc

SEQ ID NO: 22145 - DNA, 1093 bp, Oryza sativa
cccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttccgttgctttgaagcatttgttgctatctaaattccatttaaggtcgtaccttatcgcccagcatcatcttattctctatttggattccctccatctttcaaatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgaacaacgatcgtctccatgttgtcctcctgtggggcaacaaacagcaggccgagttggctctggccggaa

SEQ ID NO: 22146 - DNA, 6119 bp, Oryza sativa
  unsure (1)..(6119): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggatgcagatacaccaaaggaagaaaagaaaactatgagtaacttatcaaaaatcattatagacttgactaaattcaatgccatgggctgatgatagaaaaaagctgataatgatcaatttagtatgtgcatcaactttatgattttgactggaagggtgagatttggttgttgccagtccatgtgtaacctagtaaactacataattttgccggatcctttccttgaattcttcaatggaaaccatttaaaccaatgtacatatttttgctgatcatgtgtaatcgtgtaaactctgtggtggacagcagtcttaattaaattgtgacaaaccttcaccacaagtctcaagatgattccctgatgctgctctgtaacatttgatatgttgattaaaagatcaggtgctatgcttcccttgtcctgttacagaatgttaacttcatgttgttggctttgcagaaaaggtaaaacagcctagagaaaatgagaaacaaacgaagcagaataggatacctcacttagcagacgttcaaatgccatctcaatataaacaatgcaaaaattccggactattgtggaggaagtagattcagtataaatcctccataaatccagcatgggcagtgaaatctcaggcctgtgcttcacccgtttgttaatgtggctgagaatttccataacctaatggagtccaaaaatggtattattttccattacatgccattgtctaattgacatggaaattatgctatagaatcatgcaaagaactgaaggaaaacaggactggcactctgctactctgaactggttcaggttacagtaacaaatgcaagtaattcttgcaacataaagcacaatagtctctctaattacgtcgtttagaagattatgtgtacatgaacaaatcactaaaacagtataataggcactgttgctcgaatttcatcaaattgaagcaggaacattgtaaacatcaccaaccaagagaccaactaaaccaaccgaagcagaataatgacacctacacatatgtctcacatacaaacttcaatagattcaggacctgaggaacggtatacttacgagcttgcggacggatgcggcgggggaggcgagcgaggtgatggcgtaagggaggacgcgggcgagcagcggcgcgagccgcgcgtcttcggcgagggccagccgcgtcagcatccggtccagcgcctcctccctctccgcgtcggtctgcgccgccgccgccgcggcggccgccggcgacgatgtctccggcatctctctcccggcgatgttggactcagctgctcagtcgcccgtgtttccttccaccacaagaaggttagaagaagaaagatggtcgagtcgggttcgagtccaaaccgctcaaaacgagagggggatcgtgtcgggctcgggtccgacccacacgagtcggtacactcgagaacgaaacgaaacgaaacccaacccaacccaactcgcgcggtcgctgctttcttctttgccctcaagcttgcgccctgcgctgcagcggctaaaacctcctgatcgcggcgaaaacccgcgaaaccccaaccgccgttcgccatcgtcgccgtcgccgccatggcctccatggagcccttgaaccggtgcggatcctcccgctgtgctcccctccgtgtatccatgatgcattgatgatagctggcatccgcgggaggtgtaattttactggttttggtttgggaatttttggctggcattgcaggatggtgaggatggtggcgcgcgcattctacgacaacgtctcgctggccagagaccccaagtccgctcgcggcgacaactgtgggcttgccgtcgttgtcctcgacgccctcaccaggtgagaccaaacctaaatcctcaaccaaagtcctgacctcggtgctgtcactgatcaatgatcaatgtgccctgttgcatgtgtttctgtacatgtttcatgacctgttctattgtgttggtttcactcacctgattgattgatgatgctagtttctactcgctagtgccaatgaggaaacctccatgttgaatactgctccctcttggcctcttgtgattttaggcaaggagaatttacagtgaccgagataattaatgcagaccttttgtgcctgtgcatttcaaatttatggcatggtctaggatttatttttcaaggttaaattgattatttcgtttcttgctggttggctacaacgtcccgttaagtgctcaaacaagcatttgaagattttttttagagtgagtgatgagcaattttgttatgatccctgagggactgttttggagtaactgctactcatggtttgtcgtttatcaaatctatggcaaataatggttaatcaacactatcaccaactggatcaagtttgtacacaacattatgaaacaaatatactgagtactcctttatgatttcttatgactcattatccatgtggaactgctgagagaacattttgcctcctcatattgtagtgttacttggtactcgttgatgtcccacattttatttttataatgctgcttgctcagttttgaacgtgcagttttgactactaggcccttgcctctgtattctttttttctcctcctttaatcctatcttttgcaccccggagtgtacatctgtcaagtctattgagtttttcctagcgtgcatatgctcgggcttgtgtgagaaggcggcttccactcctcactctctcttactatgactcttcttcctttatttaatgcatgaggcagagcccttgccttttcgtaaataagaaaactttgattactagagatggaaatcagcaattggagaagctgcttcaattgtccaattatgatcacaaagaatttagtcttaaatctattatcttccccctctctctctctaaaacatttttttctctcgtttcaatattcatcttttttcgtgttaactaattatatgtagtgtcaatgcacaaattgtgatacccttcttttttaccgcaggcggcgccagtgggtccgagaggaagatttggctaaagcattaaagatttcctctaagcaactgcgccgcattctccagttttttgaagaagagaagctagtgagaagatgtcatcggaaggagattagaatttctgagagagagttgttctcatttttgtatagcacttttttttttaattttagcatggaatcgccatctactccacttaaaacagaagttgttaattaggttattagtagtttctgaaagcaagacctgataggagagtgagaatcaacgattgtcacctcggcactgtactactgtaggatatgccacccactcccaatgagtagtgaatcaccactgttaaagagcgcatctctagcatttgtcacgttggggtctttttgcaaaatgtttacatttctattttctctctgcccgttttgccctcagccattttccacttatcctaaaaagtaaaaaaaatgctgaccactttccaactgagtcaagatgtcaagatattctacaatttatccacatttatatgcagtggcgttattattttatttctttagactatagaatgagtgcctgaaatatgtttttgagcacctacttcacataagcttgtacatggttaatggaaatacatgggaaatgaattagttgcataactatatcggtgcattaatgacttgtataatcttacatggacaaagcagaaaagttcagcagaacttaggtaagacttcaataaatgaaactttatgtcatgtatatttcatctgtgttctgatactgctgaggcataaacatgtgtgtgctacgctctcttgtatagcccatattaaacagtttcctggaatatgcatatttcattaaatctgactatctatttgtgcccgtggaatttttgttgttttttgtgatggttgttgtataggtctctttagacaccatttgcgccacacactcatgtatagccattttcttacatatatgaaggcggctctgttttcctatgtactaaaaaattagccttctatttacactattttgcttggtacactggatcacttcgagtgtgcagtactgctaaataaggagtaactttaggttcactttatgaacgtaagcatccaaagagcttaagacaatcaacattcacaggatcattagtgacagcacgaggtgacctgaacattgcttgaactcttttgttttctgggtggtgtggttggaggtgcaatcaatatgaacgtccagtcattagtcatctttgtttgttaatctgattgtcagttttttttttgccccttctcaccttgtgttgtgttatgtcatagcagtcaccaaaaggagtaaacatatctaacaatgtctctggcaccgctggtgatgtgcatccttttactaaaggaggagagaaagcaaagatgcacacacattcctactgttgtttggactatgctcaggttactcattgattgaacatttaattttcaatgcaattgcttctctcctcttattctcttcttaatgaaatgacacgcaattctcttgcttgtttgaggaaaagaattacttctctaatgaaagagaaacttgcccggcgaaaaaatgaaagagaaacttgttagctgaaatttttcgcatacacaagatatttggccgctcacatttatccacaaagcacatgagtgggacatgtagcgctatatctatttcttatgtttttacgtgtggcagagctcaatgagatttgatatagactctgtgcatggaaacttattttaacattgtaaaactgcatgggccaaaaatcacacaagcggaccttctcatataatcttcaattgaacattgcagtttttctgcatgcatggtggttgttttgattaaattgatctctcttccataggttggcaaatctaagtcacttggctttattagaattattaggacagaatcctactgaaaatttgttgaacagaaagtgagacaaatctctctcaccacagcgttagcgataacattacccatctttagtcatagaataaaatctgcttgtaccttacccatcccatgatccaaaaatgtcttttgatctggtcataatctgatatagattttaatgtgcatatttttctgaaatacaggtatatgatgttgtaagacataggatacaccgcatgaggaaaaaattaaaagatgagttagatgacagagatacagttcagcattatgtatgtcctaactgtaaaagaaggtactaagtatacttctgattattctggatatatagtaccattaaaaaaaatgaagcttacattattgtctctgttgaactgtaggtgacggagcgtggggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtgaatctatgtacgaagaagctacaaaagagctggagaaccagagagctcttactctctccctctctaatcgttctggatccccccaaaaaatcaatcccccttctaagtgggcaaggtcctccttttatacctcaaggggataccacatgcaccatctctctcttttttgtggggacttatcctatcttttcttaaacagacggagacttgtatggttgccgtccgaatgaccttctgatgggacggcccatacctacctccacttccgccggaagcaggcgcgacgtgggaacatagctgtttgccgacgacatgaccagtgtcagaccggtcacaaatcggtcattcttgtccaccacgcgtcagtttagcaatctgcatgtccacccttcttcatacaatttcttgcttgtatggttgggatgaagcctggcatatacctgaccagaacccacgtgccat

SEQ ID NO: 22147 - DNA, 42026 bp, Oryza sativa
  unsure (1)..(42026): unsure at all n locations
accaacgtgccatctccaggagctagcacgctggctccggctaaggacgagtgcctagagactctcatcctgacgggacggggcgaggcgtgtgtcagatcgcctgttgccacctaacccgcaatctgaccggtctgtgaccagtcacagaccggataaacgagcgcgctgtactgcattacgtgcggcgtgacgtgctcacccaaaccgcaataaatgcggttaggtgagccccgctgcgctcacctaacccatacacgcggcgcaaaacccacaaggggtcggggcgccttggccctcggggccgaggcgggagcggtccgacccctcggggagacaaagagaagggcggccgtatcaccctcgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctgatgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcatgggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggccttcaactggcgggcgccggtagatctgggagatggctacgacgccgtcctcgaccgcctggtgggcctgcgatcccaggggctcacaggggccatggtgttcggcgactatcttcgtcgccggatcgcgccactccagcggcgcgcccggggcgcctgggagtacaccgggtccgaagacttcatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcggccgccctgccgacgcctgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggcccggaggcgggaatctgatcggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacaccgcatgggcacgtgtcgaagaggggcgtcgctcggtggaggccatggtggaggtgggccgcaaggcacatcgccggcacgtctcagagctcgaagcccgtcggaagatgctgggggagatcgccaaggaggtggaggaggagcggggggctgccctcattgccaccaccgtgatgaacgaggcgcaggacaccctccgccttcaatacgggagctaggaggcggagctagggaagaagctcgacgccgcccggggggtccttgacgttgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgtcgtaatctggaaggtgcccgcgccgagagggccgcgctgaaccagcgggccgctgagctcgaggcgcgggagaaggggctggacgcgagggtgcgcagtggcggggcggccgcgggcgaaagcgacttaaccgcccgcctcgcagctgccgaacacaccatcgccgatctgcagggcgcgctagactcgtccgctggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctcttggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgacgctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccacggtccttttgtgtcttggcttgaacaagggctcgtgcccaggtcctagtcctcaaatggctcgggtcggggctagtgcctggggagatccacatgtcgagactggccaagccgggagcgtggtgaccgagggttatgggtgacccgattgtgggtttttgccgattcccccccggagttcactacgccccggggcacggctcggttctgggccccgtttagcgattttagccgacccgagcccccgagggcaggattgaacacgagtgacttatttcaagtcaagatccttcaaaaggaaacaacagcacagatacagcctttaggaaatcgaaaatgcttttattgaaatatagatataagagaaataagaatatgcatatgtggtagcccccggccaaccctgcacgcccgaggggggtgcggggttggcccgagccggaaacctgtcacccgatccccctttaggggtagaagcgacgaaggtgttcgatgttccacgggttaggcagctctgtgccgtcgcccgtggccagccgaacagagcccgcccgggggacgccgatcactcgatacggaccctcccacattggtgagagcttgctcaatccagcacgcgtttggacgcggcgtaggacgaggtcatcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcaattcgccttcatggatatcggcaagaagctcgacgccttgttcccgaggaatgcacttcaggaggattccgttagccgcgcgccgatagagggtcccttctaccagcacgtagcatttggagatgcgctggacgcgttcactcccttcgcggtcctgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtggggtcgcgccgacggctgggcaagcctttcttcaaaggcgcccggtggggtctgggcccgcgaggaagcgagccgtgagagttcgtcggcaaccgtgttatcccgtctgggcacgtgccgaagctctatcccgtcaaaatggcgctccatacaccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtaaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccattaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcatcccggagggcctcactaacaaagtagacgggccgctgcacctttcggtggggccgatcctcttcgccaggggccacatccccggggcgctctttgtccaagcggcctcacggggtgcactcgtcttctgtgccgacgacctcgaggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccaggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccgatgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggctgcgcgtctttacaaccaagtcatcgacataagcctcaacattacgtccaatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaactagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggtcgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgacccggcgtcacaccgataatcggctgggacggccggggcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggtgagaaacgtgagcacacgctcccccatcgacagtggcaatggtggccccaggctcttggaaacctaggtcatcatcgccgtcatcgatgtcctcggcggggtccttctgcttggcctcacttcgccgattgccggaaggaaccgccggggacttgccctctcggcgctcctgcctcctctcctcccacttcctcgtccgctcagccaaacttttgactgcgcggcagtccgcgaggtcatgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcatcggaatgggctgacctcttcttcctcctcctgtcacgccgccctgtccgagcagcggatccgggggcggccgaagctgccacatcggaaccggaggggttccagttccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatagtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaaaaaattcgccatgaccctgtcgtcacccccggcggcctcaatcccggtcgtgtagacctggagaaactcggcggggttgacgctcccgtcatatttttcggcgctggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcagggacaataggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatcctttgaccctctcgagcgcctcctcctgcctaggactttggcgtggagggtggagtacgagctcgacggcgtgggttcgggctccccgtcgtcaccgctaacactcggagagaggttgtgcgcctttgcttgttcggccattgggctgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctctcggtgtgtggaaggttcgcgataatggaaacacacaagacacgggcgatgtatacaggttcgggccgctgagaagcgtaataccctactcctgtgttttggtgaatctatgtacgaagaagctacaaaagagctggagaaccagagagctcttactctctccctctctgatcgttctggatcccccccaaaaaatcaatcccccttctaagtgggcaaggtcctccttttatacctcaaggggataccacatgcaccatctctctcttttttgtggggacttatcctatcttttcttaaacagacggagacttgtatggttgccgtccgaatgaccttctgatgggacggcccatacctacctccacttccgccggaagcaggcgcgacgtgggaacacagctgtttgccgacgacatgaccagtgtcagaccggtcacaaatcggtcattcttgtccaccacgcgtcagtttagcaatctgcatgtccacccttcttcatacaatttcttgcttgtaatggttgggatgaagcctggcatatacctgaccaggaccaacgtgccatctccaggagctagcacgctggctctggctagggacgagtgcctagagactctcatcctgacgggacggggcgaggcgtgtgtcagatcgcctgttgccacctaacccgcaatctgaccggtctgtgaccagtcacagaccggataaacgagcgcgctgtactgcattacgtgcggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgacccctcggggagacaaagagaagggcggccgtatcaccctcgggcccgaccccccccccccccccgagggggttaggccacgtgggtgatcgtgtctgcctcaagtctctaagtcatgatactcccggtcccatgtcaccgacagtaggtattcagcatttgatgcactgcaacttgtaagcgatatggatgactattttcactgtgagcattgcaaagaacaacttcttccagaaagtgaaaagcttactttggatgaagttgtgtgtggtggtgacaatgcaataaagcataagctcgataaactaaaggatatgcagcaaagaatggaggttattactttttattcagttagaaatttgtttccaaatttgggagcatagatcaaacataaatgatgttagaattgttcagtttttagtacagcttacatactataactattggaaaacaattaaatttgtttcgcctttgtcagaaagactaaattagtgtatctgcattttggccaataatcagattgttatccagtaaattgtgcataaactttctataattttttacattgcacttagataatacataatttaacatctatttaaccattattgcatttgtgataatagcacgataacaatatagcatttcattgttgtgagaaggactttctttgacatgaaccatatatatagtttcaatatctatagcagagatggaaatatttctatagattggttatgtcatctatgaagcatcacttcgctgatcacttgtatatgtttatatctcgtatataaaataaatataacggtgtatgttctcccatattggctaagcgtgcccctcaagatgctgactgcaaggtagtttttagcttaaacatggatggcaaagtgcatgttctggaatcttgatgatagtgtggattgtgatgctttcgttttgtagatttctgctctaacattgaacatacatgaatgcaggagcaattgaagccattaatagcagtacttgacagggtaaaggatcttccttttccatcttttatgagtttgcaagattgggaaagagcaactatggaggcatctgcaaatggtgcagttggttcatctcagaattcagaagggcgatacagcagtaaaccaatgcccttccttggggaaacagaggtaagcctggtatatgcattgagttgtatacgttagtagttaaaggtgcaaatttagataaatgtgaagccaataaaggcaacattgatgaggcatataacatgaccatggtgttatgctgggaatactgttagaacttctatacttcctgaaacatctcatgcctttctagattggaatcaaatggtttgattattaggatttgcccctgtaagtactaattacttcatttaaactagatattgcactgcctgattaatccaattctcctttccaggttgaagttaatttcttaggaagtactggagcacaggaaggtgttgaatctggtatggaaagtataaagccacagccctcatggatgaatcgtaagagtacagtcctcacaggggaacataaaggagaaatcagcaacactgcagatctggatcaaagttcagaagccaagagtgacaagaaacagctctcagagaaagatgagatgaagagcatacaggtgagctgataaaatttgcatttcaatatcaattataagtttcacaatcaagaactagctagttgagtgaatgttaaatataaattcaccttttatttaatggtgtaggaggcatatgcaaaagcttattatgaggctatccagaaaaggcaggaagatgaggacaaaaggatgatacaagaagaaagccttacatgtatttctgaccagccatttgcttctgatgcacagtttgagaggcggttgggtgccaaatcaaaacgtgatgatggtggtgactctggtgatgatggcattgaaatgaaagtggagcaaccaacaggtatttcttgatcaaaacttgtgttcctatctataatttcacataggagccaaaaaattttctgtaaaatattgtttttttcttgaatacgcatgagagttgcgtgtcatttcattagtaagggagaaaaataggaacggggaagggagcagcacccaccatcacccgaaccaccaactggcattagccttcacatgaaaaaacacacacaacaaaaaaaaacaaccttctgtaaaatattaatcattaaccattctagctgtagtctagctttttattgacccttctactaatctaattacataccccttgacttcgttttataaaaaggtaattgtttattatcattgtttgaaatgtatatgatattaccgccattttttagtttcttatacttgttgttgagttagataatgatatggcctggtttatgtgattgcgatgatagttctcaaaaatgttagtcatataatattttgaacggaaagctcactggtgcagtgtttttttaacatgtcaaccttcaccttatcttttaatgtgttggctttgtatctaatgtgtttgtagggaatataggagaggtatataagttggctgatctggatgtggagacccaagaatcaattgatgatgatgatgatgatgatcttgtttgggtagagggctgaagacttgctacttccttaatgtagaatgtgctaaggttcaagtttgaaacactaggacagtaggactgatggctccaagtttgatacatcatcaccaattgagtgggaagtgcaaaatgtgtggaaggtttagcatagtattcctgcactgcgcatgaaactagtttgactagaatcaagtgaagatgcattctgccatactacattttccatttcaagcttttggagatttttgagaaacaaaagcattttgagatgtatatcctgctaaagtagtaaaatactacagttgctgatgatcaatattgaatgatagactgtactaaactttgcttgtgcatagcaatagtaaagtgaacaccagaaattgatgatggcgatgatgtggtatattgtgatgactagttttaaaactggtacatggtgattgacaaaactgcagtttcagatatatgtggtcctttgacttgatagcctgtttaattacttactatcgccctgtagacgctgcgcatgcgtacgtacatttcatggaacttaattgtatagcatatttgtgtacattaaaccaaaaggcaggagacaatcataacttgaatcttcattgatccatgcataacgcgttcttgttcaacgcttcaatccatgaatacatttttacattgttgggaagacaaatgctgttgaaaacaaagcaatcaagaagctgctgcccactgcaaaagattgatttgttggtgagctgagagcctgagaccccccccaaaaaaatcatcatttgagcagtggttcatcagccgttggccgtggcttgcaggtaggcattgacttgctactttttcaatttttgttagcatttttttaaactgctaaatagtatattttatgcaaattttctctctatataaactgtttttaaaaaataaacaaattcattttaaaattttaataattaatacttattttttttagaaacacagtacaaatgcagacgctcacaatgcgcgcacactcaccaattgaatatacacatcctatccctataaccaccttcagaagactaggccgatatattttgagatttatgaagtcaccacgagcgtctcgttgttgacagttaaatcatctaacactaaaaatacttaattaattatatgttaatcatgtttttcgtttttatgtgtgtgggtaataaactgttttcaacctctatttagagcatgatcatcctgctgctgattgggcatcagagcccgcgaaacatgcagcggtcgtcgtctggtactagtgttgacaaaataaaaaaacagtgttagcaatacccatcattgacaaaaataagaagtgagctgaaataaacatggcaatgtacacactccactacactacaaattatacacattgaagagaaaaataaacactaaacacatcgacatggcaatgtgcttcttttcttctcattgctgaggattaatttatcagtcaattttaacataaatatcatcgttgtcatcatattacggcttgggcagaacatggcggtaaattgggcagaggctgctatccttgagcctacggaagatgcagcgctcatggaagctgtggaagcagggcgtcgtcctcagcaagtctctctccttgaagtccctcaggcacacggcgcacgtctcctccctcgcgtcggccgccctcgtagggaccaggctcaggaggagatcgagcgacaccgtgcctactcgtcgagcgcgcttgcacggcggcggcggcggctgatcggcgtcgttcgccggccctgatcggcgcggccgtatgcgtgtcggccaacgaggccgatctggtcgtcccacacagtacacctggttgaagggagccacccagaatagctggccgcgatgcaactttaggcggaagcctggtggtggcaagccgctgattcttctctcggttaagttaactaggaagagatggtcccagtgccatcgcctccgtggacgatgccggtgaatccatcaattaatcttgttactagctgtgagttgggaaagatagatagatcatagatgcttgtacaatttatagacgacgggtgtgagtgaagcacaactagaatgtcgatcgtgatggattcggattcggattcaattacgctgattacttctaagataaccttttctttatttacgcacgcacacattcgttaattgcagcagtatacttgagtagtatacatgagtagtaatcagataggttgttattattacatgcgtgattaggcagctacatcttggttagtgtttcactaatccatggtgtaagcgatgctggtgagctcattcgcgtgcttctcccacagcgccacgaacacctccaccccaccacttttcctcaggctcggcatcaccaccaccaccccgtcctctggcaccttcgccggcaggatcccggcgagccgcccgccgagccccatgtccagccggtgcagctccaggtgcagccagctgtccgagtccacgtccggcgacagcacgccgggctcgtccacgttcgccggctgaagcggctcctcctcgtccctgccgccgtcgacgtggagcgccccgaagtcgatgaacgactggaagtagcgccggtcgacggcgcggatccccgcgcggatcagcgccgccgcgtccgcgagagtaccggtggtcagctccctcgctgtcgggccggagctcgcgttgatgatgaggttgccgaagaagccgtttggcacggttcctgtcccgagccgggcgcggccgttcacggagacgttcaccgacgtgcgcgcgccggcgtcgagcccgcgcacggcggtgatcttcttccagacgtgcgccgacacggtctcgaacgtggtgtacttgccctgcgcgcgccgcttgagctcggcgacgaactcgctcgggtagtgcagcagcacgttggcgacctcggaagggtcgatgcggacggcgccggtgtcggcgccttgtccttgcctgctcgtgacgccgtcgtgcggcaagaactccttgccgcggtgctcgaactcgcaccgcggcggccggcgcggcgagagcgcgccggggccgtacggtacaggtcggtcaagcagcggagctccgttgcgacggacggcgtcggtccaggcgtgaaagaaggtgctcatggagaacccgtcggcggcctggtggtgagccgacgagacgaccacgaggccgccgcacgcgaagcggttgatctgcaccagcagcacatgcggcgtcggcgcgtccgtgttgaccggcgggtggaggcgcgcgagctccggcgacggcgcgagcgggaggtggtcagcgaggtcggacgacacctcggcctccacgacgagtgcgccggcgccacctctgcccgtgacgaagaacgggcggcgacgggcgccgcggcggtcgaggcgcgcggtgaggagcgggaagtgcgggagcgtggcggagagagcgtcgaggagggcgcgggtggtcgggttgggcggcgagaaggcgaagaggacggtgacgtggtacgtcggcgcgacgagttcgaacacggtgagcggcgtctcctccgtctcgcgcggcggcggcggcacgaccgaactcctcttcacctgcacctccattttatcactctggttagatagatagatgatgcttttgtgtgatggatagatggtggcagtggttcatgtatatatagcacggcagccgccacttgcgtatatatatgtcagtatgtcactagctcagctgtgttgctattaacatttgaagtgtgcgtacgcgtgccaatctgttgaggcatgcaatgcttgatttgttgagctgccagaaattcaaccgtgcatacgtgcgaggggtctcagttgtacgggagacaaaaatacctactacgagtactaggaaccggacgtatatacgttcagatgaagcaggtatacgtagacagtggtcgagattgcgtggcacgcgccgcgctgtgctgcgcgcgggaatggattactccgactccgatcgattccgagtcctaatcaatctcgttgtgcctcacatcgtccactataataaaatctggtactcatccagttgttgcaacaacgcaaaagctggtctgactgctgcaggcgatggatccgccggctcgcagattgatggattctcgggcggcggcgcagttggcggcgccactttctgatccatacgcggcagaaaaattcgaagacctactccgagaattgggggtcgaccctagtatccacactgtagtccgtagcgccgggagatggatggatccggcagcggcggcagcgcgagttccgatgagattccaccgcacgctccaacgcctaggaatcgaccccaacagcgatgcccggagcatccgcgacatgctacaagagttccgtcgaggggtgtaccagggagaggtgtactgggctggccgagtgatcaggcctcgtccttcgcccatgctaggacgacgtcgccgcgccgccgacggggatgccccgatgcaagatgtcgcgagatgtcctcctgggcctcgcgctgacgaaggcgtgcgacgcgaggcaggaggagtgcgccgtgtgcctcagggacttcgaggagaaagacatgctgaggacgatgccgtgtaaccactccttccacgagatctgcctcttccgttggctcagcgaaagctgcctctgtcctctctgccgctacgcgctgcccaagcagcagcaggttcaaagctgctgatgatgctatttatgtttcggttcaccaacagatccgtttgtaacttgtaagcatattgccatcgatatagaagtagaatcatgttctcatcgatgtatagcagggcagttcatcatcagaaggttcctaattaaaacatttcttatcctccactggatttaactagtattgcctgcaacgcaaggccctgtcttggctaacaagccgaaacaacttgccactcatgtgcctatccctatcatggtcaggcacacggttcttcacaatatacgtataatttaagaattgcattgatcttcaaagtaattaattagtggattgatagaagtttaatcgacttgacattgcaattataaattgctttggagatccagtgtcccagtatataatgccaggtgaacactcctcttccatcaaccagcttgctaccaagtcgatcaatggcaatggactcttactactgttccatgctcttcttcctccctccgatactctacgtctcctaccacctcacaagaatcctcgccgacaagaagaagcccaccacccatggcctcaaggcgcacccgctgctcggccacctcccggcgttcgtcaacaacagccaccgcttcctcgactggacgacggagctcatcgtcggcagcccggagatgaggatgggcttctggatccccgggatgcgcaccggcatcatcaccggcaacccggccgacgtcgagcacatcctgcgcaccaacttcgccaactatcccaagggggagcacgccattggcatgctcgaggacttcctcggacatggcctcttcaactccgacggcgagcagtggctctggcagcgcaagaacgccagctacgagttcagcaagcgctccctgcgcaggttcgtcgtcgacgtcgtgcaggccgaggtcgccgaccgcttcctcccgctgctccgccgcgccgccggtgatggtcgtggtggtgatatcgtcgtcctcgacttgcaggaagtgctccagcgattcgggtttgataccatctgtatggtggcgttcgggcacgacccgcgctgcctcgccgacggcagtgtcatggaggatgccaggtcggagtacatgcacaccttcggcgaggcgcaggacctcgtcgtcggccgcttctttgatcccatcgaggtctcctggaagatcaagaagtggctcaacgtcggcaccgagcaccgcctgaggaaggccatcgccgacgtccatgccttcgccatggacattgtccgcacacggcgccagagcgcgtccgtgcaagacagagacgacgtcttgtcgaggttcgtggcgagcgacgagcacagcgacgaggtcctccgcgacatcgtcctcagcttcctcatcgccggccgcgagacgacagcgtcggggctgagctggttcttctggttcttgtcgtcccggcccgacgtcgtggcgcgcatcgccgacgaggtccgtgcggtgagggaggcgaccggcacgcgccccggcgagccgttcgggttcgacgcgctccgggagatgcactaccttcacgccgcgctcaccgagtcaatgcggctgtacccgccggcgccgatcgactcgcagtcgtgcgcggcggacgacacgctccccgacggcacgctcctccgcgccggctggtcggtgacgtacagcgcgtacgccatggggcgtctcgccgccatctggggcgaggactgcttggagtacaggccggagcggtggctcggcgacgacggcgcgttccagccggcgagcccgttccggttcacggtgttccatgcggggccgaggatgtgcctcgggaaggagatggcgtacgtgcagatgaagtccatagttgcaaacgtgcttgaggagttcgaggtcgacgtcgtcaaggagatcgccggcggcggcgtgccggagcacgtgctctcggtgacgctgaggatgaagggtggactacctgtgaagattaggagaaagactgaagcttactagagaaggccacaagggtactttgccgctgaatggtactataattagttaagcttcaagttttgctcttttcgttttgagcttatgggttaagaataacgtttgtgatttggttgtttttggccgttttccatttcctactggactacagcggcagaaaaatgatttgccctgggttgaattgatgccaattaatcaataaaaggatggcgtatcactgtattgtacaaatttaacaagttgaaatcagccatgtaagacacaaatagacctgtttaagcaactatttgaccaactttcaggtgttgttcttactgccaaatgaatactgtaagtacattactgatgaactaatgataaatttgagcagatttctgcggaaaactaatgatacatttgagcagatttgtgcagaaaactaatgacacatttgagcagatttgtgcagaaaatacacaaaatactgagacatgggactcctatagtggatagtgatgatgcagcacccaaaatgtcggtcatggccataaaaaaaactttgtaatggcattgttctagatgagcaagacggcaagatttccagatttgtcatgataccaacgagtgtttgtacatgtaaaattacgtgtaagctatacaatgtcctgcactcctacacctaaagctaaaagaaactacctgcatacttactgagtgatggtctgacggagggtgttgtgatctgcaagtctgcaaccgtcgcctataccgaatgatagaaggacaacaaaattctaaatcgcgtacccataaaaaaccaatctagtactggacgttgacacatcctaatactacgtatctggatagcgatatgtctagattcgtaatactatgatgtgtcaacatcaagtattaggttggttttttatgggatggagggagtatgatctagctgcagttgctacgacggtcctgcgcttaagcgacattgcagtctgatttacacctgcgcatcctgccaaataatcttgcttgcagtgtcacaatagcatcaactgtagttgagtggccattggagacactaaccatggaaaagtcatagggttaaataaattcacctgaaaagcagcaagaagttatttatttttcagtaagaatctcataagcattgcttctgcttgacaggcaactaaagtgcaagcacgaaagctctataccagtacgaattcgaagtttcataagtcttacatttattgatatgttactgaagaattgaacagagtaaaatgaaaaaaaaaatcaatgtcgactgatgacttcagttacaggttaatgattactgcaacataaaaacatactataatttagttactaacgaccttgagaacaacagcaaatattaattcagacacagcatcaacatggacaagaaactaatgcaacattttcctttcacatgtaattccaaacgaatgatgccaatgaattgtgaatgagaagataactatgtttacagaaacaggacaccagtagtatgttttttttgtttcctctagcaagtctagttgagtaaacaatttaaagaaggggaactagcacatggaattttagaagttctaatgttcaattttcctgtagttgagttgtcagaaaaacttttgagtcttcaaccatcaaagattcaagcataatctaaaatcacatatgaccagtcatagcaagattaatacctttgggtggagatctctgcgggagatttggtcatattaataccactcctccagttagatggtactatgaacgttcctgatctttcaacctccagttgctgaagtaaaaaaatcaaataagccgtaacaacaaccttgttgcagtaactttgtaccctacactctcctttctttcataatgaatttggctggtgatttttctggccaaacaaaagaataaatgatctccctcatttacaagagccaggtagacgggcatcaagaattagcaaatttctgctccacacgctgcaaggatttacaccctgcaagatgctgtaaaaccctggagacttcacagcaaactgactcagttgcatattggtcaaacaaaaacttgtatctaaatattatctcgaactcctcttgctgaaattcattaggaaggatggtcctccaattcactgattttccaacagaacaaaagccataaagaagtgaaaggaaggtgataggattcggcacatagccctttttagccatcctatttttaaaatccaatgcttccctgagcatattatgtctacacaggctgaagatgatggcattgtatgctgaattccttggatcccctatgtcaaaaaccaatttcttgaatacgactaaaagggcatccttgccatgcacctcactagtgttacagcagatagagttgatgacacaaggagtacaactagtgagcccattgactagataatgtaaggtaacatcattaggagaacaatggttaagcaacatggtttcaaagtacaaaccagctctgagtactttgtcttttttaaacagactaccaattaggatggtataagttaccacattaggagatagagcttcagcctgcatatttgcaaacaagccttctgcagagtctgtatcacctgtcttacagtatccatttattaatgaagagtatgtaacaacatttggcttgcatttccgcttgatcatatcacataaccaccttagagctccattaaggttaccttgtttagcatagccactaataactgtagtatatgtaaactcgtccgggatgcacccaacctttctcatgttgctcatgcatagaattgcctcgctcatcattccaaactgacaataaccttttatcatggcattgcagctaacaatgtcagggcagacacccttgtgttccatgaattcgaatattttccttgcatcaccaagattctcactcctaatgaatccatcaattaatgtggcgtaaacaaactcatcaggttggacatttttctcaagcatctcttcaagaatgttcttagctgcaggaagcatgcgtttcttgcacaaaccactaatcaatacattgtatatgttaacatccgggaatacctgtctttctgtcatcttctcacgaacaatcaaagcctcactgactttgccagcaactacaagaccatgaattagtgctccaaatgtgacaacatcaggagtatgccctctgcccatcatttccacaagcaaatctgatgcaaccatcaactcccctctcatgcagaacccatgaatcaatggagtgtagctaagctgatttgggttcaactccctcctgatggcctccctcaaaaaatgctcagcctttcgaacatgcccttcgtggcacagcccagttatcaaagtattaaatgtgatgatatctgggtcacatccacttgcaaacatctgcttcaagatcaccatagcctgtgttgcagaccggcaattgcacaaagcatctatgacactgttataaatctggacattgggggaaaatccccttttcctcatctccaaaaataaactcccaatcttctctagatcacccttctttccaagccaatttataagagaaccatatgtcacaagggttggcaagaatccatttgtctccatttcccccaacagcaacaatcctctacccatatctccacgccggcaatacccatcgatcaagacgttatagaacactacatgtggaatgcacccagctccccaccttgcttcaatcaatttcaacccctcttccactcgcctttccaggcacagtccccggacaagcacacaagtactgtagttatccgcaccactatccttgccaagcatttcatcatacagcttacgggcgtcatcccagcgccgctgctccactaggagcttgagcaggcggttgcaatgggtcacctccgggagcgagccgtactgctcccttacgcgctcgcacatctcggtggcctttccaagcatgccagcgtcggcgtaggcggcgacgagcgcgccgaggcaggcgcgcgtgggcgcggcgcccgcgagagacatagactggagcgtgtcgtccacggcgtcgaaacggcgggagcgggcgaggaggcggagcagcgtggagtgggcgagaggagtagggtcctggagggcgacatggtggtcgggggactgtgaccaggagaggagagcgacggcgaggtcggggtcgggcagggaggagacggcggcggcgaggtgggcgtcggagagcgggaggggagcagcgccgcgagggaccgtgcccaggtggggttcgtggagcgggtggcgaggacgccggcgagggaagcagcgacggcgggggagattagtgggtttgggttgtggctacgacgaagncgcgggcgcgggaacggggtaatgcgggcaaggagcttgaacatgaaacgcagacgacccgacgcgggcgatgacaacggcgacgtcgacgacggctgcgtctgcgccggcggcgacgacgacggcgacgacgacggcgacggcgacggcggcggcgacgaaaacgaatacaacggcggggtgaggaaacgcgtaggcgacaagcagcaaccgatgggccggccttaaaacagcagagacgctcctgacctgacgatctaaacgcaatcttaaccgttcaattgcaatgctacagtaccgagaagatcatccaacggcagagagccggtcctcagtctaagggaggacatccgaattagccttttttttcccttcagatttgcatctttcccccctttttgcgattgttttgcagattgatatacagctaacacgacgaaacaacgagtagtttatgatcaattcatcatgattatcacaccgaagaaaatagcaatcagaaaaacgaaaaatgtttcagacttcaagtcatgggtgattgaatcactgaatacactgacaagatgagtcgctgaatgtgttaggcagaggctccatcaccgccaaatgcgttctccagaaagccattttcactgagatggccgacgtctccacacctctcaaggatccaccggccggtgacgccggaaatgcggaaaatgttcagtgaagtattgggaattttcctacgaatcgagctgttgggtggatcagtgtgccggcagagttctagtatggcagcaccatggccgacaacaatcacccgctcccctgtcaatgcaacattagcaaaacatctttaaggttccaggatagcagcttgtcaggataaggtgtacaatggcatacacaaatgaaatggagtaaaagttcgatttttttttatgatagtttgatacttaccgatatgattctgagcaactttgttcaggtaggagatgccctgctcacttaactgattaagactttctccaccatcctaaacatcatttgaaacaatgataaacttttcaaaagttatatagtactagtgctacaaaatggtatacactcactccacttctgatttaacagacctagacaaagttacatttctcgggttataagtgttccaaagaaaaaatacggtttggaacttaccggaaattcgtggtttctgccatcaaagtccaaaccatttttgacttcaaaattagcaaagcctttgaaaacgcctgggcttttattcatagcatcatcccacgtcaaaccttgcagatatcccatgtgcctttctcttagtgcttcaatcaacactaactggaacaaattattggtgttactcatggaggagaaagcaggaaaaggtaggctagaagaactcacgtttgatacatcacagacttttgctatgatttttacagtctcagcagcacgcttcaaatcagacgagtatatagcagctggcctagcttttcttgcaagacgacgagccaccttgtaagttcgcatcagatcgattcattcagacagaaaatatcaaattaaactaccaatgctggtaataccataaatccacatattggtggttctgcttcgaaattttgagctagtgtgtatcgtaccacaacagcctgctgttttccaatctcgttcagctctggatccatttgcccctattgcagaagttcagtgttctatcaggagtatgtattttcatttttccaacacaacgaatcgtcagaaggataaagcaacagatgcttggtgttggctaccgacctgaacgatgcgggaggagttccacgacgtctcgccgtgccggacaaccaccagctccacgaaccgatcgacctccttcgccatggtgacagctgacacctgatggccgcaggcgagagggaacagaggatacctgacagccgccgtcgccggcgagatggggcggagggtggctgctagcctcagccaccggggaccaggtgctgcggcctgaatgcttggacgaacagtgcctcgcatatgtcctgccggaccacacgtaacatcagctattgggtcatttcagtatttgtaaccactatccaaggatggcgacgcagtacgaataaacaaaatctgatgagtgaaaagcaagagaccacgttttcctcgtgcacaaacccggtaaaatccactgctgaacacaaccgtataaggaaagtggtactcgttccgttccattttaaatacagttgtgagtttttatgtctaatattgaccgtcaatcctatttaaaatttttcttattagatgataaaatataaataatattttatgtgtgacttattttaaaaaaatatataaatttttaaataagacgtgcggtcaaagattgaaaaaaaaaatcagaactacatttaaaatgagagagggagtaagtggtaacacgctaccgatagaagttttttcgaaacgaccggcacaagcgttcatctttcaacaacaggtgttcaagtaagaaacacagcgctaagatatatagttctcctgttaattcagttgcaagaatcaccaaaccatcccctaaaaagattcaccctttctccttatcttcacaggtaagccacccttcatcctcagcgatatagagaacacatgctccggaacgcccccgccggcgacctccttgacgacgtcgaccaccaactcctcgatcacgttagcaactatggacttcatctgcacgtacgccatctccttcccgaggcacatcctcggccccgcgtggaacaccgtgaaccggaacgggctcgccggctggaacgcgccgtcgtcaccgagccatcgctccggcctgtactccatgcagtcctcgccccatatggcggcgagcctccccatggcgtacgcgctgtagttcacgaaccagccggcgcggacgaacgtgccgtcggggagtgtgtcgtccgccgcgcacgactgcgggtcggtcggcaccggcgggtacagccgcatcgactccgtgagcgcggcgtggaggtagtgcatctcccggagcgcgtcgaacccgaatggctcgccggggcgcgtgccggtcgccttcctcacagcgcggacctcgtcggcgatccgcgccacgacgtcgggccgggatgacaacagccagaagaaccacgtcagccccgacgacgtcgtctcacggccggcgacgaggaagctgaggacgatgtcgcggaggacctcgtcgctgtactcgtcgctcgccacgaaccttgacaagacgtcgtctctgtctttcacggacgcgctctggcgccgggcgcggacaatgtccatggcgaaggcatggacgtcggcgatggctttcttcaggcggcgctcggtgccgatgttgagccatttcttgatcttccaggagacctcgatggggtccatgaagcggccgatgacgaggtccagtgcctcgccgaagttgtgcatgaactccgacttggcctcctccaggaccccgccgtcggcgaggcagcgcgggtcatgcccgaacgccaccatacagatggtgtcgaacccgaatcgctggagcacgtcctgcaagtcgaggacgacggcatcaccaccgacaccatcaccggcagcgcggcggagcagcgggagcaggcggttggcgacctcggcctgcacgacgtcgacgacgaacttgcgcagggagcgcttgctgaactcgtagctggcgttcttgcgctgccagagccactgctcgccgtcggagttgaagaggccatggccgaggaaatcctcgagcgtgccaatggcgtgctggcccttgggatagtttgcgaagttggtgcgcaggatgtgctcgacgtcggccgggttgccggtgacgatgccgctccgcatcccggggatccacaatccaatcctcatctccgggctgccggcgatgagctccgtcgaccaatcaaggaagcggtggctgttcttgacgaaggccggtaggtggccgagcagcgggtgtgccttgaggccatgggtggtgggcttcttctcggctagggttcttgtgaggtggtaggacatgtacagtatcagaggcaggatgaggagcatggaataggcgtagaactccatttcaactgactgaattaattgctactttcgctgttggttgacatatatggacatgcatttgctactgcttttatatgttgagctatctgcctatctacgcttcagagttcagagatgttgagcttgttaattgaaagtcctactctgagatgaatgctaaaatattgtgaactgtactaaagagtgtgtaagcccatggattggcacatgtatgccaaattgtttgttcttgttgcccaagatagggacttgcgttgcagacttcagaagaccaactcgaagatcaattatttaatccaatggaggttaattgagaaatgtttgagtaggaagcttcggacgatatggacatgtatctatagagcggggagcgggagagaccttggtcaatgttttatagcaactctattgatttcattttctgctagtacacagtagtactgtgctgccgtaccgacaaatttgtatttgtactgcaaaagagaaagataatcggatggtttgatcatgtctgaaatcacgaaatggatcaagaatagtagaccagacggttgcttggtcgtagagtggagctgagggggtgcctaacaacccggttcaaaatatttttaatctatacttcatatatttccatcctatttgcaccctctgtccaaacttaaatacttacatcagccttaactcgatccaaattaaagtaaaataaaggagtgatacccttttattttgtactaactctgccccttcatttcgtactaactccgtctagtggcggagcttagtgaaggttatcctgggtggtgaaccccagctcattaagcagctaattctgtttaggcgcacacatgcaggagaatgttttttgaaactcatgccgatatgcggatgtgacatcacatattcagggtattaagacatccaaattagcaataaaagcatttggtacttcggcccttatcagtattctttctcatgtctgcattcctgctgttttttacttcagcccctatcaattttctttttcttacttctctggtaaataaatatcccatgttctgttctaattaagcttgaaattttttcaaggacttttagttttatgaatgattccacaatcggagttaatgcttcggtccttgcctgggttggattctgaacgtgattattttttttccactaactgaggtgcttgactaatccccagatcaaagccaccagcaaatcgaataatcatatacaagggaccgtgtttctattgtcatactttggaaaccaaaagtttggttgattatcatctagcagagcaggaggttatagtcacacgaatgtgtgactatttaactagtactaaatatgaaaagtccagtagctagtttcaatcaagcaattacaatttgtgaattcgtgagttatgcgatgtgactcagttagcacgaaagttctacaattgtcaaattgagagaaaagagagacaaacagataacagttcatgcccggattcatgaaatggcccaagaagccggttggttggttggttggaggcactacgtagaggcctcatcgccaccaaatgcattctacgggaagtcgtcttcgttgagatgggcgacatctccaaacctctcgagaatccaatggccggtggagccagaaatgttgaagacgcagatcgaagtgtttgggattctcctgcgaactgagctggttggatcggcgtgtctgcagagttcctcgatgctcgctccatgggagaccacaatcactcgctcccctgccaatgcagcatacataataacttcattttctgtgtattatgagcaactgcttgaatgactcggcataagaatgtgcaggtgcattctgaattttctttgcaccgctagctttcactttactaatagcatgcttaccagatttgaaatagctaactcaacaagcaaatttcactattctgtcaaccatacaaaaacttcagagtgagaatattacaatactgcctacccttgtgcttcccagctattgtgttcaagtacgaaacacaccgctcagatagttggtcaaggctctccccgccaccctgtcaaaacagaaaattgttcgaaacacatctactaatgttaggccaatcattatcaagcctaagaagttggtgagaaaattaaggatgaaagttacagggatttcttggcttctgtcttcagatgagaaagccttgtaagcgtcaggcttgcttctgacggcatcatcaaacttcaaaccatggagatctcccatgtgcctttctctcagtgcaggactcaacaccagctgaaagcaaatcaaatgagaaacatagcaagtttaccactggaaaatggaagcttcagcatataatgcatgtacttacgttggacacattgcaagctgtagctatagtttgagccgtttcggcagcacgcttcagatcagaggagtacacggcaactggcttagcttctttagccaaccgacgagcaaccttagacgttagcaccaattccaagttcaggtttttcgataatagaattccaagttcagacaaaaccccaaattacaatcctgtttcattatttgaaatgtattggtaaagctcaccataacagcttgctgtctgccagcctcattcaactctatatccatttgtccctgttaaaattgttctgatgatctgtcaactcgagaaaattgatggaatgacgacgaggggactgaagagctattgactgaagaaggccatcaaccaagtataattctcaagaaaaattgaaaaggacaagttattggtgacaggaacaaagggaagacaagaccgccgacctgaatgatgcacaaggcgttcgccgatgtctccccatggcgcaccaccacaacctcggcgaagtcctcgccatgcgacgacacaggaggaggaatcgtccgctcgctcattgagtcattgtggttggtactggcatctgcaatctgccaggctgctacggactacagagaggagaatatatgtatctgaaggaggctgcagctagttgagtttgcaggtgatttgcagcttcccggaaaccacacacgtgatgctttctttttttgaacgaatcatgtgatgctttctgatgccacttggtcttacattcttctattctttgcactcgtgttaaccataatcgttgtccttttttccttggcacaattgactgccaatctggtctgactttggtgatttgcatccatcaactttgatgatggccattaaccaccagctcaggacaatgcactttaccgtttactggtgcgctctatgtcccttccctttccataaaccataaagcactaacttgtcttgtgtatttgcatgttcaactttagggcatgaaaaaacgatggagtgctgatcgctgaatggcacacattggaactttggaagctactatgtgcgctagacggtgaatcgtttgtactgtacgtggtcaggttgatctgcctgtaaagtcttgtgtattcctcttcacgtgttggtcaagccaaacatttcagaatgggcaactaaattatgatcagataatctagtctaaccaattcaaaactatttttaaatgaaactagaaaggaagcccgcacaaatgcgcgggtgtcttatttactatttcatgaacacaacgctaaaaaaacatatttattataagatttcgttattaccttataataaaaaagtatctacgttgtcaaatagaccctagatatgttagatgataataatttctcccagattctaataaaaatgacgttcacccggttatgtataaattcccatattatcacgactatttattatcattgttttaaaacctgggcctatttaatggatgaaattgcatatgtcctatcaccaaaattaagcctaatacattattaatatactaaaaggtttaccattaatctgagtgttcaggtctcacttatttccaaatccatgtatatttattgtaagaataccacttctactggttaatggaataacaccgttaaaatttgacgtaaaacccctctaacggatgaagcttgccgtagccgccaagctttctttctcacacatccatgtagccatgtcacttaaacctggcgttgagggcaatttaacgcctaaatcactatcggcatgctcatagaggattacaatggtaagtagaaagttgagcactattaccaacagtagcctccaatagggccacctcaactcaaccaaatgtaagcctttgctaacgcttacaacaacgtagaaagttttctcatccatgtttgatgtccttcaactaaggacaagagagatgatggagatgataaaaatagtttttctcacagaaatagttttatttacgttttgagtagatttgtggtataaagtagacatgatttgtttatagtgttaatcagtactatttaatattttttatagatacaatattatgttttgaagataagcatgattgatcattcgactgtgcttaaaaaattatatataaagagacatatcacgatgataatctatagagcatcctatcattattatttatattttgacctagatcttttttttggcaaaatttgcttttaacacatgttgttcgtaattatatgaaaaacttttactaattccaagaatatatttattttctcaaacttatttacataattaatttgttcaagtgcacttatagtcaagttagcgggggatatggcatacatctagaaattatgcccgacatattagaattcatcaacaataataaaatatatcatgagtagtttaatgtgcatgttattggactgttcatttatagctaaaactattatgcataaaaaaaatcatacatataccatcataatccttgttatggattaaggtgcttgtgttatggaaagatcattgactcaaaatattttttatagtatttttcacattaccttgtagtaaagaaagaatttttccatgcgatagaaaacttgggagcaaagaaggaattgggtaaaactttagggacacatagaaaattttctctaaaatatgttgtgatattatctaaaaaaatatcatgaaattaattattttatgtcggtcttatgtgtcgtgatgtatttaacattataatatcattactataagtccacggtagttcatttaattagaggaatacaatatgatcacaaattgaatatctgatttaaaaaataattttaaacatgggtgtatgtttagaagtaatatgttttatttttatattatagaaaattatatagaccgtccttttttcccgatggcactaacgcacgtatacatgttttatttgggctttaactttttctactcgtacgtactacgtatggtttcttgggttttttggctggtgaacagttcgccagctttaattattttttatcgtacgtaaatacgtagttaaaatttcccagtgaaatagttacgtattttgtttgtatacacgcgagatttggtggaagggattaattttatccaatagatctaatctaatggtgtatactaatggatccaccaatttaaatgaaaattaatggtgagatgctttgtttttctataaattattagaaagtgccacgtggtggtctaggaatgtttgtaggagtccacgtggccgtttgaagacgtttgtagaaagtttaatagactttttagtatataatagatcagatgatgtaaagtgaagtacactgttattcctacaggccaaagctgacctaaccaattcaaaacgctcaaattttaaacccaaaccttcggatttcaaagaaaagcaacggctccaccaccgtcgccgttgctgcgccccgcacaaggtgggggcacgagcccagccgtccaacgacttccccttcactccactccacctgccacgattccccacgtgcaatcacaacccacctcgctccccgagcagcagctgagctcccaatccggcaatccgacatgcccgccgccgagagctgccactcccgcagcctctcgtggctcgtcaagtactgcatccccgccgaccccgcccgccacatcgctgtgcccgttctttgccccaccccgcaaccgccgcctccctcgttgccggcggcacccccaatctccgccctccccgacgacctcctcctcgagtgcctcgcccgcgtcccccgcgcctccatccctccgctccccgccgtctcccgccgcttcgccacgctcctcgcctccgacgccttcctccacctccgccgcgcccacgcccacctccgcccctccctcctcggcctctccgtctccgacaacggctgcatcgcgcaggcgctgctccggtttgaatcctccgtgcccgtgctcgaggtcgccgcgctgccgttgcccccgaccctgctgcattgcggcggctccgtgttcgcgcacgcccgcgcggtcgtgctgggtcgggatgtcttcctcatcggccgcggggcgacgctgcgcgtcgacgcgctcaccggcgcggcccgcgcgtgcgcgcccacgctcttcccgcggaagaagttcgccgctgccgccgtgggcgaccggatctacgtcgccggcgggtccgcgcgcaccgcggtggtcgaggagtacgacccggaggctgacgcgtggcgcgtggtcggcgaggcgccgcggcggaggtacgggtgcgccggcgcgagcgcgggaggcgtgttctacgtcgccgggggcgtcgcggtgtccggcgagggcgcgcgggcgctcgaggcgcacgtgtgcgccgggtcggtggacgcgctgcacgtcgcgtccggcgcctgggcgcgcccccgtgcgctccccggcggcggatgcgtcgtgggggcgtacggcgtcggtgaccacctgtacatggtgcggagccacgcggtggagctctccttctgaaggtggtgcggcgccaccgaccgtgccggtgacggcagaggctggggcgggtgggtggcgcttgaggcgccgccgatgccgagggggtcggtggggctcggcatgccggtgcgcgtgccgatggccggcctaggaaccaacagggtggcgcccgtggtgagcgctgcgcccgtgaggggtcacaatgccggcggcggcgcgttgaaagggatggtgctggtgtacgacatcgccggcggcaagtggagccgcgcgccggacctgccgccagggttccgccgcgccgcgtgcgccggcgtcgagtgctgagaatgttggtagatgtggtccccgcagttcagtgagattcgcgctatttggtgggtggataggatagattgatgctaatgtcaagtaacatggcgccatcgtgggattgtttgttgaacagcaacttgatcggatgctattacaatttttttctccagttgttatttagcattggcacataacttggattcaaactggagtacagttcttattcattttctgcaaattatgggacgcaaatattatacgagtgattattcgactgatagcgatttatgatccgtttcctggagcattttttaggcagaaaacagcacgcggagggccgtggggcttgtggtcagattcatggtcccatagaagaactgattcgagttggttgtctacttctctgtggcttcctgtgatgccaacaacctactgtctcgactgtcgtcccgcctcgagtgattacttgtgcttacattcatttacgattgtactccatttacattgttcaagcttgcaatttgcaatgtggtcctcttcctgcttcataaatcacgatgaacgcgagccacgtgattgcacggtgagcatttgcgcaagaatatatcaactgttgctgtaaccctataagccctgtaatttagtaatctatgtggctgtgtgatccgagtaattcctggttcaccttcagtacttcactctcactgccactgcacgtacgcactctcgccatccaaattcagaatcgattcggatcagcttctaccaactccgccttaaattttgtcacgccattccgactcatacgccgctcgcatcgcagctcgttcgtgccactgtccagccgcaagccccacttccctgcagctgctgtctccatctcttccattttatttgctcacactgaaatgcacgcgcgactgctgctacgaatgcacgcgcccatctccttcgcgcccgcatcttcgcccgacgccgccttcttcgcgcccgccgcagcggacgtcggcggcgccgtgtgcctcggctacggcatcgccatcgccgtcggcgtcctcgtcttcatctccaccgtcatgctcgcctcctacatctgcgtccgcgccaaggccggcgcagctgccgtgctcctcgccgacgacgacgacgacggcggcgccccggcagcgtccgccgtcgtggtgctaggcctcgacggccctgccatcgacgcgctctaccccaagttcctacacgtcggcgtcggtgacgacgacaacgcgtgcgcgggggcgcagtgcgccatctgcctcggggagttcgtggccggcgacgcgctccggcgagggcccgggtgcgggcaccggttccacgcggagtgcgtggagcggtggctgcgggtgagcgccacctgcccggtgtgccgcgactcgccgctgccgtcgccgatggccacgccgctcgcggaggccgtgcccctcgctgcgcacgctcgatgacacagccacacaggttcacatgtcacatatgttactgtgctctgtagacaatttttgctctctcgaattttctttgcttcattcgaagcgtgaatgcgtgattgatgtactccatacatttcaatactcgcatagtactactccagagtccatatactaggatatagcttttctgacactggaagctttgggaaatggattagggtaagtgattagtgatagatggagtattatatttttcatagcacagatcatcaggacgatgtctgcggaacaagcaaagctagcgtggggtcgttttcatcaggcaacggacaatacaatacgtgcatcttattatgtgtgcccgttaactcgagagtggattctaatcacttgaggatatcccttatgtatatttttcttctaaatttgatacaaatagttgtacgatgatatctatcgatacatcaaaaatcaaattcaaattcaatgtacatctcaaggaaaaaaatgcatatgtgaatagtatgctactattcataagctgaatttgtttttttatatctcgacgtgtgagatgaattcaaacctgagattttgtggagttgtatagatatgttgtatgagtagcatcaaatttttttagaatttttcataacatgatttttaagaaaatgaggaaatattctctcgacaaatcaaaatagtttcccgttaagtctcgctcgtcctagctgcaacgcatgtggtcatgtggagttatcatcacgcaaccctgcacattatcacaaggttggctcgaccgattcatgggcctgtgcatgggcctggccaagacatgatattttggaaaaagtacaccgaaggtcctcaacttgtcatcgagttacaaaatcgtcccccaaatgcaaaaccagatatccggcgtcccttaactaatcaaaactagtcccaataggttcttcggtggttttggctctagttttgttctacgtgatggctaagtcggcgtgggccccacatgtcagtgtgtccatgtcatcactcactctttttcccatctctcctgatcctctcttctcccttactcggttactctctctctctctctctctcattcttctttgggtaggccggcccacgggcacaaggtgggagagagggagggcggccagcggtggccggcgatggccgacgcgggaaaaggcaagacgatggctcctcctaccgccggagaagacgagagggagggtggccggtggcggccgatgctagggcggctgcggccggcgatggccgatgcgcaagaaggggagacgacggctcctcctaccgccacaatgacgccgtccattcctccctcctcgccgaggccttcgcctccgatttcctccgctccctcctccgccgcatcctctcgttcgcctcctcaccttcctccctccatccaccttcccacgccggccctcccccgtgcagactggcttcccgacctcccttgctgacctcgtcatcaagaaccatgatcgcccaggcgtcgtcgcccgatgacggccaccgccccgccatctcccaccactgcgctcgttggcgttgggtcctcctcctgcctcctcccacggtggagaccggcagacgtcgctaagctaccaaatttgcacggccacatcttcgtctcgacgatccaggaggtagagttggaggtggcggcgacgcccaggttgaggtatgccgattccgtctcctccctttggaccgacggtgacctcctccaccttgccctcccagccacgagcgggacggccgctgaggggagtggggagtccagcggcgagcgcgcacggggagggaggaggtggggaggcctctttctccacgcggccaccgcccgtcggccctatgatcctaccgcccccgctcctccgtcgtcgccctaaccgacctcctccctaaccggcctcctcccgcgtcgcctgttgctagccgtcggtccttctcctctccctcctcgtcccggcgacctcctcacgacccgccggccagcctgctagaggagaaaagtgagatacagagagagaggaggaagggaaaggaggggaaggagagagaggatgatatgtggcatcctgataggtggggcccacgtgggttccatggtgattcagccaccacgtcgtataaaaacagggtcaaaaccactgaaggacctaaaatgaatggatttaaaatttgagggatgtcatatatctggttttgtggttgggggatgatttttgtaactcgatgataagttgagggacctccggtgtactttttccttactagaaatgcttacagcatatacactagcagactataaatcaactataaacagatttcgagaagataaaacatacagatttatagacagttatagtacggactccaagatgcatgcgtgtatgacaggtgagactagatattaattatgtagtatatgtttacaaatacctaatatataaattggctattaagttgactataaatgatttagagccagccgttggctatattattaaactgttcttaggccttatccgactaattaatgaattaattaggtgcttaaggtcaactttcggatcaagcgtgtagtgcagtgtcgttagtttaagatttgttcgaaataggaccagaccacgttattatctctgccaatggcgagctggcgtgcggaagtaaactccaaaatttaagagaagtggctttgaaaaatacaaaatttctaagataaatgtaactatatattatatctattttggacggagaaaataagaagttatatatagacatgtcttttgtgttatcggtcaaaccggtagaagagatctctaattaaatctgtagagctgagctagaaacatgcaacgcacgtgcacttgtacttttgtagttaaagagaataatatatataggaaaaagtacgaattaccccctcgaactatcacggtcgtccgaattacccccgaaccgcaaaacggaacattcttcaccctcaactatgaatacatgatgaattaccctcctggacccaatccgcggtgattttggtctacgtggagtacacgtggcagtccagtcaacattctattttaaaaaaattataggacccacctgtcatacacaactctctcttctctctcacacacacactctctcactcttcctctctctccctctctctctcacggggtcagcggcggtgggcggcgccgtgggacaaccgaacgaggagacggcggtggcgggggacgcggaggcggtggcggcgggtgacgtgggatgactggacgag

SEQ ID NO: 22148 - DNA, 4635 bp, Oryza sativa
cgtcaggccccgccgctccatgtcccccgccgacgacgacgagaggaaggggaaatcggcgccgagctcctcatcccccaccaccgccgcctccacgtcacgcgccgcggccactgccgctccgtgtcccccgccgccgctgaccccgtgagagagagaggaagagtgagagtgagagagaagtgagagagagtgtgtgtgagagagaagagagagttgtgtatgacaggtgggtctcacaattttttttaaatagaatgctgactgaactgtcacgtgtagaccaaaaccaccgcggattgggtcgaggggggtaattcgtccggtattcatagttgggggtgaagaatgtccggttttgtggttaggggggtaattcggacagccgcgatagttcgagggtaattcggacagctgcaatagttcgggggtaattcgtacttattttccttctagtaaagtatgttagaaaaatcattctttgattatatcccattatttaattagttccgttagaaaattcattctttgattctatcccattatttaattagttcctggactttgtgtattactagtactactccagcacgttagccgatattaatcatatccttgttccaacaaccaacgatgtagctcgctgacctttaaataggcggttgaggtcttctttttttttaaaaaaaaaaacaatgaaacagatcatggggtctatttagagttctgaaaagcaactggttggtagctagcttctaaaaatatgaaaaatctgtgtttcccaacttttgttttctagtttattttttaaattttacaactatatcttcttaaaatctaaataaaaaactagaccgtttgagagagtttctaattctagaaggagctgcatcagctataacctccccaaacaagcccaatatatatgatccggctttcgagagaaagccaagatagcaagagagtccacggctgaaatagcgaaatgccctccacaaccacggcgccggagaccgatcctagcaagaccgtcgtcgaggagatcaccggctggctccgcctctactccgacggcacagtcgagcggctgacaccaccgggcgcggagcccttcaccgtcatcgtcccgccctacaccgagccgcgcaatggcgtcaccgtgcacgacgtcaccacggccaggggtgtagacgcccgcctctacctcccggccgagccggcaaccgcgcaccggccacggcggcgtcctctcctccttcacttccatggtggtggtttctgtctctccagtccatcgtgggctctttaccacaacttctacgcgcctctcttacgacgaagctcgacgtcgccggcatcgtctccgtcttcctcccccttgcgcccgagcaccgcctccctgccgccattgacgctggccatgccgcgcttctctggctgcgggacgtcgcttgcggcgaggacgagaacaacaacggcgccgcccaccaccttgatccggcggtggaacgcctacgtgacgaggccgacttcgcgcgcgtgttcctcatcggcgacagctccggcggcaacctcgtgcacctcgtcgcggcacacgcggcggcgaaggatgacggcgcgggggctgatctccacccagtgaggctcgccggcggggtacttctcaatccggggttcgcacgggaggataagagccggtcggagctggagaacccgccgagcttgttcctgacggaggagatggtggacaagctcctggcgctcggggtgccattggggatgaacaaagacagcccgtacacctcgccgtcgctggcggcggaggccgtggcgcgcttgcatatgccgccgatgctgctgatggtggcggagaaggacttgctccatgatccgcaggtggagtacggcgaggccatggcgcgcgttgggaagacggtggagacggtggtgagccggggcgcggtggcgcacgttttctacctcaacttcttcgcggtggagtccgaccccctcacggcggagcggacaagggagctcatcgacaccatcaagacatttatcgacagatactgattctccctaatagcaatttgcaatgaagatcatgcatgtattgcatgcatgcatgtcctgtgagataattcgtatgtgcaggtgcatctatcttttagccatgcactggtccatctccatccgtgcatggatgtatgttgtgttcagtttctgcatgtttgttacacctagtttgatcggtttggtgaatgttttctagttgggttcaaacttccctgttaaatttcctgcgtgaataaaatagagcatactcagtatgcatgagcatattggcatccaattacatgcagcgtttttcccgattacaccgaagactgcacatataccaccatattcacaagtgtggccctcaacttacattcaaattagagaatgagaccaatgccatatccttggccccataaattcctatcgacaacacactggggtagtcgggtgtgtaatattcgtggacactaggattagatgcacattttattcgactggtaaatcacatatttcaccgcaagaatatgattgcttaacaatatagttttttttctactaataaagaaaccattcttatcgttcttaatggttcaaaagatatcttatcattcttttggaagccattaagtatgtggttccaatagtaacatattgatattactgacacacaaaaacattttttttcatatactatgatggtttttaaacccttatatgataaccctttgtatagttacatgttagtgtgcaccgaactacacgtactagttgtgtgtttacatgaaaaaaacttcgtcggggtggaaataaagaaaccctaagatatcttatagtatttgttggttgcttgatattttcaaacgctatatatcacttttgaatgatccatatactactctaaggttcgaatatatagccaggaagtaatcataacccaacaagtctctctagttctaaaaataaatacaagtattgtctctcaggcctacctcacaagcatccaccacctcatcgccctctaatggcctctcaaaaaatatgacactagatgactctcctatagagaaatacttttatctcttaaggaaatatcctttcatttttacatgacatctaaacagttacaaaaaaatataataagataattaaattattcatatgcgatatatatcatttcataaacatgcatgattattcatttgacctataaaatctgaaaaagaaagaacaaatatgacatgaatcaacgaggggaaatcgcacatcaaagtatgaaaaaaagaatgaagtgcataaacttgtgtgggtgggtcatttaggttattaggtccctgaacttgtcataggtgtaatataggtccaaacaagttctaacccgctccatgcgctgacatggcattgctatggtggcacctacgtgtcaattaatggaatccacatatcaagcatatataaaaaataaaattaaaaaccatattttctcctcttaagtagatagaaaaaagatttaaaaaaatctaaggtagagaggatagaatatgtttttttccctatatgactgacacataggtccgactaacacgtaggcactgccgtggcattgccatatcagcgcatggaacaagttaaagcttatttggaactatatatataacacctaagataagtttaggatcaaaaatgcatcttaagagacctagatgacacacccgtatggccgcataagttttagaaaccgctcgagcagttctctctatgaaaaactatctcctcctctcacaccgcactagtacagatccttctatctgtgacgggctctaatatgtttagaaatagcgggccgtcacaaggaagtcatctcaatcgggccgaaaagtgtccgattgagatatggtcgcacagacatattagatgggcataaaacttaagcccgtcacggatgacacctatcagtgacgagccacaactttaggcccaattgagataacattctatatctcaaacgggcttaaagttgtggcccgtcacagatgaccatcatctatgatgggccacaactttaggtccgtttgagataacattccatatctcaaacgggtctcaagttatggcccgtcacaaatgaccatcatctgtgacgtgcaccaacttgaggcccgtttgagataacaactaggcccgtcacagatgactcatcagtgacgggctatatacttaatctctatcgggcattaactaaagcccgttaccgatgactatttttccatttttcatatgaaatgtttatatttgtaagttgactatagcaaaataatttagtgcagtataataattcattttatgagtcaaaataattttacgggtagtaaatgatttcaaatagaaaaatgtcaataacaaagttgtataacttatgaatatttacaacttttagtttggtcatttttcaatataacatttttttgaacagtttgaatttgaatttaaaaatatgacaacttcaaacaacattttcaaatactaaatgatttcaattgaaaaagtcatcaacaacaaagttgaataactcatcaa

SEQ ID NO: 22149 - DNA, 27383 bp, Oryza sativa
tttgttgttgatgactttttcagttgatatcatttagtatttaaaaatgatgtttgaagttgtcatattttcaaattcaaattcaaacggttcaaaaaatgttatataaaaaaatgaccaaaataaaagttatagattttgatgagttatacaactttgttgttgatgactttttcagttgaagtcgttcactgatctaaaattctatttgaacttttcaaactttgaatttcaaattttgaattgtttaaatagagtcagatggagaaatgaccaaaataaaaattttgcacctcgatgagttctacaactttgattttggtgacttttccatttgaaatcatttaataaccctaatttgatatcctggcctagggcataataggattaatagaatactcatacaacatgttacaactatttttccgaaagccaatctccatagaactttgacgttaagtgtgcttagtctggagcaatttcgggatgggtgaccgaccgggaagtttgaacttcccgcgtgggtgcacacgagtgagggctagccaaaaaataaagtttatttatttttggaatatactcatctgtgacgggcattaactctagcataagttaatgcccgtcacagatgactcatctgtgatgggctagtcatctgtgatgggctagtcatctgtgacgggccatagttaatgcccgtcacagataagggtcatctgtgacgggcactagttgtggcccgattgagataggtcatctgtgacgggctatagtttgactggtcgtctgggtcaaagctatcggtgacgggctttacttagggcccgattgagatagaatcatctgtaacggccgtttgttcgattgagatagctcttaacatcagtgacttctagcctgtgacggacgccatgcccgattgagatggggcttaccgcccgattgagatgaggatatccgttctagtgccgtgccatatcccgaacatccctcgatcgaatgacagctaactcactgaaaaactgcggcattggcgatgtggtttcgctgcttggtcatcactgctccgtcgtcggcttgccgggaaaggactccgtgttagtgatatttgaagggcaatttgatctatccaacggctattgttagtcaactgcatgggatttagggaattgcagttgactgactttagcaaatacgaactgaaactccaacgaagaagcaaattaacttaattaataagttgagcagcctgtaggcctgtagttggttttggacatggacattccaaccacattactatatatcaacctataagttattggagcaaaatagtaatcctccattccagagagatttgataggacacaccattttatcggaagtgttaggtgcgaagaaggccaccattttctgtcgatcgagctttattaaagctagaccgagacgaaacgactcaccaagactaagtgaaagactcaaattaacatactacaacaaattaaagacgacttgagccaatcaacgatggcgtcaagccagcgcgtccacacgacgtacgtatgcgcgcagagtttgcaaggccaggtcatccatgctcgccgtgaatccgtgctgcgtctataaaacacaaacgcagcatagccagttcatttcacattttcactgctacgtactcgatcatctggccagctgctgccatggcaacattgccacaaatggccgcgaccaaggagcgtcaagaggcggctaacccgaccacgacgaccaggacgctggtcgagtccgtcaccaactggatccgcgtctactccgacggctccgtcgaccgcctcggcccgccggaagccgccgcgttcatggtcctcgtcccgccgtacgacgacccacgggacggggtcaccgtccacgacgtcgccacggaccatggcgtcgacgtccgcctgtacctgacgacgacgacgccggccgggcgccgccctgttctcgtccatttccacggcggcggcttctgcttgtcccacgccgcgtggtcgctctaccaccgcttctacgcccgcctcgccgtggagctcgacgtcgcgggcatcgtctccgtcgtcctcccgctcgcgccggagcaccgcctccccgccgccatcgacgccggacacgccgcgctgctctggctccgtgacgtcgcgtgcggcaccagcgacaccatcgcgcaccatgcggtcgaacgccttcgcgacgccgccgacttctcccgcgtgttcctcatcggcgacagcgcgggcggcgtcctcgtgcacaacgtggcggcacgcgccggcgaggctggggccgaggctctcgacccgatacgcctcgccggcggtgtcctcctccacccgggcttcatcttgccggagaagagcccgtcggagctggagaaccctcccacgccgttcatgacgcaggagacggtggacaagttcgtcatgctcgcgttgccggtgggaaccaccagcagggaccacccgtacacgtctccggcggcggcggtgacggcggcggagggagcccagctgccgccgatgctggtgatggtcgcggaggaggacatgctccgcgacgcgcaggtggagtacggcgaggccatggcgcgcgcgggcaaggcagtggaaacggtggtcagccacggccgcgggatcggccacgtgttctacctcaactggttcgccgtggagtcccaccccgtcgcggcggcgcgggcgcgggagctcgtcgacgccgtcaagagcttcgtcgatagccactgaatcgattccaagtttgaatcggtgtctgcttctatgtctgaatttgtgtcgaaatcctgtatccatctcaccgtcacgtagtacatgtctacatcgcaatgtctctgtagttaaacaagtttcccgcgcaatgcatacgtgttttcgtttctccgatccgcttacgaaatttcgatttgatggagaaacacgtcgagaagatgctcagtttaggctttcgtttcaacccgtctgcagaggatctcatcaccttctacctgccacggctgatcgccggcaagccaatgaaagacaccgagaaattcatctgccgcgctgatgtttacggcagcgagcccagtgacctcgccggaaagttcgcgccggtgcccaggtgcgagaaaggcggcaggttcttcttcactagctgcaagcggcacaaggggagtagcaccaagaaagagcgaacggcgggggctggcacctgggtgaggcagaacagcaaggaggtgaagaacaaggcgggggtcaaggtcggcgagacgcagaacttccgtttcaagaaggacgggagctacaccgactggctgatggaggagcaccactgctgccggcagcaagccgtcgccggcgacgaggagcccgtcatctgccggatgtacgtgtccccgcgggcgcctccggattccgcggcgcgccaggaatccgctgctttcgtgcagcagcagccggcgccgcaggtttccgagccgccgtgcgacaagaagaagagagatgatgtggcagaagaagcccctgccgcggcttaggcgtcatcagaacagaatatatgatttgaactttttttaccaactgtatgtgcatttccagtgggataaagattctaaccaaagcagagactaaaaacatgtggggtaatgttttttcaatgaccataacaaaattatttcgagagcaatacaggtgcaaagttgaagaaagacttcctgctatctgaactggggtgttgccacacatacaatgaactctgcaacccagacagcactaacctatagatcaggcatcccaattccagccttggcatcataggttttctccagcacatgttcaattcgtgtatcctttgggccagctgcatgaatgaaacaaaatggccaaatttagtttcctcacaaaaaaaaaagaaaatatatacatcatatgccgagtaatatattgacactttgacaggaaatagaacgcatttgcttgcatgtcaattacatattagtcattcgataatagatagccaaaatacaaaggcatgtaacaaacatatttagtattttgactccaggtatgtaaaggtcatggatagatcagagtcatgatttttctttttcagtttgtattattagttaactgctattatcgttccaatgcagaacaattacaaaacaaacaatagtaccacaagccaaacagcaaacaccataagaaacatctactgtagtaaactagtaattatgcatgatgttacagtaccaaagattattataagcacttgatgctttcctttattagtatttattattattgtgatctcagttgaacatcaaactggtacagcttaatttctgatccaggaaaagaacagcatagacaccacaaaagtatatatgcacttgacaagggaaccatgcaatgaacagagacatacgtgatgtaggtcttggctttcttcgctccttcaaaatttctggcctgggtatcacagcaccagatgcattcattcctctagcaaacctgactttagttccatcttccaaatacttgtatccaatcttacatggtttcctgttgccagcgttgtgtggataaatttaccttttaccagtaaactgcagtagaaatggaagaaaaaaatattctatctagatgacaagatggatggttaagtatcatacccagtgactggatcaagtacttgaacatttgaaacatgaagtggagcttcaattgagaaaatcccacctgtatgtccttctccttgcttaatatgtttcttaacctgaaatgatattaaggcacaattattattatccaaactcttatgtacaagagaaaacactcacatacataagaacaagaaactgttgtctgtcgttagttgttacttcctccgtttcacaatataagtcattctagcattttccacattcatattgatgttaatgaatctagatagatatctatctagattcattaacatcaatatgaatgtgggaaatactaaatgctaaaatgacttacattgtgaaacagagggagtactgattacagctgcccagtagtcaaaaagaaaaatgtgacacgtaacaacaaacatgtgaagattttagaaggacaaggtttttacagtttcaccattcttctattgcacccattaaaatcaattcctcaagatccatctggatactggacgaaactaattcagtatttactcctctttgttatggcatacaaatgatacaaacacacatgatatgatccaaaatagatacagcatgtaccattatgcagtacatagaacacaaggatccagcaggcatctacaatttctgattattctatgcataaaggcagatgctaaattatttgaccactgcttttgttggatcacgcatagctaattgttgagcttatcataaacaccactctctatatacgatgatatgcacaggtatccaaatcctcttgataaaaactctcttcatattatgctatccttgtgccatgatggatatatagtccgcggaataatattacgttatgagtatttacaggttcaaattcgtatgaacaacactccaatggaaacaatggtcgagcttacatctgttacagcaagtcataagctatgtttgtgacagcagtcaaaaactatgtttgcagctcctacgactaatctgaactcaggacttgggagtttaaaaaaaaaacgagtgcaccatggagatcaggtcacatactgccatctgacagatacagcgttgtaagctcttttatctcattattaaatgaagcttttgtgcctctattctaaactttcaatagttgggcttaaaaccttttcaaaaaaaaaaaggaaaaaaatgcagtagtttgcatcaggctaaataataaacggtaattttctgaaccagttaaaccgatgacacaaaaccttgaaatctttcaaccaatcagcacaaaatctatgcagtatttgacaatttctggaggagggtgcgtcagtatagcaataacttaccaaattctttccctcgacgatgacacggttctgcgaccgaatgacccgcttgatgagcccgctctcccccttgtccttgcctcttatgatcatcacctggaaataaacagcgccgaaattggagattttgctagaaagaggagaggggcgaagaggaatgcgaggacggggaaagataattacgttgtcaccgcggaggatcttccagtgtctgatgagcttctccgcagccttccaccccatctctctcgactagatccctcctctctacccagccagcggctcgctcctgggctccccctccctcccagtaagcttcaaaccttggttgcggcggagatgggggtggcggcggcggcgagggagccggcgctagcggcgaatgtgatgctggacagatcagagtgggccgagaagaatgattcgggcatttaattgggccgtttccttcaaaaggtttcggattggaataagttcgggagtgactccctttactagtgaccttatctaattcgtatccctgaaccacagtacgaatatctcgacccctaactattaaaaccagtgcaatttaactttaactgttttgctgacgtggcggtgttgacccagtcttcatccaacatttatgtggtattagaattaaaaaatatatgtagtacccatttgtcactcacacaaaaataattgtgggacccacttattatacgggcccacatgtcatcccctctctctccttcccttctccctcctcccccctctctctcttatctctctttctccctcccccctcccatggggcctttctcttcacctgggtggagcggcggtgggagcggcggcggcggggtggggagcaacggcgccctgagggagctgcgttgcacacgtagccgaggaggaaaaggcggtggcgcagcggcgcgagggcggatggggagcacatggccggcctgcacgccatggcggcggcaaggacgggcgtcgatccagctgtagaagaagagcggtgggggtgtggctccacccgatgtggacgcggtcgacatggcaagggaggcgggtggtgacaccaaggaagacatctgtgcgcaccaccggatgcctccgttttcgctacccaccacgccaatgtctccgcttgccactgtcgccgcccttcctctggccccaacacgctgctcccacctagcaagcggcaaccatcatacctctccccacttcgccgccgctgccaaccaccggacgccgccgccgtccccactgtcatatatagtcagataaagagagaagggagagagagaggaagaaggggaggagagggccccacatgtcatcctttgtgtaaattggtcctacacataccctttttaattctaattctacttaagcgctacatcaacgccacgtgaacgaagacccggtcaatattgccacattgatgtcacatcagcaaaaccaccctccaaaactactaagggagttaaattacaccagttttaatagtttggggtcaagatatccgtattgtggttagaattagattcggccactggttaaaggagtcaacgtaaacttattcctttcggatttgtttcgtttcgcaccaaaaacctatgggcttatggtgggttttgtgaaatcctctccggcctatatatagtcatctatctctcctctctcgatttggaaaaagaaaaaaacagtttctggtaggcattctcgaacgagatatgagtaatgaaatcgaagaggcgtgttgagtgagctcaaatcatcggagttcccattcaattgccttttgtttgtcaactgtgcaggttgatgctggcatgctgttagccagcttagcacacgttcttgtcaaatactcgagtgacaagaggtgttatgcagttgattctgtttctgattaatcttaaattgttaatcctcggatccaacgcacaagcagttgaccagttgagcaaagtagcaactgagtagtgtgtatcaacgacccttctcttcgcagcaaccagcaataccattaccagtacagttcagcaactaatcgtgagctgattagctgaagcacataacacgtaaagcgtccatgacgatggagaaacgcacgtcaccgcaacaaccgccaactttattacccaccaactgctcgacgcatttcctctacgcgcgcgcgcccaccaccgccggcgtcacacctcgccagccgcatcaaagcttccgctcctacctcgcccaaatgggcggcaccggcgacgatggcgccaaggcccctgcggccgccgcggccatggacgtcgtgtcgtcgtcgtcttcttctccggcgccagcgccgtcggtgctcaagtcggtgctactgtcctatgcgtacgtgagcgtgtggatcacactcagcttctcggtgatcgtgtacaacaagtacatccttgatcccaagatgtacaactggccattccccatctccctcaccatgatccacatggcgttctgcgcctccctcgccgtggtgctcgtccgcgtcctccgcgtcgtcgccgtgccggcgtcaccgcccatgacgcccagcctctacgccgcctccgtcgtgccgatcggcgcgctctacgcgctgtcgctctggttctccaactccgcgtacatctacctctccgtctccttcatccagatgctcaaggcgctcatgcccgtcgccgtctactccctcgccgtcgccttccgcaccgactccttccgccgtgcctccatgctcaacatgctcggcatctccgcgggcgtcgccgtggctgcctacggcgaggcgcggttcgacgcgttcggcgtcatgctgcagctcgccgccgtcgccgccgaggccacgcggctcgtgctcatccagatactgctcacctccaagggcatgtcgctgaaccccatcacctcgctctactacatcgcgccgtgctgcctcgtgttcttgacgctgccgtggtacttcgtcgagctgccgcggctgcgcgccgccgcgggcgccgccgtccggcccgacgtgttcgtgttcgggacgaactcgctgtgcgcgttcgcgctcaacctggcggtgttcctgctggtggggaagacgtcggcgctgaccatgaacgtggccggcgtcgtcaaggactggctgctcatcgccttctcctggacagtgatcaaggacaccgtcacgccggtcaacctcgtcggctatggcattgccttcctcggcgtcgcctactacaaccatgccaagctgcaggggctcaaggccagggaggcagagaggagggccgcgtcaatggcgacggcgaaggacggcgacgcagaagccggtgcgcggctgctgccggagaaagatgccggtgagcagaagaactgatcaaagtcgaacaccaagcatagtacattaatgaaggttgataaatcaacggcatttttttcatctttagatagcctgaagctgcttagtattatgtttgtaaacattcattattacagaggatacaaatgatcagtgattcgaaatatgcatgcttaaattgcagcattcattttttttctcattttaaagattcagtcatcgtgttaaaactccttgctccctgggcactagtgttcatctaacatcactgtcacatggttgttaatcgtagcatactagcattctgtttgttgattgtgctatatatgaatgatttggtgcacgatgcagtaatgcagagctccaaacctgataatccactggctaccaaatactaccttcagttttactcaaagtgcaacaagaaaggaccaaaagacaaacaaatgcagcaaggaaatgacgcaaagtgtcattacagtgaagatagtatattgagtgactagtaggtcagggtagtagaagagaaagggatttgctagcttcctactcgtacttagggcaagttttataatagggatagttgtcacatctaattttatccatgtaagataagaggtgatatatataatacaccatatctacaccacctctattattataacccaaataattttattttatttgtttgtccaatcccctctttctttcatcttctttttcttggggtttgtgtggaggttgccccttgcatgatagggggctcaccttctctttcctcaattattacttccacctcatcatccaatcatacatgatatttttagaggcaacacattaagcatcatagtacttgcccttactgctgcctacgatataggagtatcctcctaaaccctataaactctaatactaagggcttctttaaaacacaggattaaaaaaagatacatttaaaaaaaaacaaaggattttgatagaaatgcaaataccaaatagagaattataaaacacaggaaaaaaacacgaatgatcgtttgattaggctataagaatcaggataagagatagacttcaaagaaattttcaaagaggttagagctcttgttaactttcctctaaaaattttaaagaaaatgagagaaaaattcacaaaactacaaatattatgactaaagcactaaaaatttaattagtgtatcacaaaacagcagatttaacactaaatttatcacaaaactatacgtttaagatgaagtgtcacaaaactacatatttagtaacaaaattatcacaaaactatgggtttagaaccattttagtcacaaaattacaacacttattgctccaacataacaatggtgttagggatttaaattctaaaatatgtacttttgtgatgaattcaatattaaatatgttgttttattttttaaacacattaaatctgtagttctgtgagaaatttggtgccaaatttgttgttttgtgatagtttggtcaacatacatgtagtttgtgaaatttacacaaaatgatatgattcaatccttgtttcaaatgcttttataggaatttttataggaattttttcgatatgattaaaatctttcaaatttgaaatcaaagggggggggggggtaagtagtactatctttaggttcattaaaagctagcaacaagaataccgaagccatcatttcgcttatttgcgaactaagagaaacgacatatttgcaaataaaaagtaatttgtgaataaaactttttatatatatgttcttaaagatctaaaagcaaaggctaaaaaataaacttcgatgaaaaaaacctcaaaattagctccaaatttacggttgaaaattcaaaatttggctgataagtataagtataaacgaaaagcagctccaaatttaaggttgaaaatttaatttttgactgataagtataagtataagagaaaagatgaggccctacatgaagtcctgtccaatcatatatgcatcattgactctctctctcctttcaattgtattaatcgagtaatatttcgctgagtctgattaacctaggccgcgttttgttcgtgtgccaattttttttaagtatacggacacacatttaaagtattaaacgtagaataataacaaaacaaattacagattccgcctgtaaactgcgagacgaatttattaagcctaattaatccgtcattagcaaatgtttactgtagcatcacattgtcaaattattgtataattaggctcaaaagattcgtgtcgtaatttacatacaaactgtgcaattggttttttatctatatttaatgattcatacatgtgtctaaatatttgttgtgacgggaatttttggaagtttgaaagaaacaaaacactgccgtgcatttcgccgcacattggaggcccatcaagattttatatggccgccatggtccaaggcctcagggacatttcctgtattgggctgagccggactcttcgtcaaggatgaatttgtaatcagtgaaaaaatcgaggggctggatgcaaatctccattcccatcgtattcctctccttccagctcgagactagggctcgcaggtggcttattccccctaatttgctcgggaccagaccacacctccccaaggtgagaaccaaatctctgattccaatcttgttacgttcttggttgttctttgccttgcgatttgggagcggcagcagcagtaaggcgctcgtcaagatctcttcttttcaattgttggggtcgcgctagttcgtcgaaatttatcctttccgattgctggattgcgtcatttcgttaatatttctccttcccaatacctatcttgtgctatttggaaacgagagcactaatctacttcttcgatctaatatgtttgtacaggcccttgtatataaacgaacaaactttactcatatattcagtccattaattttaggtcctaatagttgttttttaacttatgcgaaaattgcaatgtgctgaacagtgcaggtgatatctctttcttaacgaaaaatagagtcagcatgtaattatctatatggtacttaagatcctaaaaattaagcaagggctaggttgattgcttgctgtttgaaaattgttccagttagcattttgctccattctttgttattagtcagactctcaactgctgtcatgttatttactcaggaattagatttttacttcagatatcatattatgcaaattgtattctatttctcatcgtgcttttatctctgtgcctttttcttttcttttcctttcccttccatttcacggaatatattggcatcatcagcttgttgattattcttcgcattgcatcatctttgcttcccctcttttgcatgctcttgctgtccatgctgattggggattgtatcttgagaacctccccgtgtaatcctttgtaaccataccactgtttcctcatttgttccatatacattttctttctatccagttggatacccatggctgcatcctgtttgacattattgcataacaagtactcttgtttatttggttgtttttcttcctatccttgtatcatcactttgctctcccaatattgttggctcctttgctctttccaaagttgccttggaactttgagcttttcaagatgccaaggaggacagataatgctgcttctgccaattcagttgaaccagaaaaatcagaagaatgtttggagtttgatgatgatgaggaggaggaggtagaagaggaggaaattgaatatgaagaaattgaggaggagatagaagaggaggaggtagaggaggatgaagatgtcgtgtaggaagttgaggaggtacatgaggagcaagatgaggaggaagaaaaggaatctgatgaaactgaaggtgtaagtaaaactaaaggtgttcaccagaaggatgttcctgaaaagggaaagcatgctgagcttcttgctcttcctccccatggttctgaagtatatgttggaggcatctccagtgatgtatcttctgaagatctgaagagactatgtgaaccagttggagaagttgtggaagtaagtactgcttacattgttcattttatgttcccatgtggcctgttttgttctgaattacatattctcccgttttatgcaggtgagaatgatgagaggaaaggacgatagcaggggatatgcttttgttaattttagaacaaaaggtttggcattaaaggctgtcaaagaattgaacaatgcaaaactgaaggtttgttttctgttgaacttgagaaatgtctatactgtcactccatcagtgccattgatttttaacctaagattggtaattgatcaagcaagttctggacatttttactacaccttttgcagtttccaaatgtgaactggtagagaacaaaatagtgatttcactcgaatattatcatgcaataagctttccttttttttaattttttttcagtcttattgcacttatatctgcagttgacttctgttgattttgacatagcacagtaatttcacacatcagctgtgctccctgtttccctggatatgtaggaagaaagagggaggggcacacacatatctactatacatgatctctagtaatatcatggttttgtaacgtgtaatatttggttaaaactactgattatgccattaacaggaaacacttgttcatgattgggagtagtggtagcttatgttctcttaccaataattttggaaaacatagctttgctgccttgatcacacacatgtgcagaatatctcctggttccctgttatagctgacaacttatctatcttgatcttttatacctactgaattttttcattatgcttctcgttacagggaaagcggataagggtttcttcctcgcaggctaagaacaagctttttattggaaatgtaccccatagttggacagatgatgatttcagaaaggttgtggaggaagttggtccaggagtattaaaagctgatctcatgaaggtatggatctgggtagttcaacaactttgttatgcaccctcgatcttgtttctcctaaaaatttctttgtacttgtaggtctcaagtgcaaatcgcaatcggggttatggttttgttgaatactacaaccatgcatgtgcagagtatgcaaggcaggagatgtcttccccaacattcaaactagattcaaatgctcctacagtcagctgggcagatcctaagaataacgactcggcctctacttctcaggttcgttcaagcataacatgaacaattttactttgtttgtgtataattcttataccatgatgttttatttgaacttgattattttgcgtgtgttttcaggttaaatctgtatatgtgaaaaatctgcccaagaatgttactcaagcacagctgaaaaggctgtttgagcaccatggtgaaattgaaaaggttgttcttcctccttcaagaggaggtcatgataataggtatggttttgttcactttaaggacagatccatggccatgagggctctgcagaacacagagagatatgagcttgatggtgagctttcctcttgcgctgtaatgtcccactatgcttgcgtattcccccaaaaaatgtcccactatgcttagtctggtttgtctggtgcattcaaggtctcacatatttctcttaacaggtcaggtcctggattgctcacttgcgaaacctcctgctgctgataagaaggatgatagagtaccactacctagttcaaatggagctccattgctcccgagttatcctccacttggatatggtatcatgtcagtaccaggtgcctatggtgctgctcctgctagtactgcacaggtacacgagtacatcatcatcatagacccctttgcccaatcaatgagtaaatacatgtagtaaaggatgattgatgcccttctaaccattgtatgctctgcattttgcagcctatgctgtatgctccaagagctcctccaggtgcagcaatggttccaatgatgttaccggatggtcgtctcgtatatgttgtgtaagcgctaccaaccatcttttcttcagaaaagctaataacatgttatcacctatcagcatgagatgagatgaaatgacttctgttcagttacatgtcattttggcatttccattgctgatgatatcttcattgcttctttgcagacaacagcctggtggacagttgccgctggcttcgccgccgccgcagcaagctggacatcgtagcggcagtggaggacgtcatggcggcagtggcggccgctatggcggtggtggtggcagctccggcagtagcaggccaggtgcaaagcggcagagaggagacgacaacagcagtagccgccacaaaggccggcgccgcccgtactgatctgatcagcatagctgtagctaccacttagaagatgtagtgtcgttgcagaaaattaccagaaaatctggtagaaataatttatactgtttgtactcgtcgatttattagaggaatgcgtttctgaaacaagactgtacatgcgtattttacctgtatcgcagagtgctgaatctgatggtgcactggtacagtataagccagtttcaggtctctttgtaagcctgttttacattatctttcgcttttgcagtaccgtcaattcacccctgtaagccacatggactatgagatttctgggccagaatctgaggtagacagtgaggtgtggcttggctgggtggcgcagcgacgtgtgtgctcaagactggagacacggttgatgctgcccgagctgaacacgtcgtgttgactctctcgagaggcggacgggtacgtgccgcccctccatccattctagccttctaatctaaaagcatccacgggctctctggtgcgctgcttctcgactagacgcctcctccggggaacctcgtacagggcggcgcgggccacagctccatattccggtcgacggcgagtccacgaagcatcggacgccggcgacgacactgcaatccggcggtcctggcagcaggtgaaaggtgcgtgctttctccgcctgagaatgattggttaattccctttgcaattaacttgcaaattctttttctaatttgtgcatcaaaatttccggccatatggtgattgtacatgttgtattggacttctaggcgccggattggccaacttctaaatttatgatgcttttgcgcatgacaaaaatgacagatcatatttatccatttacttcattctaatgaaataactcctagttaattatctttaggttgctcatagagtcatagttactcagggttgggctatccggctatgctgtaccgttctatattcattgatattttgcctgcccaatattgtacgcgaagtgctacagttaacatgatcatcaatgatgctaggtgtctgatttccctgaaacatgttaggttcatgatgctgatctttatttatatacgaactgttatgtatgctctatctggtcaagtcatgcttgatagttgatacatccttttgttctgaagaattctagtacaaatttaggtttttgaacaacagggcaatgtcaaaggttgcaattgttaggttagcttcaaatatacatttgcagcataaactgccatgtctctgtccagtagttatgccaatgtttaacctagattatttcatttacttgaggaaacattttttttgaatttagtttctctactctctgaacaatccaacctggtactgttatctgattctgtgaattttctgaactttatacagggcctatttggtgtaagaatttatatatccgcccactcatttagtcatctgcatcttctaagttgggtgaaaaaatatggatgacggggagatagagctttccagccaaatgatgtttccaaatccagagattccaaccagccttgatgacttcctgccaagcatcaggacaacatgcacacacactcatacttgcaacccgcctggtccatcggcaacagagcacacccatacatgctaccacactcacacccgtgtcttcagctcagatgatgatagttgtggaggtgacaaagccaagccaaagaagagccgcaagccattgggcaaccgcgaggctgtccgcaaataccggcagaagaagaaggctcatacagcacacttggaagaggaagtgaagaggctccgtgtcattaaccagcagctggtgaagaggctgcaagggcaggctgcacttgaggtggaggtggtacggttgaggtcgttactggtggatgtgcgatcgaggatcaatggtgcattgggtagttgcccgatccaagcacaatgtggagttgataatgttttgggttgtgatggaatggctcagtgctttgctggaaagccggagttgggtgtgagacagagttgtgcaccttctacagtgaattgccatatcagctcggattcagggcagaacctggtggtgccccatgctttaagccctagcgatgttattggaagcttcatggtctcatctacctcaaaggatgagtagatattgtaggtattattttgttgagtaaattgcatattggtccatgttttttaaccatggtttcacattggaccaccattaactgaatgctttcactttacaccagattttattaccaaaatgtatcactttggaccagtggtccacttgccagtgtggctgaggggaaaaaaaaaaggaaacttctcggttgggaaggaaccagcgagtccgctgactcatctcctaccacaccgttgatctctttccaacttcacccaaccatctcatggcggtgtgggcagagatcacgctaaagccttgggggcaacatggggagcttgtgactggaaagactcgtgtggaggtcgatgttaggcgacgtgagcaaagaggagctcgtgtacgtccaggtacagcagaagtcgagtcacggaggcgacggcggtggagaggagcttgagctccgggatggcgcgcgggcatcggagtagccgtggagatcgaggttgaaccgggacggcagagaggagcttgagcccaagtacgatgtgctagtgctactgaatatcgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccacgtaggtcaagctggggtggtggataggagctcgagctcaaggacagcttgtgggtgctgatgcctgctggtgcctggaggtcgacgtcgagcggggggagacacggcagaggtcaaggccgggggtggcgcgtcggcatgggactatgggagagttcgaggtcaagacggggcatcaacgtcgagcggggagagacacggcagaggtcaaggccgggggtggcgcgccgacatgggactatgggagagctcgaggtcaagacggggcatgacgacagcggagattgaaatcgagactgggaaatgcgtgtgtgcgggaacaggcggaagtcgaggtcgagccaccggacgacatcggcggagattgaaatcaagccagggaatggcgtgcgagtgcgggcggaagtcgagatcaagccaccagacatcgagcttgagcctgagaccggccggcacgacgggaacaaaagtcgagctagtgtgacgccgtgttggcggaggttgaccccgtgctggctggactacgagcttgagatgcgcgggcgtcagctctgttatatatgctcgagctctcttaggcgtcgtggtctttgtggtctacagccatcgatgaaaacagttggagatgatcagatagggatgagagattggctctgagagactgactatgggccatacgcccaaagtgaaaggttttggtataaaatctggcctaaggtgaaaacattatattaagggtagcccaaagtgaaaccatggtaaaaaaatatagtccaacatgtaatttactctattttgtttctagcctttttatcagaagataagacagtagtattacagtgccgtggagcctggagggttgatgcctcgtttcctaggtggcattttacccctgaaatctggtgcaagttagtaattagttttcaggttcattatcaaatacaaatttttggtttctacgtagtgtaaaatgtctttggtttctatgcagtgtaaaatacacatttccccctcttttccagagataatgttcagttttaggaatttgtgttttaggagctgttaattctgagcatttccttcttttgcagatactctgtccaattctgtgagtggttgggtgtgatattctgtagttgttaactatgcacttttacttcttttgtagagatgatgttctgtttttggaaagatatttaggagctgcatgactcatgaatccgatggctgtataatattttctgcgtgccaaatctcatgatttttccaactcattaactggattaggacacaaatctgcaacagtcagctggagatccctgatgagcagcacaaaccggtcctgaaactgttcaaatacaacaagaacaaatctattatcttattaaagtaatagaaaaagaagccaccacatttgttctcacggcctagaaattaccacgttaatcgaagaaaataagaaaaataaaaaaggcaagcggagaaggatatgttaatagcatgaaaatatgaaaagaaatagtaaagcaatcaatcggacaaggattcatggaaactgtaaaagtgtcaaacatcaataagaaacagacttagtgtgtggaaacggaaatacaacgatacaagtaaaaatagactccggtcacagtgcattagtatcgtttagagtccaaaagtaaaaaaaaccaaaactatttaaaatacctgaaattcaaaatataactaactattgcaagaagaatctatgtataaatacaatttatactaatatgaaattacaattattttttttaggaaatctaaacattgagaccagagttatatagaatttacttaaaaaagagtccatataaaaatataatttaaaaatatctgaaattcctaattaaaaaaaaagaaatattcaaagagaagactagactccatgtatatacaatgtagaactaattaaaatttggaactaaagttagagtccataaagaaacaaaatttagaaataactaatatttggaattaaaaaataaaaaatattgaaagaatattttagattcattatggaaatacaatttacaaataacagaaattcagaattaaaagaaatatgggaagaggagtctagagttcatatagtaatacaatttaaaaataattggaattcaaaattaaaaataagaaatacttattgaaagaaaggtttagagtccatatggaaataaaatttataaataatagaacatttaaattagaaaataagaaatatttttaaattagaaaataagaaatattggaagaggagtctggaatccatatagaaatccaatttagaaattacaaaaattcaaaatttaaaaatagttagtaactatcacgtatatacaatacaatatgaatattatatgtgatatacaatacaatatgaatattacatattggttggtgctgttaagttagtacaaaatttaaaattatgttgctattttaatatattttaattatattatgtgaaaatatatgctactatgtgaaaaaaaataatgatatacaatacaataaaaatatcacacatttgttagttcaaccaagaatttaaaattatgttgtcattttaatatattttaataataaaatatgaaaatatttaagctaatatatgagaaaaaaatttaacgatactagccgtgcaatctgcgcgggccaccatgctaaatttttttttttttgacaacagaggtacacaagcaactccaacttcatttcagacgtacacagaaaacaggtacaccgtacacgaacacctttactcataggcgtgcaagaccaagtactccattcacatcgcatacacataaaaactcataaatctcacgcaaacaagaacatcataaaaataaatataaaatataagatactaaaataaccagagcaaaggagatcactaagatgattcactcatagttatacgaaaagaaagaagcaacagagagctcaaccacaatgtttcagttccagacaaacgctgcgacggcgagcacagcggcagcaacagcaagtgagcagctcccaccggcggccatggggcccgtcgccgccgcgccgttgttggacgatccgctgtactgggcggtggcatcctcaaaacagctgacgatgcatacgacgaacagcacgagcgcaatgaccggcttgggagaagaacgctccatcttgttctgcttttgcttgcctgttcagagttcagatctcagagctgagacgatacacttgagcatttcgctcaaattgacaggatttatatagaattgcctcaagttgacatggtaaacatagtacacagatgcacaatacaagtttgtccatttctctacatcgtgttctgctcgccaggatgagttgggtttgatctggacggctggtttgttgctgcatattcgtctgaaaaattcaacaagcagatgaggtgctggctttgtttctgatgctagagttccttcctttttgtcacttgtaagttgtaactttcactatccatacaacaaacgtaacaaaatttccttttcagagaacaaaactgatgatctgattgacaacgtcagttcttatgtgtgttggtcgcatcgcatttatcaatgagcttagatgatgcctatgttcagctgatgcctgatgccatcagccacagccatgtcgatacgctggctgattagctgatcgatgactccaatgtaagcatggaaaccacctagtacatcatatggcactccggtgatgagaggagttcgtgttttcttggggcgctgcgttgctggagttcatggggccagccgcgccgccgtccgaagccgccgcggcggccgacgatgtggtgctcccgtacatctcgcgtattctcatggaggaggacatcgacgacgacatgttcttctgcctgtaccccgaccaccccgctctcctcgaggcgcagcagccgttcgcccagatcctctcctcctcctccggcatcgccggtgaggtgaacagtgcacccatggaggattctgctgccttgatgatgcaggggagcggcaatggtaggggacggaagggtagtaagcatggcggggacgagctggaggccgaggtgggcagggcgagcaaactgatggccacgccggaggaggaggacgacgacgacgatggcgtcggcgagatgttggagaagatgatgctcaacggggacgaggagatgaacgcgccacgcgtccccgcggagaaaaacggcgggaaggcggcgcggcggaagaggaggcagggcaagggggaggtggtggacctgcgcgagctgctcatgtcgtgcgcgcaggcggtggcatcgggcaaccgccggagcgccggcgaactcctggagcagatcaagcggcactcgtcgccgacaggggacgccaccgagcggctggcgcattacttcgccgacggcctggaggcgcggctggccggcgcggcgagcctggagcaccggctgctcgcgtccgcggaggagcgcgcgtcggccatggagttgctggaagcgtaccaggtgttcatggcggcgtgctgcttcaagtgggtggcgttcacgttcgccaacatggccatcctccgcgcggcggaagggaggagcaaggtgcacatcgtggactacgacggtcagtaccacggcctccagtggccatccttgctgcagcggctggcggagagggaaggcgggccaccggaggtgaggatgacgctcgtcggccacccgcagccaggtttccggccagcccgacggctcgagaggacggggcgccggctcagcaactgcgcgcgcgcgttcgggctcccattcaagttccgccccgtggcggcggcgaggtgggagacggtcaccgccgaggacgtcgtcggcgtcgaccacgacgaggcggcggtcgtcgtgaacgacgtgctcagcctgggcaccctgatggacgagagcggcgtgttcgacgacccgagccctcgggacacggtcctcggagcatccgcgacatgcgcccggcggtgttcgtccaggccgtggtgaacggcgcccacggcgcgcccttcttcccgacgaggttccgggaggcgctcttcttcttctcggcgctgttcgacatgctggacgcgacgacgccggaggaggggagccacctgcgggcggtgctggagagggacgtgctgaggcgggcggcggtgggggtgatcgccggggaaggggcggagcgggtggagcggccggagacgtacaggcggtggcaggcgaggaatcggcgcgcggggctgagacaggtggcggtggaggcctacgtggtggaggcggtgaggcgcagggtgaggaggcggcatcacgaggaattcgtgatcgaggaggatgcagggtggttgctgcaggggtggaaggggcgcatcctgtatgctcactcggcgtgggtcgtggcagaggatggtgcgcactagcaactagccgccatgacggtgttcgtgtgtactgggaatgcttgtttgctgttggatcagtggagtttatggtctttggattgtttcatatccctgcagcaactagcgttggagagctcacagtagtaacaacaagcttagtggcaataatcctttcagctgcttcagcacaagacgagcttccattgtccaccaatgaatgactaatgtaatataccaggaaaaccataacggcataaccactagcttcctttcagcacaagacgagcttccattgccatttgtccaccaatgaacgaccaaccaatgtaataataccaggaaaaccacagaccagaccacataaccacagattagagttcagtccttgaagattgctgaagttcgatgctgatcccacgggatctttcaactgttggcgttacagcctttctttctttggtgcttagcttgggcaacgtacaggtacaggcaccgcccatatttctgcagttctgctctttctgaagcttattgggcgaaagatattgccgtgtcaacattagtgaccactgaccagccaacacaacataagatacttctcaccgagatcaccccaacacacacacacacaactcaaaaacttgaagaaaccggtgccccctccacttttatccgggcttgggaccggcactggcagtgttaggcacccccctacccccaaacataacaccccaacacgtcaagtgaaaaaacaattggagcacctctgactgttaaacagtatgaagttagtgagtataaagaatagatcgagttagctacccatagcccatcatagcatctaccaacatcaaggagagcaaaaacgtcgaataaagcaactatcgtcataatcaaatactagtaattcaccacaagcaacctaggcagaaggagctatatataaccataccgacgaaaataaacaaatgcaaatgcagtttgcattagactaacaatgcaaatgcgcatagaaaaacagactaactaccaccactaggttccggtaattatactagtatatgctagtttgccaaacaggcagataacataaactaagttcaacatctaaggataactggaacgctacgctaataaatttagctaaaaccaaattttcgaatgaaatcgtcttatcattgattaaccgattttctgtgataaaattttagcatccgacaagtggaagtccatactcaatattgccttcaaaggatatacatgaaatacaaagtcagcacaagtgcattttcagaacttaggacattcaacatggttaatactcccaacacataatttaggatattcaacatggttaaataccacaacacatatctcaattattagtgtactatgcaaagaaaaaaattagattgagcatggcgacgttacggagtaaaaattatgttcggattatatattccctaaataaatgttagctcatgtaaacaaactgacagaaggtatatgccaatcaatacacacacaaaagggaagatattataagaacaagttatcattttaataatatttaatttaattacatattcatcatcctgttaaagatcatatcaaaccacgtttgaatggataagttgaaaatattttaaataatatagattcaaaactatgtgcactatattaaatttaattccatatccatcaccctattaagtaacttactaaatcagaactgtagtgcatcaaaggaaatagctgaagaaaacacgacataaatcagaagaaacttggcaaatgatcaagtcataataaaattacattaatgtaagcattttaagtgtatcacattgcaaaaaacattttgaagacatcttctgatatgtactttatgcacaataataggaggtaaatcaacgataaccacacagaatgggcaatgacacacgaaatatgattaaacaaacatgagctggtaaaagaaaactaaatacataattactagctcagcaatttccataaaaaaaacatacaaacactatatctatttgacctcaatctcatgaattactagatcttcacaagtattcgcatagtaacacaacatatattgacatcaaataaataaacatcagaaagcaaccatagaacatggatatgatactttctagcctttggaacagaatgcagatggaaaactaattagcaagaatgaaatgttaatcacgcgaacaaaatttagtaaaaaacaatttttgggaatgaaatcatcttatcgtcatgcaaatgatcatttttactaaattccaaacatctgacaactagaagtccatactgtaacatgaaaaagacaatatttggcagaaagctcatgtaaaatatattctcacacaactgaaatcatctggtgccagtggatttcagaatttaggacatttaacatgattaatacttgtacattccaacacatacaactctaaattagcaccttattatgcaaagcaactaaatttggattgagcgtgtatagcaatcactattaacaacattaaaaatgttaggattagattttcctaaaataactgttactaggtcatgtttacaaactgacggagcatatatagcaacattattaacacagtaaagaaaatgttaggattagattttccctaaataaatcttactaggtcatgcacacaaactgatagaacgtacttacgtacatgccgacacacacataagggtaaggcattaagagaacaagttatcaatttttaataatattcaatttaattgcatgttctaaatcctgttaaagatcatatcaattcaggagtcaggtggtggaaaggataggtttaataagtagctatatagattcaggagtcaggactatgtgcattatatttaattaaatccatcatcttgttaaagtaactacgaagactatcagaacagtactgcatcaaagcttggttagggatcaagtcattatcaaaatgatattaatgtaagcattttaggtgtatatcacacttaaaaccattttaaagtcattttctgatatgtactttaagcactttcaatatgtcgtacgtcactgcactctaataggaagtaaatcaaagaataaccaaaaagcattggcacatgcaatataattaaacaaaattcttgcaggagctaaagtaaaagaaaactctaattaaaccaaattagccgccttatcgccttatttataaaaacgct

SEQ ID NO: 22150 - DNA, 7050 bp, Oryza sativa
ggcgcctccatttctgccgcccccaccgccatagcagccaaagtccccatcgtccgccggcgagactaacccgccggctccctctcctcatcggagtaagaggccgatcgggttcggacgcttgtcccccccctcccccacaccgttcggaagcgtgtagctcggggagccatgaggaatggcgcggaaagtagtggggaggccgagcggcgaacggggaacggtgccggcggcgactgcatctccggtgggagggagcactactcgccggcgggcgtcaccaccacagtccatccatggagcctggacctggacgcggcggggcgccggtgcactcgtggtgtgcgcttgtggtggtggagtcggaggtgcgtcagcgacggcaaatgcggcgccgaggatggtggcggtggccaccaaccctagaatggcgcccgacatggcgatggtggtgactccatcgaatcgagggaggaggtgaagaaggtgatgaaagcggtctcagcgatggaggccgagaacggcatcgaggatgaaatcaaggtagacgtacttaggcgatttccttagtttcttctgtttctttcgcttttcttgaaatcaaaagcgatgtttccttctttcacttcgcgatctccttcgcgagagcgaaagtgctgataacgtgttgaatgtggatagaattgattgagcgagagagattgagagagagaatttaaacacaagaatgtagggaatgaatgagtggatcctttattgataacagtgttacaatatatatgggggagagaggcagcaaccggaggcgcgatggtttgggaaccatcacgtctgttgctagaatcgccgtgaggcgagaagaggtgtggggcatgaccaaccgtcgtgtccctgagttggttgttacactatccatatatatggatgagatcacccaaatatttcagaacactcccccttgatcgaatccagctttgatcattgctcatttagtgttcagatatctgtaaagataatcttagaaataattatagttaaatacatcacgtaaaactcctcaaaaacccagtgggaaaaataaggagagaaccatgatatattattgactatttttagatctctatgagtaaagctcatagtatgatccaaaatagtatagtgtctacagttatcatttagtaaaaacacagtggcgaaaagccaaatgataagacatataagcttatgttgatattacctcgttaaaaactttggatgagaaaacctaaagggtaaaactcatacaaaggaaaaagagtataatatgacgaaaataggttattttccaaaggaagatactccccctgaatcctgcaaatttttaagtcgtctcataccaattccttcgacacatttaaagaatgcggagtatggtagagattttgtgaataaatcagcaagattatcacatgacttagtttgcaagatgtttatctctccatgttgctaaagctcatgaggataaaataatttgggagcaatatgcttagtgatgttgctcttaatataaccagtttccatctgaacaacacaagcggcattattttcatagataatggtaggtgattccaatgaaccaataccacaagaagttatatgtggttaaccattctgcgaagccatacacattcacgtgatgcctcatataatgcaattatttcagaataatttgtggaagtggctactagagtctgtttagaagacttccatgaaatagtagttccaccttgtaaaaatacgaattctgtttgtgatctggcgttgtggggatcagatagatagccagcatcagtatacccaattaaagttgaatcctggttctttttaaagaaaagtccaagatctcttgtgccattaagatatcgaaagacattcttaactccagtccaatggcgtttggtaagagcagcgctgtatcttaccaatagatttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttctaggtatatgcaccttggtgcacaaggattccagaagataaatgctcaagttgtagacctaagcaaaatttggtttgacccaaatccttcatctcaaattccgtctttaaatgatgacgtgcttcattaatatcttgtgtattgccaataatgttgagatcatcgacatataccgagataatacaaaatcctgtggggtctttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttgaaatcaacgccaggtttttgcgtaaaaccttgtgctacaagccttgctttatgtctcaccaccacgttgttttcattccattttcggacgaaaacccatttgtatcccacaggaaagataccacgaggagtaggcattacagccgagaatacatctcttttgtaaagtgaggctaatactgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccttatagactcatcgtgatctcccgaaacaatgtgtctatggtcttccgaattcctagtcttagcattgtgcaccaccgagctaggttgcagactatcatgatctgcttgatatatagtatcaatttggtgtgtaccaactaaaggttggtttgcatttaccgtctttctttgcttattagcaattgtttctcgctgagtggccatacttcctctctttttagtgagtagaagttgagtggttttatttggtacctccactctttttggcgcattctgagcaggaatgaaagatttagtcacacctttataattagtaaatgcatctggcaggttatttgcaagtctttgcaaatgtataattttctgaacttgtagttcaattttagtaatacgtgggtctgaggctggaataccctaggcatcccaatcaatttcctggcattctttcgggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggccatagcagtacgatttgatggtgagatcggtatgtatacagcacatccgaacttacgcaaatgggaaatacttggaggatttccacatactaactgcattggggaagtttcatgatatgcagttggttgtagttggacaaggtcagcagcgtgcagaactgcatgacccccacatgacgaaggtaatttggcaatcatcaataatggtcgagcaataagcttaattcttttgatcaacgattcagccaaaccattttgtgtgtggacatatggaacagagtgctggacctgaattcccaatgccatacaataatcatcgaaagcatgagatgtaaattcggcagcgttgtccatacggattgattgaatcctatgttcagggtaatttgccttcaaccttataatttgagacattagtttggcaaagacatggtttcgtgtcgatagaagacacacatgagaccatctagtagatgcatcaatcaaaaccataaagtacctgaacggtccagatcttggcacaataaggccacagatatctccttgaacgcgttcaagaaatttaagtggttcggctctaattttgagataagatggtctcaaaatcagtttctcagtagcacatgcagtgcatacgtaatcagaggatttgggaaatttatcagtgatcaaatgatgaccaatagagttgccaataatttttctcatcatcccgatactggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttggttggttaagagaagaaattcttctcgattatccatatgggtttcaatgtgaaacccattttgacggatatctctataacttactagggtacgggtcgaatcatgatacaatagagcatactagattgtaaattgagtacccattgggagtgtaataattggtcgtcctgagccaactatctcaggatatcacccaaggacagttaaaactatgccatccttctttccgagagtgggcaagattgtcatctccctaagtatagagtttgtgagcctactggtcacaagacatgattcctctccattcggagcgatatccctatacatggatagtggacgacgaattacttagtgaagaattctttatccacaatatatacatacatacaataatgaaaacataaaatacatagtatgacgtttacatatgttaaaagtacatactctaatgactagcaagtcatacaaccttataatataagggagtttgtacttatctacttattacaaccaatattgtttggcaaacttataggatatcaatataatgtctcaaacacactgagattaaagcagctttatctctaagtgggatgcactgagattacagtaaatctccaagtgggttcgttgagcagtactcgatgagcatgtcatccattgtagaaagtgcagtggtatcttctgggagaagagcgaggttgttctctggttcaataggagcctggtaaaaactttcaacctcaggtctttcttttgtaagattgaagtgagcttcaaatcttagttcctcagaagactttttctcctttagggatttctgatacaggagaaaagatgttgttgggatgcggcaatctttagcaacatgatagtcagatccacacctgttgcaatgcctgttgctattgccactaggttgtggtgccttacccttcccttttcctttccaatcaaccattggatttgcgctgttgttgcatttgcgttttccagtcagattcttagggttattcgaggaatttcccttgaatcctttgagtgcgatactgttggttcagtatcatgtcctctggaaacatagttgatagagttttctctatcttctctgcttccgttggctctttttcgcaaaacttcaacttggagcaaatgttaagaacaacatgattgtattctgccacagtttttaaaatcctgtaggcgtaaatgaatccactcataattagcctcaggccaaatgagttccttttgctgatcataagctttccataggttgagagggctcgtctccaacatgtattcatgtttaagatctttatagatgtagagccttagaagtaaaagggcaatatatagttttctgttctcaactggtagatcccaatcattgggttcctaatttgtatgtgaaatcccactagaagaaaaatttattttgatattggaagcccaaattgggtagttactcccatcgagggcgagttcgtcgaactctatagttgccatgtccctataatcatgataaacattattaatttacagaggtaaattaataaaaagatgatattgtggttgtaatctcaatgcgaaatgtaagacttcatattttgtaatgtttcgaaaaaatgcaggtaatagacctgacaatttgagttagaattcaaaattaggtggcacaatgtggataatctccaagtaattaaacagtgtagtagatctcttaatagtgggcaagttatacttgctgcctaaaacacggtctctaggcaaatatattctggtgaatataccgcagccaatgtttaggactccactaccttgtgctcaaccaaaattccaataatctcattttcaaaacatattctcggaaaaaaacacatgtcggtaatcatcgtgagatgtagacctctgtgagatcggcgagatactcgctgcctaggttacgaccagtgcggccaatttgtagggctccatcgggtaatcatctcaaaatgtagatcacttgttgatgggcgagatactcgctgcctaagttatggtcacgatgaccaaagtataggactccatcgacatgtgattaatttccaagtcaaagtgtgaagtggaacatgcattaaatcatccattaattatgtagtacataattaagagaatttgctaaattaaagtataaaatttataaaattttgtaaattaataaagcaagaaagtagagcatgtcttgaaataatatgcaaaaggcattttattaagacaactaataaatttagtgaaacatggtatttgaaaaaacacctatgttaattaacacataacatcagtagtctataggaccattacataatttgtagaactgatgaactgtttccactaaattaaataaaaatacagggactaatatgaaattgctgctaaaataaaattaaaaactaaaataaaggggtaaaagggtggtgccgaaatcaatttgatttggcccaccaccactacagtgcagccggcccatcaagcccatggggaaaagggcaaaggggggcgtggggggggggtt

SEQ ID NO: 22151 - DNA, 19769 bp, Oryza sativa
ggcgtccggaagccggcgcacggccgggcgaacggcaccggcgtgttttgtgaattttttttatttttggaatgatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatattagcaaaacgattttcaacagatttagctttgccagccaatagagtctagagctactgcccgcagtgtttttgtttccccgcccttggattgctgctaatattttctttttgacaccatcgttgcagataatccgcatggtccaccgcagatccatcatacccgttttatctatcacggtgaggcaggcactgtcatcgggaactaattaaacgcgtagatcgtgttgttacctgttctgctctgtattatactcctactccctcagttgaaattctaatgcgtgatttgacttttgttctgttgattatttcggaaaattactccttggctatataattgcaagggctcaactctgttttaccacaaagttaactgcaattataaatttagcagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaagattatagagatataagccacgaccaccaaatgcagcttcgcagctgaatcagcgaatcgaagtgggaaaatctccttctctgaaatttacaatattagcaagagcactaacctataggaccattacaaaatttgtagaactaatgaactgttttcactaaattacataaaaattcagggactaatataaaattgctgctaaaataaaattaaaaactaaaataaaggggtaaatgggtggtgccgaaatcaataggatttggcccaccaccactacagtgcagccggcccatcaagcccatggggaaaagggcaaaggggggcgtggggggggggttagggttaccctaaccgcccagcagtttgagccgccgccgccgcacatgacgctgccgagacggcgccgcctccttcacctcgtctgccgccgccgtccatttcggcgcctcctccttcaccactttcgctgccgtttccaccgccgcctctctcatctaccgccgattccattttcgccgccaccatctccccctgttacaccaccgccggtgcctccatttctgccgcccccaccgccacagcagccgaagtccccgtcgtccgccggcgagactaagccgacggccccctctcctcatcggagtaagagaccagtcgggttcggacgctgttcccccccccccccactccgttcgggagcgtgcagctcgaggagccacatgaacggcgcggaaagtagcggggaggctgagcggcgaacgggaaacggtgccggcggcgactctatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcaatgtttccttctttcacttcgtgatctccttcacgagagcgaaagtgctaataacgtgttgaatgtggatagaattgattgaacgagagagattgagagagagaatttaacacaagaatgtatcgcgaaagtgctgataacgtgttgaatgtggatagaattgattgaacgagagagattgagagagaatttaacacaagaatgtagagaatgaatgagtggatcctttattgataacagtgttacaatatacagggggagagaggcgacaactggaggcgcgtccgttgctagaatcgccgtgaggcgagaacatgtgtggggcacgaccaaccgttgtgtccctgagttggttgttactctatccatatatatagatgagatcacccaaatatttcataacagtttgacttttgttctgttgattatttcggaaaattactccttggctatataattgcaagggctcaactctgttttaccacaaagttaactgcaattataaatttagaagataattgagcagtatgtacatttaatttgccacttatctcatcgtatccctttgattttactttggtctgccttttctgaacttccatattgtggatcaattaatatacccacatgccacatggtacccataagaggaatacacagaaataaagcctctccccattacctccctcgactctattgtgctctacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttctagggaaccggtttttttacatgggaaacttcaatggtggggaaggattatagagatataagccacgaccaccaaatgcagcttcgcagctgaatcagcgaatcgaagtgagaaaatccccttctctgaaatttacaatcttagcaagagcactaacctcttgaaaaaaaattttagtcggtctctctcatcccattcctacatttttcctacgatccaatcaaacaaccgttcctatgttttttcctatattttgtaatcctctgttttatacttgcattcttatcaaaatcctgtgtgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacagtagcccccgagacctttgcagtcaaccatcgtagccttctcaaagataataatccgagtgctttcaaacctttcatgccaagactgtaaagggcgaaaagataaagaatacggtgcatcgaatagatgcacctaattaggtgtagcccccaactatgtgattagttaacaaactaaacatatagttgagaacaaaataatagcacaatcgtgcatcgcatgacaaaagcatacgcggcgcctaaagaggcattctagccgactgctttttagccataataaaaggaatccgagtggttagcactctaaaaggttcacgaatgaactcacttgacaggcatccgaataaaaaactctaaagattacccaccaaatattataaaaattatggtaatgaataagtctaatagcctaggctatgactatttaccataatgaaaacaggcatataacataccaaggaaatgactatgataaaaacaagtcattctaagttaaccctgacagctttcgtagcctaaaaaagcttacaaaaacggcataacacctttctgtcgggcaccttttaatttgcattgcaataattccaaagaattatatgaccgcgtaaaaaggattttatcagcattgggcaacactattgtgcgcataaattgccaaagcaaaaaaaatgcctaagtccctaaggagcacaatgggccacgctgtttaaagtactgggctgaggtactgttcaggcttaggcccatttgcacctccgatacccttaacaataaatcccaagatccaatcgacgcttcgtcttccccgccggaactctcgccattttccccactccctgctacagtacagagctgcgccggcaaactagggttcaccattccactcaaatccaccttcgaaaagttcatcaaaatccttcctgtgatccaccgcctcaatccctcacttctcccaagccatccctcgaatcaaatcagcgcattcggataaaatcaatggcggaagagaaagaaagctttgaaggccaatgggcgccatccgacgtgacagaggagaacctgaaggagatggtggcgcacggcgttctccctgctaaggagatcatcgggtggcgaccagcgtgcggtgaggcttttccgacccccgatacacacgaggttgtagtcttctcccatttcttctatggcggcttcgctcttccgacctcaaaatttttccgcgggatattaagcttctatggaatcagcttgcatcacctaaatccaaattccatagtccacatcgccaatttcgtccatgtttgtgaagccttcttggggattaagccccacttcgctctgtttcgccgaatcttctttctcaagccccaaccgaacaagagtaagccatgtgtagtcggaggggccggatttcagctgagggggactctgagccaaaagtacttctctatgcccttcaagacttcaaacaaagggtggcacgcaaactggttttatattcagaatcctgagcctgctcttcctgagtattcttgtcttcctccggtgtaccaagatacctggaactctcttccgattggggatgaagcagcccaagccttggaattgatggatcgcatgctaaaactcaaagaacaaggcttacaaggagagcagattactcggcacttcatcaaatgccgattggcaccaattaaagaaagatcccgtacagcttttgagtttgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaatcctcaacccgttaccaaaacataatcttgtcttcatgttgagttatctaaccgtggaggcatctcattcaggaatatgtattgatgaagtctgaccccccaatcactcagcgccggtctcctcgccagcacaccgttcagggaggtggagggccgacaatcagatcagacccacaacctcaaacctccaatccgactgggcagacaggttctcgcaagagaaaactggtgcttaacgacgacgaaggcgacgacggcaacaaatctgggaacaaaggcttgaccaataaactcccaaagcataccactcccaggaaaaactggctagccgtccaatgccaaagattagaacatcttccaggtataaacctctcggtatcatttcacttcggcatgcttctctcatgaaaataatactgaatattgaaagaatattttgcaggaaaccatccgacatagatccaactggaaaagatcctgatccggctgtgacagagccaaattcatccaaggattctgagccaactgccgaaagccagccgactggcgcccatacttcaggtgataaggccgatccgagtgaccaacctccgactggaaactagtcggcagcaactgaaactacaacaactcaagagcccccgactggaaaccagtcggatgtaggtccagatcaagaaactcccgaagttgaagcgcagacgacaacttctcgaggaccagaggctggtaacgactcgatgattgggtctccgaataaagaacaaggatcaccttacgttcagctaggaacatcctcaggtaactcatcttctcaagtgatgccgatttgaataactccagcttattcgtctaatgtcttggaaatacatcagaaccaccaggcgatgaagaagaaattctccgcataaaggcggctgatgactctcgtcctcctatcttactcaaatggtgggacgagaactcacaagctgccggcatcgtcataaatcgtcaaaaagaagatgaggaagtgtgccagctgaagaaagcacttggagaagccactcgcattgtgaatgtaaatcttccgggcgactgcctttgatgactttgttttctctttagcagaactaaaccatgaaccatcatgcagagaatccatcttcgtaatgaggccaagaccgcaactttagaaaagctggttcctcatttgggaactcttgaagcagttagggaccagctacacgaggccaaggagcttgccaagaagacagagaaggaattgagggaccaaattgctcagctccaggattcaaacttcgagctgagaggttcatcaaaaggtaatcttctagatctgtcccattaatttacgctgtcataactgtatcctcaaccatttggatttcaaacagcgcaagccaccaggatggcccaaatggagaaacaaattgaagccttgaaaagagacaaggtagaactggctgcacaaagggactcggccttgaaggagattgaaggtactgccagctaacaatctgaacttctctcttttaaatgcagcaaattcttatcataaatatgttttgtagaccgcaaaatcaaatctcaagctcaatttgacgtcctggttggcaagatcaagaggcttgaaggagcaagagatgaagtcgctagtgtcgctacgccactcgtccaagctatgttcctcaataacagtggtccgagtgcactcgacgcaaccgaaatcttcgacaagctgagagttgctccggatgtatatttcaagaatatcaagaaagctggaagcatgggagctagcatggcattggcgatgaccaaatccttgtacccaaggattgaaattgacgccattgatggctttgctgacgggacaagcgaagaagctgctcttgatcttatcagcaatgctcaaaacgcggctgacaaaattgcaagtgacgttgtagatagattccgcaataccgacctgcagccgagtagtaacaactctgatgatgaaaaaactgaatctgactaagtatgaatgtaacaaatggaggctcaacttgtacaatactagtgtatttatgctgtgtttgataattctagccaagtctttgatttcttaaaagcttttatcaagctttgttgagcctaaaacccaaagaagctattaaaaactttcagtcctcgcagactaagtagaaaaatcaagcaaggcaatgatagaccaagtaagcaaattgaattgataaaaaatcacactccattattatgataatagcccccgactgacaacttcaagaagaacacttgatgttgacagtcaagatagggaagtacaatgataagcttaagcgtagaaacgacgaagatgttcaatgttccaagagttgtcgacgagtgtgccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgactgaatcaaagctgcttcgcggacttcttccaatcggtgcaagtcatccactcggtcctcttcatagcgttcttcgcggaaattacgaaagcgcaaagactcgaattcgacttcactcggcaacattgcttctgcctcatagacaaggaaaaaaggtgactggcctgtggcccgactgggtgtagtacgcaaagaccaaagtactgatggcagctgttccacccatttgccggcataaggttttagccggtcaaaaacacgcgctttaatcccttgaagtatcatgccattggctcgctccacctgtccattgctcatgggatgcgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagctttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgggctggtagatgaatttgtctggcgaaaaattggcaaccttcgcacgtgcgcacaattttgtcggcatcggacactgcagtaggccaaaagaaaccctgccggtaagctttgccgacaatggtgcgtgcggcagcatggtttccgcatatcccagaatgtatgtctttcagcaattgtctcccttcctctaaagatacgcagcgttgcaggatccctgaagggcttttcttgtacaattcagcttcatgcataacataaagtttgctccgccttgaaatccgctcggcttcatctttgtcttgggggagttcttgagaggtcaaaaatcgtatgaggggctctcgccagtcggcttcaatcatagctacgtcatgagtgcccgcaacttgagtagtatctttgtgaggtactgtcggcgcataaaggtgttcaacgaaaacatcagagggcgccacctcgcgcttggatccaaagttggcaagtctgtcggcggcttcattattgtgtcgaagaacgtgactgagctcgagtccatcgaacttgtcttccaatttgcgtacctcctgtcgatatgccatcatattgtcgtcaaggcaggaccactctttcataacttggttgacaaccagctgtgaatcgcctcgaactattagacgctttatccctagggaaattgcaatccgcagtccatgaaggagcgcctcatactcggcgacgttgtgggatgccgaaaaatgtatccaaagcacgtagcttaatctttctccagttggggaaattaaaaccactcctgctccagtgcccgaaagtcgttttgatccgtcaaaatgcatggtccagtgctccatcttctccgcgggggtatcctcctggcactcggtccattcggcgacaaaatcagccaacgcttgggacttgattgaaattcggggcttgaatgatatgtccaaagacatcaactccaaagcccacttagcgatccgcccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcgcgctcaacgaccaagactgtgctcacaacctgggaggtggctgatacatacagcaacaacggctcctgcgggtgtagtgaggctaagattggtggttcggtgaggagtttcttgaaatcttcgaaagccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcttgaaagcgcggatgctcgcgaaggtttcttctagatccgaaatcaaatcatccttttgcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaacgaagtcttcaagcagtcggattcctttagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgaaggacttctttgatgaagcctgccgctaacagcttggttaatttctccttgatcgcgtccttcctgtcttgtgcgaatcggcggagtcgttgtttgataggtttagcatcttctttgacatgtaaggagtgctcaatcacctctctaggaataccgggcatatcagatggtttccacgcaaagatatttttattgttctgaagaaaggtgatgagcgcgctttcctatttacaatctaactcggcgcctattacagcagttttagtagaatcagaaggatctaggggaatctttttagtcttggcttcgctttctccattttttgaaatcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgctcggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcaggctgaacagcattaatctcccgttcggtcaacttttgcttccttttagactcataagccagggggccgccgaaaatatggttgagctccttgcggtggtcttgaaatcctgcctgggtgtcgccgtcgtccttcttcctcgacgtgctttgttcttcatcggagttcttccgtgtagtcttggtgtattgctccgcaaactgcttgtagacgaaacaatctttgggcacgtggttggagttaggatggtgcgggcattgagagttcatgatcttgtcgaacgtgttgacgcgcgaacgctgtcgagaagaatgagtggcggttgcaacaagttcctcaggcttacgcttgcggtccttatggttgttacttccacctcctcccgtagccggcgtacccttgtttggcttccaactgggacccgactgctttgatgcggtgacggcgtcttcagctttggcgtactcgttggctttttcaaacataagcttgactgtcctgggaggcttacgcccgaacttgccgaccaattcttcgtggcgaatccctttggtgaacgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttgaaagttggcgatgaagtggtcgcgtaattcggcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggcaccatcgtacttctctattccagtcggcttaaagccagctggccaatccactcgacgcaggtcgtcggtgaaggctgctactccgtcaaggtcgtcgtcgtggcggtccggcgaatgatgatggcctcgagctgctcggcgctgtatgattgtatcgcgaagatcgacggggcggcgacgaggtggtgagcgaggccgttccactcggcgctccctataatggtcgggaggtgagtgaacggaccgctcgtcgtgacccctgctcctgcgattggatcctgcgccggtggtgctgaggcttggatgacggtagtcatgagatcggaagtgagggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtacggaaaaccggtgtcccttcaacatcttgttggccgatgaaatcacgcgctcggcgccctgcttccaaggctcgctgccgtcgatcctcagcctccttcgcggtccgctcacgctcctgctgctcacgccgtagccgttcttgttcttgtgcttgactctcctcctccagtcggcgacgctcaatttcgcgacgtgcttcggtttcccgggcttggcgttgctcctccgtctcgttatcggccatgaagacgccgaagtagagaggggtgtagttgtcatctaggcttccgtcgaagtcgtcgagatccagatcgttgtagcgagagctaaactcgtcgtagtccacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggaggtgctgtcgcgatggagacggccgctaaatcgtcggggagcttcatcaggattggtgggtaagccccatcatcttgatctggtgacgttggagaagatgtgatctcgcctgagtggtttgaagccgactcgattgagatggtcttgaagtaacttccagccgcgtttgggagtccaaacgggactgaaatccggttctctcccgactggtccgactccgagtcaaggagagagatcttgccgaagttgttggtgacgaagtcgaggctgccgaaccgaaacgtctgcccgggtgggaagacgaggtcgtcgatgccggagacggatcccattgcactgatcggcgaaaagcttgacgcaccccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacactgtgttttttctattcctccgttttttgaaccctgcgatttaaagagatcctaagatgtcacatctgtgcatacaatattacaaaacgatccagacccacaaacatcggattggatagggtcataaggggagggctaatggccgggtgatcgctcgcccatggcaatcgggcacccccccccctccctcccctaacacgcacgtgcctccccgttgctcccttcctactgcaccatgaatttcaaaccattaaaaaagaacaagttagaaaagaataaaatataatataaaaatctagaatccttaaaaatatattcatgtgactttatacttataaatatatacacagtaaacttcgtatgtaaacaaattatgtatagaaatactctatataaaaatatttgaacccaaattcgaatttgagtcgcgtatataaactttgaccaataaattttaggtgtataaacttcagatgtataactttaggtatataaacttaactaaaaagaaaaactatatggtgccaaaaagaaaaggtaagtggtgaaaaaagaactatcgtctggctcgattgattgctaattagcgatctcgggtccatccaccgaacggtccgacacatagatgaattgttccggaacgattctgtaatatctttgtcgggtgattttttgtttggtatttgacgtttttctgttcgttggattgcactatgattcgtgctggaacagtgcgggatgaggatgaggcccgtgtttggacatgcctcgtggtagtcaacgtgactcgatctctgtgcgaaatttttgattttgcgcgccatgtatgtagagtgatttttttctattatatttgatgttttcttagctgtaggatcatacgtcaagattagtgcaaaaaattacagtcctatataactaaaatcgttaataaattcagctgatatgatatgcaagtgtactgtaattttggtaaaaatattatgtatgtaaatatgtatttgttatttcctttaaaatataaaattacagtcctatataactaaaattatatttatttgtaggtttagttgatataacatgtaagtgtacttttagtagatgggttggtgattattttttcaatgtaaagatctaacaaataaaatatatgcaatatatataattaatatatgttgatacatgtgcactcttctaatcaagtgatcaaatgagcctaattcaactatttaaagtcaatatgatttggatccaaaaatatgtcgcgcgatatatagctagtaccgctgaacctatcttattagtcaaaacattttcaacgatgtggatgagaaaagggcagcaatttgttactgatgcggtgatgccgatatgatatttgtccatcttaattgcttataagctgtatatctagaatcatgtgacaccatcgtttcgcttattaaccgaataagcaaaacaacttatttgcaaacagaaaatattttgtaaataaaacttttagggataattgctcatttaaccctattttagaatctaactaccaataaatttctagtttgcttatttaaccatgcttttaaaaaataaagttaccgtttatccctattttcacaacgatgttagggtttcgtttagaaaaagaaaaaaattgtattattttcagattgaccaaaataaccttaagaactcaaccctatccattcacttccaacctcatccactcattccttatctctttcaggtggcacgcaggggagggagggagcggtggtggtggcggcggcgcgggtagagagggagcggcggcggtgcaccgaggaagggagcagcggcgctaggtgttgcgcggagggcggaacggtggcggtggctgctcactgccgctgggcacggaggggggcgcatggagcaggagctcggcggcgcaggtcgaagagggtggtgcagctcgccgctgggcgcggcacagcgcaggagctcgacggcatgggaactcgccatcgctcggtgcaaagggaggggcatggccagcgatgcggtgaggaggcgcatggagagaagacctcgacgactcgacgcaaagcacttgggcgctgctcacggcgcaagaaagggggtggcgtcctccttctccctttgcggcggtggagtagagagggggcggaggtggtcccgcgacgctgtagatctgaccatcggcgtggtggatggaggcggcgagccgtcggtcgtggttgcaggcgatatgcacaccaacgacaacaccatatggggattcgaggagatgtagatgtacttctgcttgtgttgaacatgtattggtgcttttgtttgacatgttttttttgtggacacaaatttgtaccatgtatatttttttgggcaatttaatattcactaattggtttaaattcacaaggccataaatgaaattttcgtctggagttaacactgtcatgttgtcttcacggaatatggttaggcctcatcttcgtttctacgaaagagggtcaaacaagcaaagtcaaaagatcaaggctaaattggtagttagttttaaagtagggtcaaaagcgcaattaccctaaacttttatatacatgttcttagcaatgtaaaagcaaaggctgaaaaataaattacgatgaaaaaaatcctaaaataaactcgaaatttaatattgaaaatttaaattttaacttataagcataagcataagccaaaagttaaggttgatgtacgtcagcagtagcgcgcaactcgttttttcacttatcagcatttctacttaactagctgccttacttcccacgaagccgtataatttcacggaccacgaacgcataaagaaacagaagtcctagactttgatattttgaatcgaccggcaagtgtatatagagccaagaagtcatcttcacaaaggatcagtaaggtggcgtttggatcgagggacttaactttagtccctatatttagacactaatttagagtattaaatatagactacttacaaaactaattatataaataaaagctaattcgtgagacaatttttttaagcctaattaatccataattagagaatgtttactgtagcatcacataggctaattatagattaattaggctcaatagattcgtctctcgaattagtccaagattatggatgggttttattaatagtctacatttaatatttataattaatatctaaacatccgatgtgatagggacttaaaagtttcagttccttctaaacagggtctaaattagcccttgtaagtctataggcccaaacctatcttgaatgctgacagtgacgcgagaggaactatacaactacgatcatgctcgaaagtgctagcgtcatgtcgtagtatatcttaccgtacagcaatctaaacattgacgagtctagaaccacgacgttttttttaaaaaaaaaaagtttctcaaaatgagtctagaaccacgaccaaagaaggtccacatttgttggaattaatatacgggtctttttctgtttaaatattaattatttgaaaagtcacaaaacctcatctccttaggtgatatgcatgcatggagatgtttagtaccacattacctattttagaagagggagatatccttataaggaaggacgctctcctaggcacttgagccatatgtggtggagagaacaagactaacatgcacgtgctcgctcacttggtcaaccaggccaggctatatacgttgtgtggagatcgtgcaggcgtcctgataggttgttgggaaattcggttgcctcctcctcacaacacacgcgaaaagcaatttaggatttgcctcctcctctatactggctaatccaggttgttggaaaatttgtttttggaaacgtagtttttgaaaacacatcaaataatctagtgcgtggagcggcatggtgtccggataagttatgcgcaacttatcaggttcggttacgtgatgtggagatcgtgcacatgtcgtaatatctttatataaaccgagtcaccgcctccttacaacacacgcgaaaagcaatataggatttgcctcctcttctgtactgtattgtcgctcgtagtctattctgtcccgatcgctagcgtgcaccgactatcgggagagtagatttccggaacattcgtcttcgatgccctgcatcgagagaaggcggtaataaggattctaggaagtgcttcgcgtgactgcttgctgttcgtccaccacgggtcgtcttactcttcattcgtatgctacgtgccatcgtcaacatctgctaccgcgagttcttcatgcggtgtttgctgctcctcatcaacccgctccacagcagaaccagagtcctcgatacgtgttcaccatgtttcatctatttgatcagttcatgatttactgtctagtttacatgtttagatttcatgatgtggttctgctagtatacatgttcaatgtctttatttattgatggaataatttaaatctacatgtgcgtgcttatatattcaacacatttctcaacagctaacacaaatacgaacttggtggcttcttttcaattacttgatgaagacaatagattatagttcttgacgagacattcaacattgtagttgaaatattttttcctttgagatcgtttaggagtcaaatatttgttacaagctcccagatctgttttgaaaaaagaaacaaagtttttaagtttccaaatgatctcggatagaaatatgttct

SEQ ID NO: 22152 - DNA, 9346 bp, Oryza sativa
atcaaataaatattttataaaaaaaatgttttgaggtttaaaatcatttgtgaataacaagtcttgggcgtcacattggacaaagtgaaaggtatacccaacgtagccgcaagcagcagagccacctaaatcggacggtgtagatggcacccaatattttcccccaaatcggacacccggcatggaattctttccggattaatgcaaatgtgatgatgtctgcagtgacaaaaccactgcttaatttttttcacaggtcataacctttttcatttcatatgcaaccccgaaataaaaaccatcattaaaaatggccgtggccatctcagaatcataaatcgcatgtaaaaaaattacatatgggtaaaaaaacacgtgtaaaaatacgtctatcttcatggacagttttcctaagaaaccatctgtgaagatcatgatttctatatagacggttgtcttaatgaaggcccgtaaaaattgatttttgaggatggttctcttataaccgcctttggaaacatgggaaatattatttaaaaaacattcataactccactatatgaagttggatgatgaaaaattttatctgagagaattgtagctaccgatgagatctacaacttttttgttgaacaaatttacattagtttagggtccaaaaattaattcgttacaagatctcatatctatttttaaaaataaaattttgagtttctcaattgaccccagcgggacccttgttacatatggagtcttctgacagaagatctcagattgtttaggtgactatataatttttacattgtctgagatatattttacgaatggttcttttatgaagtcaaaactttaaaaattatagaaaaatcattttaagtccaattgtggtaaaacaaagttctttgactaacatcaactttcgtaacatatcactcttataaagacttcatgacataagtaaacaatcatactaattaaagaaacagtttaagaaatatagactcgatcatatttaagaaaatactgtaaggattatagggaactttgtttcaactcaatcagacttaaaattgaattttctataacgtttgaaaattagacattttcaaaataataagagaaaaatgttttttttccgtatggacttctttaagggatctccctttaaataatttttataggcggctctcataaggaaaggcctgtaaaaatatgttttataggtggttctatcataaaactgcccttaaaaggggaggagagcactactaaaatatgacttttcataacatatgaagtatgatggtgacaatctttctatgagaatctaattgtactgactgcggactgtggagttgtggactccctccaacaaatagttgtttataatctgaatctcaaatatttctaaatatatctaaatatttcagatattatttctctacattgtgtattatttcaatactatttatttctttattttcaaaccgaattttacattgtattttttttgcatgtagtattatttaaaaaatatttatttattataaatccaatatttttcaaatatctaaatcgtatttcaacatggactcttctctaaaaactatttattttttaatctgaaatttacatatttctgaattttatttttctacatggactattcttttcatattatttttaatttcgatttcaaataattctaattcatctttctacttggactcttttattataatattttttattcagaattttagactttaagttatatttctacatgagcttttttttctgtttaatttgagaatttctatgccatgatagagaatgtggtggcttatttttctattaatttattaagataatagactataatcctcaacgagatctttaactttctagttgaaagttttgtttttcatttgagatcgtttagggtcccaatattcgttacaagctatcatatctatttataataacatttttttagttttactaatgacctttggatggagacatcttctatatgaaagttaaagagctgggagcaatctaaaagtttgtcttcaaaatttgtaacatgaattttgtcacttttttttgcagttactctgcgtggtaaccatgctaccgttagggttggtaaatcctctcgaattcctaatacttaacatgcaaagataccacatcatcatccactaacacttatcatatttaagcatcatgtaagcatgctatattatctataatttaatagtttattaaattttagagaactaaaatgtaagcatgccaaatcatccaacataattcacgtaatatttcaatatatctctccatcatttgcctatatatatttcatcctcacctagttcatgttatttttgttttctctcgttaagtcatatctcatcaattgtttatagtcctaagatgattaatctatggttcaaattatctctcttattttcttatctcattaagccatatcatctcaatttgttcaccccttagatgtatgatctaaattatcttcttcttttggtctctcataaaaaccacatcatcttacttttacatgaaccatcattctaatactatttaaatttaaatcacatcaatttatataacttatgtgtatgtaagcttatgttgtttaagctatcttacacattatttttactagaaaaatgtctgtgcattgcaacgggtgacgactattttgatcttattattgttatacggtttaattaagataaaatttactgtgtaattcgcttaaaatcatgagttgtaattagagtccgatcatctcaagttagcatgtgagttttttttaaaatgatttcttatacgactcttatgtacttatgtatttgcagaagcaaacgaacttaataaacgactcaaatacggatatgtattttcaaaagtgaacgaacttgaaaccgactcatacacagataatataccaaagcattggcaaaaatatcttcaatttttataatagtagagatttattcttatcattgtaaactcctgtagtaacgcgcggagtttcatgtagttaatagcatgctaagaacggatgagagaaaacaaaatatttatacttgcgcgctgggaattgactggcaagtgtataaggatgaagtcttcttcagtttggtcggtgagtcgtcccttgtgagtctacaggtccaaaacctatgtcaaatgcagacagtttagcagctcgaccaaagcaaaactctgctactgcgattatgacgctcgaaggcaccagcgccaggcccaaatatatatttcttttttttaaaaaaaattggctaaaacttatcatatagcactctaaatattgacgtgtctaggactactcccgtcccataataaagtaagtcacaaataaaataaataataattctaatatttttttaaataggacgaataattaaacagtgtagaaaaaaaaatcaaaatcgttaatattatgggacggagggagtacaacaaaagaacgccattcccagggactgatacaaatttcgacgaataagaatcacatcacacatacaatatctgcaggatttgtcggtgagtcagaaacaggaggtcggaacagaatgttgcaagcttacaaaagtactcgatccgtatcatctttgcattacactcacaccctagcgtacaccaaacggctaaggccttgtttagttcacacataaaaaatttataccatatcacgtttgaacacctgcataaagtatttaatataggttaaaaaataactaattgcacatattgcggataatttacgggacgaatcttttaagcctaattgctccatgatttcacactgtggtactacagtaaatatttgctaatggtagattaattaggcttataaattcatctcacggtttactgtcggattctataattagtttttttattagtgcccgaacaccctatacaatactcggtgtgacacgctaaaactttacacccctggatctaaacaccccctaaacatagcacttagaaagtgaataaatgttacgtgtaccagccggcattggggagagggcacttgatttggatagaagagtgatcaaattatcttttttttgagagaaagaaatttaccaaattatcaaagccgtgagaagcatcaacttttccgatacgcgaaggcacagtgccatgtcttggtatatcttatcgttttgcaatctagacattgacgcgtcaagagaacaaccaccgaagaaccggttcgtatttttcaacaactaatgcgaatatatatggataattagcacatcacacttatagccagcgtacaaattgtcggactcagaatgaggttggaacagaaggttgtaacttgcaacccgtacaaaagtgtcagctttacatttacgcgtgccccagcgtacagcaaacggctagagataagaactttgaaagagaatacatatagattaaagttataaattgtccaagctgcaaggaacatcaatttttgtgatgcacaaaggcactggtggcttgtcaaagtatacgtaccttgccgtatcggaattaatctagacattgacacatcacgaactatgactgaagaacgcgtccgcatttctcatcagctgctgcaaatattgatagagaggaatcacacatcagacatacaacctctaatggatttgtcggatagtcagaacaagaggtcaaaacagttgcaaccttacagaagtgtcaaattcacaatgttgcaacctcacaaaagtgtcctctttacattactcataccacaatgtacaccaaacagctagagataagcacttcgtatttggactactcagtagccggtggaggactcgatgtggttaaaagtgatcaaattgttaaagctgcaaggatgactccctacaggcatgagaaacttgcaaggaatgtatcatgatactcttccaggcaaagcaagtgacaccaaagattctcctagcggagataagaggaggctcttggagagggaatattggagcattgcctcttcttttaatttattttgatcatagaaactttctaaatttaagagagggaatatggactcgattatatggactgagtaggtctaaagggaaatttaatatcctctcactcctacgcactacccttcagcactatccactcgaactaccccgatgcaggattttaggaatcgaggtacgatgttaaaagtaactacttcatttcatattaaataagtcactttggttctgtcctaagtcaaacctattcaaatttgatcatgtttatagaaaaatatagaaatatctacaataacaaattagtctcattaaatttatttactatgtcaaactggaagatgtttgactaagcacaaatccaaagtgacttataatatgaaagaaagcgagtattgctcaataaaaatgatgcaggcctgtgtaagaagaactaatatgaacatagctgaaagtaaagtgaatatggtgtacaataaattactaaactataaagtactcaattgaaattcctttctgaaaaagggacattatgtatttaccatgaatatgtagaaaaaagtcattttcaaataatgtaatcaataaattgttcaagtattattatgttcatgatatttcttcatttatttcaaataaaaatcaattgcaatatttaggacaatgtccgtttgcaaaaatcaatttctatagacggtccttctaataggaccacctgcgaaaataatgatcgccagcgaaaataatgaaaatagttattttcgcaagcggtcctgttaggaggcttgcctggcaccaggccagcggttggcctgtccccactccctcttcttttatctcctctcttatctacttaaaaaatctcctcacccccctttcctcctcccttctatcctctcatcacccctcctccagtgccccctttttcatcccttcctccactgcccgtagtctccaggaatgacgtcgcgacgacagtggtgatgggagcggcggtggctagggcgatgacagcgggtggatccaatgccatcagacgagcaacgacgacgatggctcatcctccgctccctctccctctctcttactctctcctcctctcatcatccccttcctctcctactgtacaagccggcaaaggcacgcgaggaggttggtagattgcagcgacgatagcgaggggtccagcggcacgggaggaagccggcaaaggaggcacgcatccacggcggcagcggcgtgcttcgacaacatcacctcctcagggcatctctgccacctcgggagcagtaggccccgtcagggatccggcgttgccggccttctcccttgtggattcggcggcagcggccttcttcctcacggatctggcgctgccggccttctccctcacggatctgggggcgacagcctcacgaggggtggatctaccaccattggcctccctcgtaggtctggtgacgaaaacgagagcggcaagccacctagcagcggatccagctgccccggtccagggaggggcagatcctcaaccgccgtcctcgggtgtagcggggtctcaacgacaaccattgcagctaaggcagatttgagctagggttttgacattttctttttctttttttgcaattatcatttttgcatgcggactgcattactgaccgcatgctaaagttacttttcgcatgtagttgtgtttctcattacgaaaattactgattttgattgagaaatatatcaacttgttagcaaaactgaacttttttggtatatagaaaaaatgcctgtgcgttccaatgggtaaactaaaattataacaaatataaatatattagatgagtagggtttaggttttcatgatatgaactctttaagaaaatatattcctaaagatagaaagaaagttctcataaactgcaagggcattatcgtgcgcaatgaatgaagtgcatgcagcccaagagtgctttggcccggcgatggaggcctgctcaacgctggatcggtatgagccattcgttttaacggacgacttggatcggttcagaataagtcgaaaccgacggtgcccaaaaaccctaaccctagtttcacatcttcccctcccctcccatcaccgccggccacctgtccccaccggtggtgcctctccccctcaactcccctatccccataggcatcaccactccctttcggcgctccccatcccccttccctcccctcaccccactatcgactcatttcctcctcgttggggtgctaccgacaccccgctcctcactagatctggtctgaggctcatcaggtctggccttgggaggcggcgacgggcggcaatggcacggctcaatcgagccaccatcggcagccactctgtgccccctccttgctggatctggccttgggaggcggtggtggcagctcgaaggcagcagcggcgacttaagctcgacgatggcaaactcatgccgctcgtgtctccggcgtccggcgaggttcgatggcttgaatttttgttcgatttgggtattttcttcaattgtcattcttcaatcactacaaaaaaccgtattttctttgccggtcaaaaaccaccaagtttaattattccgtcggccgaccgccaactctagaaagctaggaatgttacaatttcttggcgcttaaccgtaaggaaatgccttctgggcggtcgaaccgccaagcaaattaagaagattgcccactttcgaaagcgccaagaaaagtaaccttgtcggtttggaccgacaagaatatacctttacttggcaacaatgaaactttctagacttggcggccaagagaagtaaccttttcggtcataatcgcaaagaatatgtacaaacttggcagccgttttttggccaccaaagaaatcacttcgccaccaagaaaattgcggattcttgtagtgaattcttgtatttgggatttaattcgaggaaattttgtgaccaattttcgtatgttgttctcctggtgtaacacgaactagtttaaattttgtgttatttaatgcggactctggataatttttacccgcgttggactcaggatgttacgaaaaaaaaaggtgaggatggacggaaattttcaccagaattcttgcgtatctttttatacgggtataggtttctaaagacaagaactatttattgtcaaagaacatatttacttagatgggtttttttgtgttacatactgcttaaatgcaagatcaaattcaatctaacatgaagtaaaatatatattttgcaataatttatgtgtcaaattgaacatttgatgggaaattaaattgtaacctttaaaaacttttatttctatttaattagaccgcgttcatgcaataacgttaatttgggactagattagtatcctcaatcctcagtagcgaccaggcaaaatgaggacgcagtctatcgagacggtgacactccaggttgaggttctataaaaccgacaagcagcctagagaagaagaggacaatgagcaagtgagcaactggctaggttacctggttagctagtaacaactcaaacattgtaagcgcatagaggagtctggtgctctactcaactctgaaacaatcaactgcaccagtgtactaattaaatatattactgtacttaagacatggctatcgcgtcgtcgtcgttttcacttgctgctatcctcctcatcatcatcatgtactgctgccccacgggtttggtggaggcagctcgcaaggggccggctgctgccggcggcggcgacgacagcgcgatgagggagaggtacgagaagtgggcggcggaccatgggcgcacgtacaaggactccctggagaaggcgcggcgattcgaggtattcaggaccaacgccctgttcatcgattcgtttaatgctgcaggaggcaagaagagcccccggctgacgaccaacaagttcggcgacctgacaaacgaagagttcgcggagtactacggtaggccgtttagcacgcctgtaattggaggtagtggcttcatgtacgggaacgtgaggacctcagacgtgccagccaacataaactggagggatagaggcgctgtcacccaagtcaagaaccaaaaggattgtggtgagctttaattattcagttcattcattcctttctttttttatatatatatgtatatcctctttttcctcctgtgtcatctcttaattaaactcaagtaactcgtaaaactaatcataataaaattaatgatcggaaaaattgcttacggatcaccagtagtac

SEQ ID NO: 22153 - DNA, 1165 bp, Oryza sativa
cctgtgtccgtggcactcgacggcgtgggcaaggtgtcccagttcttcagcagcggagtgtttggcgcgatgcaaaatgacacgtgcaccactgacctcaaccatgccatgacgtcggtggggtaaggcaccgacgagtacggcaccaagtactggctaataaagaactcgtggggaaccgactggggcaagggaaggatatatgaagatcgcgcgggatgtcgcgtccaacaccggcctttgcggcctcgccatgcaaccctcttaccccgttgcctaataaactaaagagacataaattgagccgataaccgtgttagcgtctggtgaaaaagtagtacggcgtggtgtaatatgcgattcatgtgataaattattatcagtgtttgttatattttactatgccgttttcatgacagtattacttttagaaagtacatatatgtgtgcctgtaaaaaaatactttgatgacaataagtcactactccggacaaaagttttttggacgcccggcacttttggttccaggcagaacataactcgaagtgcacagaaaaaatgaggggacaggcgccggactatcgcccgcacgaaaaaatgcattttcccgtgcggggcgtcctaacccgaccgcacaggataatccttattatcccgtgcagtcgactttatagaaccgcacgaaaaaatcaattttcgcgtgcggactttttaagtgacccgtacggaaaaatactctctctcttctctctcacccatttcaaattttttacacactctccctcttcttttttattctctctccccatttagtctcctagatctcctcccctcccctctcctctttcttcctctttttctcatcctcacccctctctctctatggctgtatttagatccagagtttggatccaaacttcagttttttttcatcacatcaacctgtcatacacacacaacttttcagtcacatcatctccaatttcaaccaaaatccaaacttcgcgctgaactaaacacagctatttctctctgcgcgcacgcagcatctttacttcacatctttcctttcacaagaagcatcagccgcatcttctccatttctttttctcctctgcttttgaatgaactcgagaagcatcagccgcatctctactacccttg

SEQ ID NO: 22154 - DNA, 552 bp, Oryza sativa
tacttcaaatgtgtatccgtatacttcaaaaactttgcacccaaagaactaaacacacccttcgacaatttggtcactttcatccacacagtgtcctcgctctctcgaatactggtcaagtaccatgtattttctttccaagtgatatttgtatccgtttggtgtacgctagggtatggctgtaatgaaaagatgatacttttgtatgtttgcaacattattctgttccgacctcttgtttttgactcaatgacaaatcccacggatgttgtatgtgtgatgtgatattcttattcgtcaatatttgtatcagttgtttggaaacttggacgttctttggttgtagttctacacacgtgtttagattactatatacggtaagatatattaggacatggcgttggtgccttcgagcatcataatcgcagtagcaaagttttgcttccgttgagctgttaatttgtctgcattcgagataggtttggacctgtacgcttacaacggatgactgatcatataccctactgaagaagacttcttggctatatacac

SEQ ID NO: 22155 - DNA, 650 bp, Oryza sativa
tatatctcctatgaaatatgttttggcaacattgaatttattcgtaaataacagattttaaaaatggtagaacatattgcacttttgtacaatgcatgcaaacaattgactgctgccgctttcacttcacgctccagaaaataattccttctaatcatactgcttgtaaacacttccttcgtaacaaaataactagttggtgaagagggcgcaaagtacagcacagagataaatgaattaccgaaatcgcagtcacattgacataaaaatcaatcagtgttgccaccaaccacctacacagagaaaaattacaacttcaagttaaggcgcttttggacaatagttctgacctccctactctgatgcaacacatagttcattcgttaagaacatacaaactctctcaaagccttgggcacaaactacaaacctagaggtctagagcataattggtgcacttaattatccaaagttgcatccatcgagaactacctatacttcctgtctttctgcagcaccattgtgcaggtcacagacaataacattggaataatacttaaaatagtactagtgactcccaacatttgctaatcattacgcctaaatttaaacaaaaatccaaagccttgcatgcctgcaggtcgactcta

SEQ ID NO: 22156 - DNA, 9018 bp, Oryza sativa
tgttatcttttcagtattgctacatgtgcttatgttgttgtgaagctttttgaaataaaaactttcggacctttacaagacccacttgatcttttattcctcaggtacagattcaaatttttcctagcgtatgcaggatgaaaagattttagtttgatgcttttgacagcataatttggcaaatcaagtaaaaaaaagttttttttttacatgctgatattgaaaacagaaatggatttggcaattttgttctttttctgggctgggggcactgatggtctggtggacatggactataagaagcttatattggttcatggttacgctatgttctctttcaactttggggggacctgtgaaatgtgttatcctgtagatttcaacacctacaacaagaaacttttgctttcacagtttttgcatcttttgggtctagatccctcatatgttgagtaatatacctaacactccaaattccatagttccatagtgcatgctctcaccaatgtggtgaccttgtgtcacattctggatgtctaaggaatattgttgttcatatatcaattgttattcttatcttctgtgttttgaggtgtttctcaacttcttttcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtaagtgaaccatatttgctcagattatttaagaaaccttattttctttaagtacattctaagtccagttgaatgcagcaagcaaaatggataaatcccagtgattgaatgaaagatcacagaggcatagattgataatacagctaaaggaaattttgaaaataatatatttaataagcaagacaaatgtgtatttacaagtgctataagcaccctatgctgaatttacattcaagagttaaactagtaactgtcttgttaggagcacttagcacttaccatagttgtgtacaggcaaggagaacattttacttgtgttctggccttatcttctaaaaatttgactgcaaatagtcataaaaaattctgaaataacttagcagtatagatcattatctataaaaacaatgtgtaaaaattcaactgcaaatgtggcttgtattgggagaaacaaaaaaacaaatatcagtgaatagtagctttccctttttctttttgccattccactttccgttgaatttttcctttctatttcttcatgtccacatcaaatttagatttgaaattttctatcatgatagttgatagatttattttgtatcaccactaccaaattatttgagaaattttcatgactattttcaccataagagtaggaagcacaggaagtccatgcagagttaaaaaaagaattttggaggccagccctaagtaatgctctggaagtacattttcgattagtatagtgttgtatatgttttcacatgatttgttaaatttatcagtacatgcttcaaacatgctaactctgtagatgttgtctggcactttttattttcttttttccttattatacttgtgttatcaattagaaaaatatcaaatttaatattttcctttgcattcaggtggatggcggcaaccttaattgacttctatataaatgtcttcgcaatatcggtaaattacattctttggtttttagaaattgttccaagtaattttgtgcgacacactagtttgcctgcatgaatgcatctgcatcttggaaattgttgttcatatttttgtgcaaacggtgggaaacgatttttatttgctaaaactacttttgcatgactctattgttatttggaacagttgtcttaagctcagctctaatcatgccatggcacccacagttttctgctaatagttttttggtatttgttatgaaaatatattccattaaaatctacaacacattaatccttatgtccagtatattttatcatttttttctttcctctttgaaaatatgtgaagataatcttattttttaaaaataaaaacataagcgctaattagcaatgctagcacaacctcccacctactgaaaaggtgtttccatgaagtaattaatacgtcctgcaactataaaatggcagggcactgctggctggtagagtggtagcgtcctaggcactgcatgtagtggctatatcttctatcagtaaattaaaaagaaaaccatcatagtggctatatcttctatcagtaaatttttggtgatatgtctgcaggtatgggttgctcacaaggagtcaaactggatatctactgccatctggatatgcttgttaatatgctttggaaggtacacaattttttgttgaggattataaaggaaacatctcattggatatctactgccatctgggttgctttcgaaggattatattgctacattgcattggggttatatttgtccttgtgacttggattttactgcatgaactttgtagaatattttttgtttgcacttcttaatcataaggtgcaactagtagttactgccacctatcaaatactgtagataaaatattctacagattttggcaacaaattagtcaaattcccaagtatagataatatacaaaaattataccaatagattgacatttcaaagtgcgttcatacaatataagtttgataactactgatatatattttttgagaaatcaattatcgaagtttaatcttgaagacttttaaatcaagtatgccttataaaaatcaatgaaggttgtgccatgttagctgtatgatgcatacatttttcctgccacttgtattttctagtgcttctccttatgagtagtgtctagattatgtttatttgtatatgggaggcactttcctgctcaagaatagttagtcacgtaatatgaacatctatagtaaattcatcagtgagttatgcgcatcatgatgtatttatttgtaaggaacttattgaccctttccactttttttcatttgatctagcatcacgacatgtggctacattgtcatacaacttttccaagtgtcgtaccgagacccaatctatcatgtgctattgaactctcataacaagtatggcattgttccctcccactaatccctgatcttctccaagccttgttagcttgtggttgtctaaactttgcttgacatatggtcatttatctggtatttatatgtctgaaatgtaggaagatttgaaaatatcattgaagagttatgttattcttggtatacaataatattacctcaataaatggtgtatcgtctagacaaatagggaattctcggtgtaattacatatcattctcagtgtaatgacataactttggcaatttctctacaaaaggaccagactatatgcagtttgcagctcctttatctgtcgtgttttttaattaaccctttatttgtatatctgatttagtcgatttgcaaaagttttcttcattgtagttgttatcaaaattgtaaggtcatgtaacacaaagggttactaaagtgaagtaaagaaaatgtgactgtcttgtttaactgggaaattatttgaattgccaaataagtttgcagtcttgctgaaatcgggctcgcaagactcttttgatttgatacatctctatcttgagtgtgtgaaggagcctcaacgcagagcagggaagacttccaagcattataccccctagctctgccaaagtatgaagaatatgtaagccatcttttgccagttcttttgcagacagaattccaatatgcagggattcagatcattctcattttgttctttctgttggagttagaaaaatctttgcttcggcatacctctcaaatataatagctttgaattctggacccctggaaccaattcttggtcacactgtcaatattttaacaaggttttcgatgcgtaacacttgtaaaacttacattctgtagaaagctttgagatgccctattgtggatgtatcctggaggtgaatagcttcacggcaggttaccagaagcaaaccatgcttgccgtatgcgtgctgggccaatccatagtttcaactgatgcattcattcatgcgtgacaaagctcagcgtgatgtgctcgtgaaaagattttaggttgtttaaaatgcaaaaataacaaatatacctagttgaaagtaattaactagtgctccaaaatacaaaaataacgaatatatcagtagaaaccacatctcgccatcgtcttctcctgcttaaggcgcctgcgcgtgtcctgtcctcttaatcaagacgagaaagcgaaagcaaaaccaaattcgtaatcttagactacaaccagcctcaccagctgagctcaccatgaaatcacaccattgcttcctttcatctgtatctatccagcagccatgatgtcggatcgagtttggcctagacgatggcaagctaaagaacctcctctgggtagctcgagcgcacaccgccgctctcttccgctgccaagcccacaccaacaacatatctcgatcccattctccgttctcctgacttctcatcgcaacaactcgctggagcctatcatgaaagaagggaacgagaagatcgaattgatggctgggaagtgggaaccaatggatgagaaggataagaaaaacaatttggtagtagaacccaccaacggtcagtgattgaggaatgaaaaaagtattactccttcccaccgaaagtatgattctagatttaaattttatctcaaaataaatgtaattctaccatactatttgtaatatcaatcatatatactagccacccagtcacgcttcgcatgactctgagcgccggcataacttgtgtataggagttgacgacggatcttgataattacgggataatttttgtgagactattatctctattttttaaatataaggatttccatattgtttaacaaagattatgtttaatcatataaaatttttatatccctttacggaggaatgataggagttgagaaaatagttaagagtaagataaaataaattgaatgggaggtgagattgaagataaatccttatattttttaataaattttaaacatttgtgatgcttatatttgcagttagagagtctacctttatgtttttttgaagggattagggagagggcaataaaattaaatgggagggttgtgttttatttttgtttctgatagaaagtatatgaagaaattaaatagaaaatggttgtagttggttgagatgatggaatagaagtaggataagttttatatattaaaagtagctatatttttagatgaagggagtaatataattggcactatggtggatggatttctgtagttgtgggtcaatgaggcgagctgctgctgctctccatctatactaaactatctgtatatgcaccgatcgatgcacaggacctattcatctggaactctccctatgtgtgattggtatacacacaaatggatccaacggtccaattttgttcctactctcatcctaaggctattattattcacatgacgtggcttattagtttatgagaaagctggttgctttcacatatgtagatactagacaatcatactttaatggatctttgtaataatgtgccataggtcattgagcaaaagctgaaattttattttattatctaaaaaatcaatcacatattattcaaatttctcttaatcttatactctatcctccctctgctaaaatgagagagtacttgatcatattaaataaaagatattactactcataaaataattctttgttatcgcccaagagttctcccataaatttcctatattttcaaatcctgcaatcttattttaatcccaaaattttctactaatgtatctttttttttcaatcctataatccaaatatgtttttttccctcttctatctccatttattattaacatgtgtatgaatcgcaatataatcatttagtagtaatttatgattaaagtgagacgttgtaatcaacaataacagttattcgagaatggagtagtatttagctgctgtgaagagcccttgtgtgagagagttgtttttaaaagatcaaccttaaatatctcatagcattcaactacgattttttccctatccattttcgttttacgtgttttcttaattcaaaatacggccgcccctgttaattcgttcgatttttgagagatgacaaaatttattcacgcaagcattaatttggatgtaaatagattttacccgttgcaacaaacggatatttttctagtttagtccaaagtaaacagtttagataaaagatgatcaaaagtaaaactttaataataaaagatccaaagtacattcacactatatatttgcaacactaggcaacccacacgtcacggcctcagggcaagttttatgaaataggtggatcttgcatctaatcttgaccacatcatcaactaataaatgtagaggtaacatgtacaatactcacatctacactaattctaatatactagccccaatgtttgtttgtccaatctactcttcccctctttccttttgtcttgaattttgtgtagcggttatctcttgcatgagaggtggctgcttatctctctcatctcttctctcctccacttcactattttaacttatgtgacatctaggagattgtgcttggatgcccatagtacgtgccctcagggcagtcccaacccataacactagacatggtttctataaactccacgtcatcaagaaactagtactagacactattcttccaatgcaaacaccactattccatactccaatttaatgctacttatctcacatgatgtcttggatgttatgtaggaaccatgtctcatacaagacatggtttccttctctttcctcatttattcacttgccacatcattttttgtcttaagtggcaacttatttaatgctatggataccatcctagttattgggttgggaatgccctcacaaactcacagtaaataccggccttcattaatttttttcacaccggctagtctattcgaaccatcaagcgcaagcacattatctaacaaaaagctgcaaggagtagattggtatcttcatccgtgcaatttcattgttagtttgttggcttgtggcccatcacttttcaccatgaaacagccggtgcatggcatagttaactattattctctctaaaaaaataaaaaaaaaacttcttaaaacgaatctggagattatatacaattactcagctcgagaaaagctcaaagcttgaacgttctgagcccaaaataaagcttgagatctggtgaggctcgactcgagcttggctcattgacagctcaaatataggcaactatcaatctaattcgcaatactagtatcttcaaccctcaattattaaaactagtgcaaaataaccccttggtggttttaaggatgttcttttgctgacgtggcttgttaacttaatctaacctttgagtcatcatgttggacccacatgtcatcctccctctccttcccttctcactactttcctctccctcctctctttccccttctccacagaagcaagaaagtgggaggacgaggagagcgggagcggtgacggcggtggcgggaggacgaggagagcgcacgctgcccgcgagtgctaggagcacgttggagaggtcctcaaccagccgccggatactgacaaactagagaggtccttgaccggccgctggcaaccaaatctggaggtcaccacctcccatcgcccttcacccgccgtcctcaccactgcagcagccgtaggcgccgtcgcacgtcgctgccgccagcgctagggcagaaggggccgagaaccatcacccttcacccattgtctgcaccgcctcagtagccgcaagtgacgcccccgccgtcgggccctcgccgttggacgccgccgctccacgtcatcatcgttagccactgtgtgccgagaagaaaggaggagagagagagggagagagggggagaggttagtagaggaaggggatgacaagtaggaccaacttatttttttaatttatttgatgactagggtgtcacgtggataccacattagcgaaaaccgcttttaaaacaaccaaggtagttgttttaaacggttttaatagttggggaagtcattatatctggtcttgtggtttaggatatgaattagattcgatctttatttaagggagtcaaattggacttttttttacgtaggcgcatatgttatacttgtatgttaatggaccggtataagtccacctgccgtccctcaactttacatgagtttgattgacctttttaatttcaaataccataaatctttacctttagactgtataaaactgtgcaatatgtcccattttcactgtttttacttacgtgccaggtgtctgggccggtgggcccacttatcagcatcatcatgtgagttccgtgcttcggtgcttgtgcccgttggtgtgccagagcccgagtcggtggcacagggggtcacgggttgaacggcaacctgccgccgccgtcggtgaacgtggctcatctgagccagatgttcgatcggcgccaagcagggggtcacccaggcggagatggtggcgctgtcgggctcgcacaccatcggccggtgtgtcgccctccagctccttcagcaaccggctctagtagtcgtccggccccaacgccgggcaggaccccagctacgtggcagcgctggcgacgcagtggcgcagtgcccgcagcaggagaaggccgggagctggtgcccatggactggacgccgtcacgcccaataccttcgacaccaactaccatgccgccatcgtcgccaactggggattgccaatagtcccgactcgttccagaccgacttcgcggccgacaacgtcaagatgggctccatcggcgtgctc

SEQ ID NO: 22157 - DNA, 6994 bp, Oryza sativa
tgggatccaagttaaggagaacttgtacactatgcatattattgtaccggaaaggtacgcaattaacgtgccgtccaatgatagttagggcggcatggaaattgttcacgtgaggtccatttttttggcccgaggccggtactaggagggcctggcactccattactatgcttctgcttctgcgtgaaagggaggaccaattctcgcgccgccgccgccgcggagacggacacatcttagacggcccccgcgctccaccaggggggtagtttcccccaggtttgcttcactgtctcctctgcggcgtcgtttgttccatcgggcgattcgcgtcgtccgcgggttttgctctctcccggcctcccgggaatcgctctctgcccccgtcatgcggtcccagctcaagagtaatggggggggggggggggggggtctccctgctgctagcctgctagtgaagtgcctgctgtgatactactgatcatgcctaccggtaggtaccagaattggcagatttctcaatacttttttccttcaccagtttaaattgtgtggttaatactagatgacgaagtagtaccctatataataattcattgattcattccacacgacagaaaagtaaacgagacagatagaagagctcaatactgaattttaattatttgttacaaactggcatagttatcagacattattacacacataaatattcactagtaagactgaagaggagaaaatgacatatcacaagctcaaacaagaaaaatgtactagtagcatgtgcgacataaaagaaataatcctttggcttaaccatgcagtgctgaaaattcttctttgattgcagcgacttccttgtaaacgctttgcattgtcggccgatctttaggtgccactgcagagcacaagaggccaagcttaaccagcttcgtgacacagttcagcattccatccatcaaacaattatcatggtctagatcattgtttgcatcattgtcttcgttctcataatctggcatgatgctcggatctagaatttgaccaatcttcagaggaaatgcctccttggcaaattggtgaaggttcaagccatcattaaacatctcatctgttggacgcttccctgtcaacatttctaagatgataaccccatagctgtaaacatcaccctctgttgatattttactcccgaagccatattctgcaacgcagtttataattaatatgacaaaaaaaatgaactcataaaacttgaaagaaaggagtttataagagcaaatcagaataaaacacagtcagaagaaacatgcaaattattttacagaaaagacatatactatcttttttgtgcattaagaaattctcacctggtgcaatgtatccaatagaccctcttggccccagtaagcttgtagacctatcacttgtcgaagaaatattgctgtgaaggaacttagctaatccaaagtcgctaacacgtgcacccatggcattatccagaaggacattgcttggcttcagatcacaatggacaataggtggcatgcaacggttatggagataatccaaagcagcagccatgtccaatgctatttctattcttgtagataacctcactggattcctcggacgattcttgtaggatgttggatgcagccaacattctaggttgccattaaccatgtattcaagaacaagagctttgaactcatgtcctgtcggatcaaatgttgagcatgcggtgatcacccttacgagattgcgatggcgggtgttcctcaaggcctcacactctgctatgaagctttttggtgctccaagttgatcaagtttgaaaactttgatagcaactgcatgtgcttcggcgtcaaatttaccaacatatactgatccatatttccccgaaccaattaagttggttggagaaaagttgttcgttactttgactaaatcagcatatgtgagtttctccaatttcttatatgatgggtctgttggatttttagctttttttctcttcagaaaaaacactgctaaacatgacaaaaataccaaacagaaaacgctgagccctactacctttgcaatataggaagtgtggttgtttttagaagcagatatctgacaaagtggcaatttcagtagtggtgagatggcacacaactccttgttcccttggagaaaaaccttgcttgcattttggaagatcccattggatggtatgggtccctctaggttgttgaatgacaaattaagaagcaccatagagctcagagtctcaaaaaactctggaatttgaccagataagttgttccgagaaagatccatctgaatgatgcctctcagtgcagaaaaagatttaggaatttgcccattaagaacattcccctccatgttgagatactcaagacggacacaatcacctagagctgagggaatttcttcctgacaatttgttgtttgaaatattgagggggccaagaataatcaaactaccaacttccactggtataggtccagagagtctgttgtgtgagaggtccagaccttcagaaagtgtggaaatagtaaataattcctttggtattgttccttccaaggagttacaagaaagatttagtatatctagtttttggcattgtcctaaggccttggggatgagtccactgaaagagttatcttgcaggtaaagctcagttaactgatttagtttaccaattgaaagtgggattttcccataaaaactgttttgtgctaagcttaaaatgagtaagtttgaaagatttccaagtgagtcaggaaggttgcctgtcagcaaattatggtcaatttgaagcagtacgaggtttctgagttgttctatctcctgtggtatggtgccagagatgaaattggatgtcaaaactaatattttcatgctttgtggaagatcaccagtggaacttggcaggcttccttgaaggttatttgcatctaaatataattcggccagctgtgtatgtgctaatgctgggaggaaagtccaatctccagcttcaagctggttcttacctagatcgagaatggtcaagttgggtaaggacccaaaataaggaataatacctttgaatgcattttctctgagattaatcaattgaagatttgttgctttggccaatgatttgggaatttgaccatggaatttgtttccttgcagaatgaacatttcgatgcttttaagagtatacccaatattttgtggtaattctcctatcagattattttctgccatgccaaggaatgtgagtgttgacatattgtagagagggagtggaactgttcctgtcaagttgttcccagtgaattccagttcttctaagtacggaattctacttaaactcgatggaatacttccttgcaattcattccatgcaagcagaagtgagtaaagtgaagtggagttgcctagagaagatggtatgctacctgagagattattgtaggacagataaagaaattgaattgatgagaggtctgacaaaggtggaatggacccaaaaaagttgttttctgccaaatttatggcctgtagtgaggagctattgaatagagcgggtggtatctctccaccgatgtgattcttccttaagtcaagccactgaagtgatgaacaatttgctagcacagggggtatacctccagtaagactattgtttgcgagaacgacataggtgagtgacgagacgcttccaagtgaatgaggaatgttacctgacaagttgttgctatgggcaaacaaaaccgaaagtttgtcgagcgcggtgaacccatcaggaatgccaccgtgaagcatgttttcatggaggacgattcttttgagatttgaacagttgctcagaccaaggggtatctccccttggaggaagttgttcccaagattaagtatttcaaggctagagcaagaagatagagagtttggtatcacaccagtaagattgtttgaagaaaggtttatgtaaactagacggcgtaggtggcctacttcaattgggatctcaccattcaacctattattcgataggtgaattcgtgtgaggaaagtgagattgccaatacaggggggtaaatggccattgaggtctaaggactctaggtgcagtgctgtgacacgagattcatgtctctttccgcaggtgataccgggccaagtgcaaaattggagagactcgttccatgaggctagggatcttgcattgttagagagacgagacttgagacaaaggagggcctggagatccttgttggattcatcatcgagtgcggtgctacttagtgacggaattaatgggagggtcaagaaagcatacaggacagcaaaagtgagaagtgagggagtgagagttcctataggaatcatctatccgctactatggatgttgttgctgttatgtttgtggaagactagctgtagcttgggttgtgttttttttcagtagcagggttatgtgcatttataggttgccggaggatagcggctagccatttgttgaatttgttccaacctcacagatgcatatctacagtcaaagattcaaaagaaaaagaaagagttggttcgtagtccatctttgctgtcgtgcagactattcaaacaatggacagtcctctatatacggcaaagcattgtaccgagtacaaattttgtgcctgaactcagtttatccattttcctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgttaccgagtctctttaagttatttgctcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgataaagtttaaaaagacaataacgttatattatttgtttctgttttttttttcatttgtgtgcttatttcagttttggagacacgtgtaggcatttgattttaactaagtattttttaattgattgcataaagaacaaaaggtgtattagagaaaagtgtctaaaattgtcttccttgtttaatgcattgtctagagttcgaagaatctctctaggatgaaaacttaaaagtgtctaaaagtgacttatggtctagtctttgctgattggatcatggcaagttgataacaacggggtgtacatatgcattgttcaccttttggaggcgttattttacgagtctttatcatagttgaggcgtcgctcgctttggtggagcatgagaatgaagtttgtttgtggctgtagcttgttgtggcatgatatttgttttttcttaaataatgctaggctgtgtggttcttcttcttcttcttcttcttcttctttttttgtgagtggaggttgtgtgcatcttaggtaatggcaggagtcgtattagagtggttgtatccttaaaacagaacttaattatgtcacaccatatctattttttttcggggaaagggagatatattacgaagctatagagtcagcaccgacaaggtgtgagatgaaattacaagaatcatcaggccaaaaggccgttaaggactcacacctccctctattagctaagatatggctaatgcgattctgatcacgatagattttcgacaccaccacaaccatatttccagccataaggcatttaaccttcttgactagaaatgtaagctcagacct

SEQ ID NO: 22158 - DNA, 2821 bp, Oryza sativa
tatgcaaactactgcaaatctaaataagtgaaaggtggaaactttcttgcaagattacatgtccatgtcatctttaaaatacggaccatttgatttttcctccagacattgctagccattagatccttagattggcgaaatatcttcgttccccttcaagaaacttcttttgtaaagaggtcctcccacgtccctaaccaaaaaaataaattgtttctcctcgttgtctccactcccaaatcgtgaaaacgtgcactcttcgctgccgtcagctcctcctccatgccaccaccacctcctcctcctcctcctcctacctaccccatctgccgttgctcctccactccatcctcatgcgcggtcgccaggcaacacctccaatccctccacctcccaggtgaccacgcagcggagcttggctgtgtgtcccctcaacatccacaaactcagaggcgatggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcatatattgttgaattttcaaagcctgtttgcgcttgggcagtaaaataaaaataccaaagttaagagagtaattaaagaggtaaattaccactataaaaattattaaataaatcaactaaattgggcctaataacattccagaaaacctaataaaactcataagtgaatacatcccgacccagagctttattatattccgtttaaaaaatagcatcttgaatttccttctactaaattttctaattgagaaacctagagaatattacttatttggctttgatctaacgtgtggcatctggctggggtgcttttacgaaacaccaaccccataatttgtcgagccaaacgagcttcttgccagtctgcttatactcggctcgtttcactcacgagctgtattgtaggcttgggctcgctcgttccatacatgccgagctaagcctatgcaaagactgagtgaaacgagcgagcccacattacttggttaatatgttcaggaatgttttctactctattttgaatttcgtctcagttgtctagttagggcgggttaattagtcaggtactagatcctggtccaaatgttcatccctctctcaaccatgaacaaacaatttcgagttcgaacaaggcagcagccacgtacaagcattgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgttcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcccagataagagaagaaaaaaaaatgttcgtccgccagccgccgcctcccgaccggcgtcggccgcccccgacgtagccggccgccgccttcccgaccagcgccagccacccctgacgcagctggctgccgccctctcgcgtccgccgcttgcgctgcccgccgttgctcgcctgtgtcggaggggaggaggaggagagaggggaggagcagagaaatgtggagaagatgagaggtgaggatgagatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggtttctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcattgtctgagattaaacggaccaattaaaggtactggaagttgtactggaattgacaatgtgttgtgaattgacaagacagcctgagat

SEQ ID NO: 22159 - DNA, 12589 bp, Oryza sativa
aaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggttagaatttattaaaaaagatcaggcaacaaaggtgaaaagaaagcacttaagtcaaatttatagtgtgttaaaatctgctctagattaatttttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcgcctaccactgaaagcacgaagccgttaaatcctgaaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgctttccctcccgccatcgcccaacgctgccatcaccgcctcccctcgtgccaggtcatcgctcccagccagatctggcagaggggaggcgccgccgctacctctgctgtcgggccgccgtcttccctccaaccatcgcccgccaccgccatccccgcctcccctcttgccaggtcatcgctcccagccagatctggcagaggggaggcgccgccgctacctatgctgtcgggccgccgccttccctccaaccatcgcccgccaccgccgccgcccctgcctcccctcctgttgggctgccgctcccggtcagatctcgtgaaggggaggcaccgcgccgcagccgccaccgcctcccctctcgtcaccgcccgcagccgccacccccacctcccctcctaccgggctgccgctgtcttccctccgacgacgcgagactgtgagagaggcgaggtgagagctgagggaaaagagataaggagagagagagagcgtggtggggatggatggataagaatgggtgggtggtgacttggtggataagaatgagaagcggtgactcggctcacagctcggtttttaaaggtgtcgattttaaaaaaaaaacgatatctttaatttattatactatcagttctttaaaaaaccgacacctataattaatttaaggtgtcggtttttatttaaaaactgacacctgtagtattagtatcgtttttttttttacagaaccgacacctataataaggtgtcggtttttcctgttttgggccatggaggtggggaaatgtattataggtgccggttttagctgttccggcacctatagtggtgatacctgttttgtctttttttagtggtgtaagcttgcatggttacaaataagatattaattatgacatgtataaatatagagtctgatatataagccccttgttccttgtataatgatcagagtcaatataggctagctttgttccttgtgtcgtggttgctaaccaacctttatcacgtactgccagctccttgctcatacttcctccaggtcaggctaaggaccacatcaaataaatactaaaaattacttaaactatctcatttaaaaatattacccggaatttatacatgggtcagtgactaatctagcttaatttgggaataaaaacaaaacaaaggtctatttaatttagattactgagcgaatcattggcatgattatcaattcaactatctaaatctgatttgtatttttctattcgtcacctcactttcggattattttcgttcgttttccgatcgagatttcgtccggattaatttttatccgtctacgtatcgagggttcgtctgatcgctttcatcattcaatcatatccgcttccccgcgctgatacaggcctgcacatgcgtgttactggcccgtgtccgtgtgataaggaaaacggaccgggcccatgtaagattttttctaactgtaaaaaatatcacgtgtcttccctactgttgtacgaagaaaagtgacattaccgtattaattagcataagtgaactaatccaatcgcaatatcgattgtggatcccctcaaatgatccaagtgtggttctaagtacagtatagcaaattacaaattcatccctagatagaatttagtaaaaaaaaacctgaaaatacacatgatattgctaaatgaatacagtgtttatgatattgctaaacagacgcatgatattttacctgtttgattaaaaatctatatctatatctatacctatataataaaaaaaaatatgtaaggtttccggcatattttttcgtccgtctctttttttttcctttttttttttgctattttcacctttttttctttcttttttctgttgtccactttttttttcaccgccttttttctgtccgccttttttttctccgttttccgttattttttttcttttttttgaccacctatacatttgtcgacaaattttcttataaaaatttgacacatgtaattatagtacaatcgtagtgtaattacactgtaacttgtatataattacactgtaacttgcatgtaactacagtgtaacttgtatataagtttcacgtaattttgaatcgttagatctattacaaaatttgttctggtgaggaagaaaaaattcacatcatacacatatgtgaaagaatttgttctcacaacctccattttaccgaaataaatgttatggagatatttttgaaagttacatacatgttatattataagttacagtgtaattacactacgattgtactataattacatctgtcaaatttttggtggaaaatttgtcgacaaatatatagcaaattcgtctttttttgtccgtctcttttttcgccccccccccccttttcttttcttttttccctttttttctttttgtccgttccttttttttttttttttgccaggccgaaccctagcgccgctgccataacgatcacctcccatgcgttctcttctacaattgattgtaaaagttgattacccactactctctcattattttcccatgatttttcctttcaattctgctctaatttaccggatctaatacacatttaaaaatcaccgtatctgagttttatgtattcgctcatattttggtaaaaacggaaagagtagatcgagtgtatcaaaagccctcaaccaactttgggagtatgggctaggtcaaagagaggcaagcaaaacagaggaagataacgggttgggctaagactgaaaaggaaggaataaatgaggttttggccgcaaaacagaggaagataacgggttgggctaagactgaaaaggaaggaataaatgaggttttggcccaaaaccaaagagtatctctactattataaaaattgaaaatgtttttgtcggtactttcgtagatcatctgtatttgagtcggtttctaagttcgttcgcttttggaaatatagatccatgtttgagtcttattttaagtctgatcacttttagaaatacagaaagagtcatataataaatctctttaaaaaaaactcgcacgctaactagggatgcttttggaaatacagaaggagtcgtataagaaatactttaaaaaaactcgcatgctaatttaagatgagagttagactcctaatagtagcttataattttctaaaagaaatatccaagcaaatttctacagtaattttcaccctaactgaaccgtataacaacaacaataataataataataagtctaaaatagccttcacccattgcaacgcacgggtattttttctagttattgaaaagatacatagtgcttccatcgtccgtcgctaatcgatcaaaagtgatatgttgtccaaatatattcaactaataaaagtcgtaatggtttatttcattcatcatcccgatccaacgaccttgattattcggtggtcatgctcatagtttgtatttccgaattgtgacaaaaattacccatatgccacgaacaaaaccccaacacaccctaaagctcgatctaatcgttccctcacatcgcaattctcgttccctcacatcgcaattctctcctactcccttgctccctataattacaagtgtctagtcgagctagcacctgagctggccaggatttgggcggccacccaaccttcatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcactttctaccatcgcgggtctctttcttccatgtctgctcctcttctttccttttactttttttggttaggggttaacatgtcgtgttttttccctctactgtctttcaacgacctcaactgtccttccacttcatcttctcacccaactatttataaaccgcactttctctttcttttcttaacttctttaacatgatgagatctctgtgaatggagctaaggtgccaaaacagtcccaacaataaataggggtaaatatgttcaataaatattattctactagacccttttcccgttgcaacgcacgggcaattcttctagtatataattagatataataaaaataaatttaacaaataacatacaatctaaacaatgatgtacaaacggaatagaataatcttttaaaaaatatatattttaaaaaaaacatggaggaaataatccgttccaatacttcggcgaataagaaaaaaaaaaaagcacagggcaggtcccgctaagaacgtttgataggtactcaacgcccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgatcaaagcatgtcgcccactctgagcagcttccgcttcttctgattcgacttgttttgctggctctcctgataggcagcggcgtccccatgccctcggctcagcaaggcggcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgcaataggctaacccacgaaactcacctataagccaaataagtagcgaacctatttattttgatctatatggattagcggcttactcacttatacccttgattcgtgctggataaatatgtagatcgtgttgttaccgctctatattatactcctactccctccgttgaaattgtaatgcctggtttttattgattatttcggaaaatcgctccttggctatataatagcaatgcctccaactctgttttaccacaaagttaagtgtaattacaaatttagtatataattgagcagtatgtacatttagtttgccacttatctcatcgtatcccttctattttcgtttccactttcttttccttctgaacttacatatctattactccctccgtcccataatataagggattttgagtgtttgcttacagtggttgaccactcggtttattcaaaaagttttgtaattattatttacttttttttacttactttactatccaaaatactttacacacaactattcgttttttatatttgcataaattttttaaataagatgagtggtcaaacactacaagcaaaaacttaaaatcccttatattatgggacggagggagtatctattatatattaaaaatcaattaaactttctcaaattaaatgctctcagaccatcacgtggtgctctaataagttagagaaaaataatagaaattatgagaacaaaaagtaaaacatccatccattaatttttatttaaattggtaggtccacgaaaaaaagggcgcggcaaaaaaaagtgataaaaaaagctccctgataaaaaagaaggatgaaaaaaaccggtttcgattctaaacatcgcctgcaaaaagaaaatcgaaaaaaaaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctcctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggcctaacgcgggatcgatctgagccattcgtttagagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagccggccgttcgctctcgggcgacggccgtcaacgaaatttgcaggtggcccccttgccgccctccgctagggcgattttatactgtgcggggggccgcctgcaaatgggcggcgagggggggcatggaattttgcaggcggaccccttgccgccctccgctagggcgattttctactgtggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataacttgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgacctgcctgtactggtgtgacctctggctgctcctgagtgtgcgcctctggagctcctccaagctgagaggagcctagtacgtcctggtggtctgcaccgtgcaagtcgtcgtcatagaactggctagtaggaccagtcctaccggcgtgagacgaagaggccccagtaccgaagatcccggctgcatatcctgctggacaaggaccatcagttttgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacacattcgtgcaaaagctgaaacaaaaatgaactaatatctgggctgaattgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgcggcatcagcctatgcaagatggaaataaaaaattcagtagttgtcctatattatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtagagcccaaagtgcgcctgctagctgtccccgtcgagtcaacctgtgaagagaggtaaattatatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtgaccttacttgacattgtgcctgatgaaaacattaactgcgttaacctcgcatttctgtactacgccctaagttacattctctacaatattgtcctctaaatttctaaaagtacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttttgctgccctcccctctctctcttttgttttttttggatttttagtgaatataatgaaatttcacagaggagggactgggttttatagggggggcaaaaatcgccctcccccagggcggcaagggggccgcctgcaaaattccatgccccctcgccgcccatttgcaggcggccccccgcacagtgcaaaatcgccctaacagagggcggcaagggggccgcctgcaaaattccatgccccccctcgccgcccatttgcaggcggccccccgcacagtacaaaatcgccctcgcggagggcggcaagggggccgactgcaaatttcg

SEQ ID NO: 22160 - DNA, 4350 bp, Oryza sativa
agggcggtaggcgactatttccgtcaattttcaaaatggaaaattatttttgtaaaacttttaataaaaaaaattataaataaaaaaaattacttcgtttagatggactgctcagatcggctcataatccattaaaactccggaccgaaccctaatcccaaacccttcctttttccccttcctcctccaaccgcaggccactctctccccaccggcaaccgcgcactttccccacatccgcggttttccccgggcccctcccccaccgccgcctctccgcgcccctcccccaccgccgcaaaaccgcgccccttttcacttccgctgccttcccgcgctcctcccccaccgctacctctgtgcgcccatctccgccgccgccgccttcccgcgcccttcccccaccggcgtcgtctccgcgccccttcccaaccagcgccgcttccgcgcccctccctcaccggcgttgcctctccacgcccctccccaccggcggcgccgctcctcctctccatctcctctcattatctattgattccgatttgtatttgtatttgaatttggattgagattttgtttttgtttggagccgcagcccggatggcgtggggacggccggccggacctcgccgctgccggatctagcggcggcgggggcaggagggggcggcggcccggatgcggcggaggcgggagaggcagctgcccggacggcgtgggggcggcggcggcccggcgtccctgcgtcgacggcggcgacggcggcaccctccccttccggcgtcggcgtttttgtgcttgtgatgttcctgtgttgtcgttgttgttgatgaaatatgatcttgtgatgttcttcttgtagtagtgttttctcttggaatttgtgatgattccgatctgtatttgaattgagattgagattttgtttttaggttggattggatgcgggatttggagaggaggagcgcgtgaggttagagaggagagggacgaaaaaccggtgtgacgaccggaaaaatactaatatttatattagttgtagatatattattatctttatacctattataaaaattaaagatgattttatactcaccttaattttcgtccatcaatcgagttaaacacatataaaacctggatcggactggaaaaaatcatctactggcgatccgtattctcaatcggatgaaaaatgtcttctctagtattataaaaattaaatatgtttttgccgatacttttgtacgtcatcgagttggtttgtaatttcattagcttttagaaatacataaggagtcatgtgagaaatctcttaaaaaaacacttacatattaaagtgagatgatcaaactcctaatcaactcctaatcgcagctcatgatgattttctcatgtgattgaaatcctaagactttacccgttgcaatgcatttttctagttgtatactaaaagtcaattaaactttttcaaattaaacgctctcagaccgtcacgtggtgctctgataaattaagggaataatagaaattatgagaagaaaagtaaaacatccgtccaatgatttttatttaaattgataggtctaatattataaaccgttaatttagattaatcttcaaacggaccgcacaaaacaactacggtctcacctctcctccttccgcgtaggtacgtacatgagcgtacgtacaagaccgaacaagacatccgtttcttctgcttccctcctctcaggaatactcaaatacaaataagtatatagtagtgtgtcttatttctggctaactactttgtaaaggtgaggaaagttaatgcaaaatataaatacactgtgatcatgtgataggtaattatgtatacattcatgtagattatatcgtcatatagctcattccaaatatacgtaactaaattagctatgtaatacttaatatttaaaaataaagtttacaccattatatatttaaccattaactaaattaattatctagttgtgaattaacttacccacaagaggagtacacaggaataagcctctccccattccatttcttaactcgactctcttgagttctacctagtttctaccatactgtatgttatcattttgaatcaagtaaagttgcgttttgttttaatttgggttagctttgttccttgtcgtcgcagtgaccggccaaccttatatcgagcaccttgctcgtgctttctccaggccaggccgtgagagatgggaaccacatcaaaaaatactaaaattacttaagctatctcatttaaaaatgtacccaaaatttatatacgggtcagtgactagggtagattagtctgggaataaaaacaaaacaaaccaaggcccagtctgatttaaattgttgagtggattatagttatagattttctagtgataaattaaatatctattatatactaaaagtcaattaaactttctacgaacgttctcaaaccgccaggtggcatcctaccaacgttcctaactcgctacatcgcattctaataaataacaaaaattcctaagaaattctaaaaaaaaaccaaaacatctgtccatccgttttcattaaaatagttggtcccattatttcaagccaacagatttatctaaaaaatctttccacctccacctccctcctcccacacgtaacatctcttccctttgtacgtagtcacgtaccatgtacaaagaaggttatatatgtacgtgcagcccatatatgtgtcctccttttctctctacaccctattttatagctagaaatttaactaagcatggcgagttaaatggtaatttaatttagaattaaactgataacttaagatcaataaaatccaaaatatttcaagggttaattggatccataccattgcaaatttgcctattccgaaaaatgtcattacaattcgtctattcttaatcgtgccattgaaattttccaaaattaaaaccgtgccactgccatcacgttttccatccatcccctgcattttccgtcttcttccttcattccctcctcaccgccgcacatggtgccgtcgccttcgatcctcaccgacgcaggaggcagcccagagcttggtagcggtgtcaaggtggcggaggacggtggcggcgatggcgccgtccatggagaagaggacaaagccatcaccgccggggaggccgagggtgcgggaggcaggccaaagggaggagcgcggtggcggaggaggatggtcgccgctgtggaggaggtcgcccctgaggccagcggttggatccatgcggcggtggaggagggggaggaggaggagacaggggatttggggatcgggaacagtagggagagcagagtgcgaagctgcattgcaacgccgccagcatggttgggtcgctagtaagctctctctcctcctccgagcttgcctcactacgggagatggcccgcttgacgcctccgtcgtcgccgtacctcttgctgctgccaccgttccaccgatggatacgtggttctcgtcctccacggcgaggtgcgctgagggcatgacgacatagagatggagagagaagatataagatgcagagagaagatggaagagagaaggaagaagatggaaaaagaaggatggaaacgtgacggcaacggcccggttctaattttataaaattttagtggcatggctacaaatagacgaattgtaatgacatttttctgaataggcaaatttgtaatggcatggatccaattaacccttgttaataaatagtcttaacaatcggcacaaataaaataaacttgataacatatattgttccatcatatattacccccacgaacatgcatagatgaattagatcaataataaaaaaacaaaaatatcaaaactcatatcctatccaatcctatattctataatactatataattgatccccacttagtgtagttattaggaattttcctgagctgtggttaagccacgtcacttcttttattttcagtcattcgatcaaacctcgtgaatggtccaatcgtactccatcacacacacatgcacgttcttttgcctccctccgccaccgatcgaatatgccgccgccgccgggtgcgcttgcttcctctcccacatcgcgcgctgcttccacctaccacccccgcgcgcgccaagacgtgggccctctcctccatcgcccgtggcagtgcgggccctccctccggccggcgcgctcgctccttctccatccccagcgcgagccagccgcgagcctgccatcctcgcctcgccgcgctcggttccccatccctcgcgcactctaccgccaaccgcgccgcttctccaaaaccccac

SEQ ID NO: 22161 - DNA, 2376 bp, Oryza sativa
ttttattttatggacaaatcagtcaataattcatgaatcccattttttcatatggaattagcattaggccagtcaatagccggaactttttccccctaatttgtatgtatcttaggttactcatgtttgttgcttttagatgtgccgattatctggatacatctataaattacggattggtgactgggcaataagctagcttcgtttcatcataggcctattaactgtatcgaagtattttccagctttgttcttcccattgctccatttatatatttagaacctaacttttggtttatataagttgtatcctgagcttttggttgatataatcatcatgcttgaataagctcctatctctgtaaggacctgaacccatcgcttcgaaagtgggtacatctatgctgcatgctgttgttatgttatctggaatttttgcatggatctttctttcaaacacatatcggtatataatatcccgcggcaacacacggggtatcatctagttactataaagttataacccactaacttttaaagcttagcatgcaaagatgccacatcattatccactaacaagttgacacatcatcatccactagcaatcaatacatttaatattatgcaaacttgttatattatctataatttaaaatttcttacattttagagcttttaaaatgaaagcatgttaaattattatcccacataattcacataatatttcaatatatatcttcattatgttttataatatcttatgtacatacataagttcatcctcacttagttaatgttatctctctcttctctatttgagccatatcacgtcaattgattttagtgcttatgtaagtttatattgttcagctatcttacatattatttttatttattgttatcatactgaactcccacagcaatgtgtggggtttcacctagttacctcatatgttcgtgaataattacttctcgagatcaactctacttattttcagggagaaaattatatttgtactgctaaaatttaatggaccaattaacgccatagacaagtgtcaactctattccataaatggattcaaaactttaaaaaaattatcacttccatcttatctaattatcattccacgaagggcgccaagcatggataacatagtatgctctgctactgtacgaatttgggggggggggagggggcatgcatatgactaagtaaaggtgaccgtagtgagaggctactatttgcaaataaagttcaactaaccttctttctgatgctattctttagctgataatgaattaggcgttaaaattgtgctgcacgctgattttgaggagcacaactatgtagattaaggacacatatttcaaggcataagagaagaaagcctaggtggctacactcggcttcaactattagaggggcatttatatataattttaatggttttatcccatgaattggtaggagcaatacttcaaaatatttatacatatatttaaaaacaagtgagacatgaacaatttagtattaagtagagatgatcttttcttgtattactgacatattaagtttgttttcttgtatggatgtaattccatcataactgataatacaacgataataaataatggtgacaagcaagtttacatatatccggaacaacgttatttctgtttgaatatgaaagatactattgtcatttggtatataaaaatttatggtctagatatttatttttttattaattataagctgatatactgtccttataattaattaatatggtgagataggatttctttagcatcatttttgtaaataataaataagtggttctaattataaggtgaagcatgattttttaacaatcttttataaataagttgcccgcgcatctgcgcgggctttctttctaattcgtaaaaaaaataacaaagcaacttatttttagtggtgtaagtaattgattcaataatccggtaaataaggtaaaaaaatagggcatgccccgctaagtatactactggataaatgaaattagctgggtcacgcaaaaattacattagtcctggtttgagtaagaaccgtgactaaaaatatctttagtcccggtttgaaaacccacgggtactttttttatcgttaccaaccggaactaaatatcatttgtagttccagttaaaaacatgttagaccctattttaccaaccgggactaacgatgcatctttaatcctggttatttataccaaccgggatcaaaataaaaaaaatcgtgaaaatccctaccccgagtcacgggcgctgccttgtccttatcccctcctcttgtactgctcctaccctcccattttctcttctgcacctact

SEQ ID NO: 22162 - DNA, 314 bp, Oryza sativa
aatccagccatcggacctcgccggacgccggagacacgagcggcatgagtttgccatcgtcgagcttaagtcgccgctgctgccttcgagctgccaccaccgccttccaaggccagatccagcaaggagggggcacagagtggctgccgatggtggctcgattgagccgtgccattgccgcccgtcgccgcctcccaaggccagacctgatgagcctcagaccagatctagtgaggagcggggtggcggtagcaccccaacgaggaggaaatgagtcgatagtggggtgaggggagggaagggggatggggagc

SEQ ID NO: 22163 - DNA, 377 bp, Oryza sativa
cgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggccgtactttttgcatctgggtcctttgccgccctctactggagcggcaagtggcccaaatacaaaaagtacgagcgcaacctctttatgggcggcaaaaattgcaattagcccattgccgacggcaagggggtaattgcaattttggccgacggcggcagacggtgcggtccacccgccgtgggcggcagggtctatt

SEQ ID NO: 22164 - DNA, 20982 bp, Oryza sativa
  unsure (1)..(20982): unsure at all n locations
nnnnnnnnnnnnnnnnnnnnnnnnnnnnnnnnnnnnnnntaccctcctctggagatcagtgagctgatcaagcatatgctgtgtctgcaacaagattagagttaaatttttttcaacatttctgaaacatatgtgagaaacagttaacaaattacccttgtggatctaatgtgcctcaaggatgaatcaagttgtttctcaagctgctctagctcttttatgccaagtgtcccaagatcttcaccaagaagattcctgtaattgtcaacagaaagatctactaagttaggctgtatttagttccacactaaaattgaaagtttgaagaaattggaacgatgtgaacaaaaaagttggaagtttgtgtgtgtaggaaaattcgatgtgacgaaaaagttaaaagtttgaaaaaaaagttggaatctaaacggggccttagttctgtatattttacactgtgattgatgcatgcatctaattctctaagcaacttcagtatatactactgcacgcatctaattctctaagctagttctccctgagattactgttttaccacttgtaaaccctatataatagagacggcggtaggaccttcattggttcacatatattacttcactcttgttaacactagtcatatgtgttttttccatgcaatatagttttttttttcacccaaatggccaaaaagtatctagtgtacacataattgttcttgccccaatacacaataatttatctactttgcatatatatgaatgaaaccaattaactgtgctccatttcgtctttgataaaattgaactcataagtggaagcctgatattacctttgggtcctctgtaaattttccacccgtgccttcagtttgaggtactcattgcggctgctttgcactaactgaaaaataaatttaacttcagtacaaagaaataggaaacaatttagagattctatgtgaaaacaaaataatataatttcacatgcaaaattaggcttatgaatgaacaatttattagaaaacagtgatattaattcatgaatccatctatcatatcatggtcaataaccagtgactaggagcttttctgttttatattcagatctacatactagacatttcagctagcacaaattagagttgtaaatcagtgttattacatgtggaaacacaacaacaatactcattctagttatagcactctttcatatgcaaccttttgcagtgctctcatttttcattaaattttgagtcttgtagcaacatcacatacattaagaagcacagcgaatatattaaattaagacttcatttttaattgtactattcaacacgtgtatatagttggtaattaatgataatactaaaagcagcatatctaggatcaatcaattaaactgcatgaatcgaattgttgaagtattatccagtgagacacagatcgattaatcagaacacaaagctagtctatgcatcaacttaaatccataaaagcttgtcataactcactaaaaattaaaatatattaatagaatctagtaacctcattttccttgttctgtattgcagtatctggcccaccataactgaatttttggtatctttccaaagttctggtcatgctgcaagtttcaaaaacacaaatggctatgtttatggaaaaacgaaataaaggaacatatatagttcgcccataactaaatactaacaatctagggcacattcttttccggggaccacatcgattaattagtagatgaaaaatcttgtttctcacaaaacatgaacattagctccatgacacggatgaaggtgcttgcataattggagacaatttctaagaaacaataacgttttatcttaattcttgcatcggtagtttcaagttgatttataattttatatatgtccatgatatcaacctagaggccactttttgtaaagaaaatggagtacactctttaaagagagatatcaagttcagacgacacacaatgaaatggcataacttcacgcagactactactacagctataatgctcaccccccccccttctaccgcgtcaatttagtgaccttttggctgtgtttagttcaacgcaaagtttagattttggttgaaattggagatgatatgactaaaatgttgtgtgtatatgacaggttgatgtaatggaaaaggactgaagtttggatccaaacacagcctttgtttaaacaagtcgtgaattcagatttctgaaaaggatctacagtacacgttgagtatcaatttgtcggcataaaatactccactgaactagctctagctagaactagaagagacatctgatgaagaccaatcttctgtactgacagctcagctacgagagctgaggagaccaatcgaatgacaatcgaaagctgtcactaactgtaccctgcagatactcaagtgagtcctaggaatattgtgtactcccttgcaggatttcttccgaggagcagaggagggatgtttcactcaccccatatccaaattgaattccctggtcaatgaaatcatgtactcttatttgtgaatatatttaatgttagaattttataggcgtattaattttaatttagtaacttaggtataatggaaaccatttaaacataactataaaaattggcaagcatgtactccctccataaaaaaagaaaaagaatgctaaagtccccatatacttacggctgattataagccataacggcttattagcaaccaaaatataatttgtgagtaaaattgtatatgtgtctttagcgaattaaaagttaatgctgaaaaacaatctacattgacaaaacattaaaaatcaacttctaaatcaagtttcgaaattcaaaatttgatattggcttataattcatagggtaaaagatgaggccctaacttctagctataaatctggacatagcctatatatgtccaggtttggcaaaaaagttggttttttctgcaacggagcatataataatgtaatcattatctaaaatatataatgatgtaatattcactatagaagatattattaaaatgatcagtgcaatacaatgagcaagaaaatttaaccttctaaagtttggaaaatgtatgattcaaatatgaaatgaagctcatgaatgcctgacttatctaccctaactaattgtttatctctaaacacaataccaaatgttttcttccccccgaaaaaaaatgttttctaattcaaaatcaattcaactagcttatatgcggcttgtgaattatgcctagccaatcagacgctctgtgtttctgaaagacaattatatatatagtagtatatgatttttcatatacttatctcaggagaaacagactttatatttattgatgttgcctttaatgatgcaaccataactcacttgaaaaacaatactcccccgcggccatcccttaaaaaaacaaagagacaaaatcttaagtgaaacccccaaatcttgtaaggtatgctgcctccaaaccgtggaattcatgcagtgaacgtttgtttagacacacatccggtacatggctaatgatatgcatgatcccttcacacaccccccccccccaaaaaaaaaaaatcatatataccctaaaaaaaattgcccctcaaaaaactaaaaattgaggaaaaaaacagatcccaagggaattcgaaactcgcataccctccattaggagatcgataaaattaagattcgaagcttccaacgattaattttctccgtaaaaatcgacttgctgatccaggcttaaatcctgaatgtcccatcccatgcatgcacataaattaatcgcaattaaaccaaactcaaaaccattaagcgcgccatctcaaaaccactactaccacgggatcagaaaccctcagatctacgtatttcaccactccctattacgctagctagcacccgatcgaacgaacaaaaaccctaattattcccacagaattccaccaacttccttctcccaaaccctcccaaaactcaccaaaacacgagcacactcgcagatccaccatgtgcagccccagatccccgcaaaatcgccaccaagaagttcacaaaaccatcgtgcgctccagatctggaggcgcaggcgcgcgcaagaaaccctagctagctacgttgcaagcagctaccgatctagctatagcagatcgaggcgcgcgcccagtgcgtccatgtatatatacctttggccgctgcagaactcgtagagcttgccgcggttggagaagatgatgagggcgacctcggcgtcgcagagcacggagagctcgtacgccttcttgagcagcccattcctccgcttcgcgaacgtcacctgcctgttgatcttgttctcgatcctcttcagctccaccctccctctccccatcccgatctcctcctcctcctcctcctccacctcacctcaccgccgctcgagctcgatcaatcgcgagatgaatcaaccaatctcgcgaagcgaaagagaggggaaagctaaggcgaggaggaggaggaggagggggaaggggatgaggggtttaaaaagggaagggggagagggtgggcagcggcggtgggggctacccggcattgccatttccggcaaggtggtggaacgacgcggaaccctaggcggcctcgatcgatccatcgtacgcaaaggcaaagctatctaggttaatttcgcactaatctccgacccaattcaatgcgtctctcactgattgctttggattttctctctctctctctctctctctctctctcctcgtcgacgcagcggtggcgactgaggattcgacaggtcgagaaattaagcgcggaaaagctggggaaaagtgagtagagttgggcgcttttgcacttgaaacctcggagttttcgggtttcgggaaaaatacccttcttgtgtccactaggagccggtgggtgatctgttgggagagcttaaggctttgtttagtttccaaaataaacaattttcacccatcacatcgaatatttaaatacatgcatggagtattaaatgtggaaaaaaaaccagttacacaatttgcgtgtaaattacgagacgaatcttttaagtctaattgcgcctgatttgacaatgtggtgctgcagtaaacatttgctaatgacggattaattgagctcaataaatttgtcttgcagttttttgacggaatctgtaatttgttttgttattgtaccacatttaatactaatgtgtgtccgtatatccaatgtgacaaacaaacccaaaaattttccccaactaaataaggcctaagattttgggaaatagctagttagtatcaagcttctgagaatatggagaatgtggatttctcagcttctgttttctagttaattttttagattctataattagagcttttgagaatttggatgaaaaactagactatgtagagaggattaatatgattttgagagaagatacagcggtcagaaaatccccatacagacccttacaacttttctcttgggttgcagttgcaaatcaaagcagcaaaatgaaccaaggtagcatagtatatatctagctagctagcgatgtggttgccaagttgccatagttcgtgtagacaaaatggagctgtttgggtttggatagagagaggcttcttcgatcggtatatctctttgcctgcagagaactttgccgttgcagtgcttgcagtagtagatatatatgtgtgtgtaaggtttgaagtcttggctaggcaggagtgtatgttctttcattttacctaattggtcgtgattctgaagagatcgatatatattctacctgggatatataggaactgatcaaaggattaatcattaatgtgtatgtaactttggtgtggtaacgtatcacagatgttaagtgcaaactagctagctagagatggacaaattaggctgcaggctaactaattttggttaagttaattagtatccatgcatgctgggaactcaaattagcaagagggggagatatatgaaaagcaaaataactagtatatgttataaaattaatgatgtattcatgttgtggttaatttaattaggggttgactgttggcacggggtgtccagtttataaaaagaaaagttaacatatgaatttgacatgtgctatgtatatgtgaaatgtcaatgaattaaaccgtccctgtaaactttttaaattgtggcttattcagcattataattttttttacctttttttctagtccaacatttcaaaggctgaccaagtttataaaaaaaacatactaacatttttaagataaaacaaacgtagtatctaaatatattcaatgttagattaaatgaaactaatttgatattttagatgttgctaattttttttataaacttgaaaaaaaaagtcaaatcaacttataatatgaaatgtagggagtagcgtgcaaagattacattaattttgaagtgcattgcaaattttgtgcttgtggatatatccggttcaatttatcaatacaataaagttgaatgttcaatatgtagtatcatttgcactttaaagcttagattaataagtatataatggtgcatgctaggtatatctatattatacatgcatgtttttcctcttaattacaactaatccgtacgtatacgcatgcagaaataaccccaacaaaattatgtacgatacagtagccaacccaatgtgttatataccacaattaacacggttcgtttgaaaactacaagctcaggtcagcttaggcatgccaggatttggcatttcgcaaaaaatggttggtcatcggtttgtgaaaaccgatcaatattagttggttttcgtacggtgttaaccaaaattcatcagtatttaacggttctcaatggatcggtttgcagtaaacgagtggaaggtggttctttatttcaaaaaaaaaaaggtaattaaacatgggtatgcaagactatcacatacggaataatagctcagcaaattgagccgttcttttcttcaaattcctcaatttcattagcacttttttcaaactatttaatggtgtgtttttttttaaaaaaaataaaaattctatatagatgttgtttgaaaaatcatttttaagtttataattattaatattaattaattatatgctaatgaaatttctcgtttcaagtgagcagaaaatttctctccaacttgaggatataagggcatccgcaatggttatctataggctctatacaagagatccatgtcatcatatttttctaattggaagaggttaaatgaagagaaagagagagagttaagctttctactaacatggagatagtctatagagaaaaacgatgtaatggatgagagatctatagatacccatgtagacataatattgaggtggtttactattaatctagtctattactgagatgtacatgttttgttttatagaaagcaacttactttaccattgcgggtgttaaaaagctacaccacccacacccatcccccgcacgcaacaacatggttggtgcgcttgactagaccctgaagcccccgtcatcgcgtcgtcggcaggcacacctgcgagcccaacggtccggaccgggtgctcacgagatatctgcaggcaattttaatctgggctatatatatatatatatcgtcccatctcgcgcgcgacttgatcgatcggtgatcgcgaccggccggcgtgacggagtacgtacgacggacggacacgtaccgggtcgatcgatcggatgccatcatgccgcgatcgtcgatacgtaccgggcccatggtattcgtccgttcgatgtatcgtcgtacccaatgccatggacgcgcgacgaacgatcccggccgccggctgatccatggatggatcgatcgacgtgaggacgcggacccagagcagggagagagccgtgtgtgcgtgaaaaaatcccggtagattttggacggcaaaagccacgaaatggcttggctagcttgctagtactactccctccgtctcataatgatttatcctagaattacgaatctggacatatatagttcccatatagtccatatattaggttacaacgttatggaacggagggagtagtaggcagcttgaatgcttgatctatcggcgcgtcccgtccggcccggtgcctgcccacaaactactcgcgcttgcttgttgctgccttgcaatcaatccatcaatcaaacgtctcaacgatcaatcagttcaatcagtattatgtgtgtgtatgcgacgcagcgaccgtgtcgtgttgtgcttgtgcagttgtgcgccatttccattggcgtcatgtgactcatgtcacatgggcccaagacgacgacctaacgtgggctgcagatgggccgagttaattaccactggccgagaaaaagcccagacggaacagagctcctcctcctgctgcagtgctgccagtgaagtttctgtacaggaatttccatggaattctctgccgctatactcttttaatgaattaaatttgaaaatatagtgttcattcaattattttttgttagaaatatttaggatacagcacaaatataccatcggtctcgtacaaccattgtgcgaaaatgacgcataaatgatttcacgaccggtatcgtgcagtgaaagtgcgagaccgtgcggtctcgctcaagcaaacaacgataccgctcaaacaatcaacgctatcgctcaagcaaagagagatatcgtgccttgcctatttaattagcggttaattatactgattattaattaatcactaatcatgataattaatcactaattattattagttaattgttaattaagtacttgatcactaatcaaatggatcccattggacaatgtcacagatggcttctgcagtctcactcttccattccgcgagagaccgtgcggtctcgcgctttcgccgcgcgataccatccgtgatgttattcccgcgtcattttcgcgcaacggaagtgcgacaccgatgatatatttctgcataattttttgcatcccaaatattccttagaaaaaattgaatgaacggtacattttcaaatttaatttctcttttaatcaccggtgaatgtccacccgtttattgcatgtcatctaaattattattatttttttaaaaaataattgacaagatatgtaatatatcactacacaaacatgtaaattaaaatttaatttctacaaattgtaacataaacaacaaataaaactcaaagtagtgtatatatatttgcagttaaatttctcaattttgttacagcttgtaaaagttaaatttaatattacatgtttgtatagtgatatattacatattaatctatctagttaattttttaaaaataaatttataactatttagttgatatagttgatatgcaactaatggatggacgttcacccgatgattagaatcaatctccattctctgccaatttctgtgaaactttgctgctgctcagagaggtaaggtaactaaaacggaagcaccacaagaagagatcgaataacactgcacatcacaggtagtagtagtagttactaattacgggaggaacagctactgatactcttaactcttaatgataattactggggaaggctactaattaagctactgccacgagaatgggagcgacggcgacgtgccgtcggaggagccctcgccgccgacgtgaaacatgccgtggtagttcatctcgttctcgttggagcccggcaccagcacggcgttcagctgctgctgctgctgctgctcgctgtccatgctcgggcaggcgaacccgccgccggcgacggccgcggcggcgggcgagctggcgaaccacggcgagctgccgccgaactgctgctgcaggttggggaccaacggctgcgccatggggatttggtggtggtggtggtgctcggctcccgccgccggcgccggtgacggctggaccatccggctgacgtcgacgctggaggagttggccggggatgacagaagagagagagcacaatcggagtcgagcacttggtggtggtggtggtggtggtggccggtggtcgtcgtcgtcgtcgccgtcgtcagcccgtcggaggaaaacatcttgttgctgctgctgctctccggtggcgggggcgcgacgacggtggtctggcacaccgagatctccagcgtcgccgccgccgccgcgccaccgccgccgccgaagcttatctgatcgccctcatggaggaacgggaaccgccggccttccttgggggagaacgccgccgtcgtcgccgacgacggcgagccgacgaaatgcggctgccggctggtcatcaccggatgagggtggtgatgatggctgtaatatggggtctcctcggatttgatgatcccaggccagcttggctctggtcttggaggagtgaaggacgcgaaccttgtccctacatttgaatacagaactaaaatggccgtcattaaaacaaatccgacgaaatgaaatctccattatgtaaaataaataaatgaatgaatgaaacaagccctagaacagctactaaattgttcggtgtggaagaagaaattcagtccgttgatttaactttaaagctccagttaatgtgggtatctggaatttcatctcagattccaattcttgaattaagtttgagtgattaactcaccatgcccactaaacacaataacccattcatatatgataataataataataaatctgacaatagtatcagaaaggtaaatatcaattgaaacataatactatgcacaacaagatataattttttttgctgttttaactgaaacataagggttgcattgtgctctctaagctccatgtaatatataggcaaacctatcatcgatttacacaggaggaaactagtagaacttgcggaatacgtaagtatcaggtagattactgaacctcggttctacatgctacattttatgagcaattggggtataatttgcagtggcatattggtggagtctagatatacattactttttgtttgctttacagctcagatttctggtttaagcaagagaggacattacataatttattttcaactatgtcattagcattcaacatactcttcaaaacaacagtttttaaacaagaataccttgttgacttgtcataaagctgccagaactcatgctatctgcctgtggcttcctgcggcgtcgattgtgcccatccaagcgttttctacaactacgcttagcctcatcaaactccccaagcaagtgaaacctacagaaatgaaaagctatgatgagaattccaaacatcaaaatccttttttagtacttaataaatctttataaaacaaagcttgattgttatactaggaagtgaaagggaaaataaaatagagctgctttaatgctgaaaaggtagtgtgagttctaattgaagcaaaaacatattcagatgtacttgttttatctcagagataaataatacagtacatacgaatacttcaaaattaatggggctcagatgctatttaaaagaagaggaatgatacgtgtatttatttgctgaatattcaataatagcacccagcttcaattaaataaaatggtacacggctggaccaatcgtatttcaatgtgtcagctaataatttcaatgcatggggattcagttatataaaagttttgtactggcctgtcaagcacaagagaaaaaaaaacagtacaactttggcctctgggacatttggaccacggtataatggttccagcaggtatatggcagtatgcatcccaccagcctgttgcttcatgaggatcaccttttttttttgcaatgagcactgaggaatacttgataaagactggcaagcaatatggcattttaattttgctccactgggcatctgggagagggcaattaatcgttgcaaaggagtccccacaggatataaatttttcaggaggtggcgaatgattggctgataatatttgtactgtgttaaaggtaacatgatgcagaggtaatttgctcattatagctcaacaacgtaaaaggacatcacaaaaagtccacaactgaactagagatgaacctaatacaagatctcggcttgcgtagtatttttataaaataaaaaattgacaaattggaggcgcgcattagctccagagagtaggattcatatcggcagaaagtggaccacattatactcagttggtaagagtaagcattatgcttggaactaatttagaaaagcagctacagtagttgttatgtcctgaaggaaaaggattttcttttttttttttgtttgtggaagcaaatgattcagctggaaaaggacgaccatgctttaacaactgttttatttcagttcagtagtcaaataacaaggatgatgttcatattcctggaacaagatatactcttgaaaattaaatatagcttttactgtacagccaaatcggtcaaaatttcactgatatcttacccaaaaaatactgatcgaatttgaaaaggtgcacacaaaccaaccccaaaacacacaaaaaggggtaaggcaacctattgggtgtatttatctgatttgtaattagttaaccattgagtagacattggtatttgtaagggttatctggttgaatgcactatacagactgtagttagctttcaaacagcaaccttgttggtcccaacaacttaaataaagagcatagctaataacctgaagcaaagcaagccataatataaagcaggttgcatgttcaatatcatctttacaaatcaacagtccctcataataaatactgttgcacaaggatccacggaaaaaagtgaaataacttgtatggatctggtcactgattcagaaaggaaagatctaagcagaaaagggagctaggcaaacatgtcagaaatggggcctaatcaaccagggtattacttaactaagagacattctgattcttaaactcctcaaagcaaaaaaaaaaaaaaagaaatcacatagatcctaaactacctacctaatgtgttggaactccatttttactcttaaattttgcagctgaccacaaaagaattgctacctgatgtcaatgacactacccgtgaaacataataaatttcttcggcgatacaacgtaaaattcacgaatttccagttcattcatcactttcaaacaaaaaccatgaagaaagtggccccagggataatgtgcacatgtagcaggtatcataacaaaagacccaactccatctgatctttggcacatgaaatgcatcagtggctttttagggataataattaccactgatgggtcagaaagttactagtgcagaaataggaaaagaggaggttataattcaggtataccggttgccaaggtaaagtgcaacaggggaaaaacttgtggtacatcttatgaaaaggctgaaaagttggcgccggaaaaggtaaagctgtgcatccttggaacaagacagccagaaaaatgttcatctcatctcatctcatctaatctctagtgataaattttcttggaacaattgtgccagggaaagggaaagccgaggccaaagaaagaactgatttggcctattcactttgaataaagggaataatcagcagtgaaaagaaaaggatgtagaagagataaactgaaccccaatcagtcagtgtgtgttcttggttgcggccaatttttattatttttttccatcgcacaattcaggcaatgatcttttgcaaatcacaatccgacgtgacacgattgcgggcagtcatcgattcgggaatttaatcaatgtgctgaatttagcatggctagaattggatatgaactgaaaatttgccaatttttacccgattttcttgtgcttttttttctttttttggttcgtcagattggtttacctgctgcactgctggcagaagcgcatctcgcggccggagacgacgacgacgggagtcttggagtgcggctcgcacaccttgtgccgccggtggtagtcgcggtgcttgctcaggtcggccttgcagccgtccacggcgcacgacgggcactgcccgccgccgccgccgcccccgccgcgcggtcgcttcagcgtgctcgtggacggcggcaccttcgccaccgaggcggcggcggcggcgctcgacaccggcgccttcgccgcggcggcgggctccttgagcgcgtccgcggcgccgaactcgccgagcccgccgagcttgaggtcgacagagcactccggccggcccggcgccccgcgcgacgccgccaccgcggcaatgcccggctccgccgcgctcgccgccgccgccatgttcggcacggcgttgtgctccagctcggccaggtcccaagaaacaggcatcttgagatcccaatccatggcacgacacggctccactccacgccacttgttggcaacttggacacctcgtcgtctacctctcgctttcacggtgaggccaccaccaccaccggaggaggaggacgaggaatggccggtttgtcgccaccgcccgtcgctctcatcccacggacatgccgcggcgaaggtggcaactagcggcgaacgaacgaaccaacgaattattgatcgcaaacaccgagataccaacaaatcgagcgccaagaacagggcaaatgcaacagatcagcagcagaagcagaagcttatcctgatagggatgagagacacactgaaacacacacacaaaaacacactctcttcacacagcagaggagaagagagatgaccagcagctgcagctgcagctgatgctgatgctgatgctgctgctgctgctgctgaatgagcaagtgaaattgatggtggttgtgcttggctttgctacttgtagctgctgctgctacacaacacagcacactgcacagatgcagcacaagtgcacaacacaacaagaatactctaccaccaaggaggagactagtagtggtaggcagtgagtcagtactactcctacttggtttttgcagaggaggcaagtgcagactgcagagttgtgtagtgttgtataggcagtgagtgagtgatcttcatcagtgatgaggggaggaagaggaggaggagaggtggtcatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggcattataatactccttctgtttacagataaccatcggttttgactttgagctgttttgcttccatcaatagtggctttagaaataattttggctattaccatcaaacctgtatcattcaattgaggagtcaaatgtattttttaggaattacttacattcaaatctatctgcttgtacatcgcttaaatcgtacattaaaaaaatatcatgctgatgtgtttaatgaggctagtcctaatattacgactgtcatttaaacagtagcaaataaatgtggtttttggtgtattgccagggcctttcagctcgatgacgaattccttagaaagtcgtttacctcaattgaataaggtctggtcgaatgagttgtgtttatacaacagacgggtaattgtttgtggtgagggtgttttaccctctccactgtggtttcctacttcttaataaagtgataggcatactcatgtatattaaacaaaaataacagccagagtttatctacctctaatcaaaacaaacatatatttgtgaccgaaaggagtataacatacattattttacatggaaaaaattcttatattttgggtagaggtattagtaatatacttgtagtaatatgttttctagcttggcttgttttttgtttgctgcatggatggtctgatgcagtgtttgcattgcattgcagccattcatctcatcaaatccctgacagggattctaaagggagcaaacaatgaatgggggtgggatgggggcccccaagcaccacagggccatgttcatcctttaacaccagcatggagccattgtgccgcaataattggggaggggttggtttggttgaggggaggccctggcctcttggaggccaagtgcaattacttttcttggcttcttgttagcagaggtttggtggtgtgtgttgggatttattatttaggtgccacaaattaaaacaaatcaaatggctttactgtcctgctacagtagcaggggttgtgatgtgtgcagctcagtgttgctatcttctgtcttggggtcattgtttgatagtttgctctctaccttactgaaattcgagaaatggggtatataggtatatttggttcggtaggagaattgtatttacgtgagatcaaattatgatttttttataataaattgaaaacgtagaatattttttattgtgactctttcaccgaattgtatacggaactttcgctgttataaatagtgcgtgtgatttagatagttgaaggttacagttaagaaaaaagtttctttcatggaagaaaagtcaaatattcatagaaaactctaactggtctatgttttctgatttcataagtacattatatatatattatggttctttatatgctatatgctgttggttcttgtgtgttcctagctagctactgtgtgttgaaatctgattctttcttttcttgaaaatatgcaagctgatttctcactgggattgtagtaacaaatggcgcaaatgtcacccaaacttcgtatacatctcattgtcaaaaacaaataagcttcacaattaacacatgtcaacttttagcccggtgattcaagctagcgtgaaaattatcacgcgccacgtcactgttgtttaatgtatggttgttgggttgaactcttaacaaacattcatgctaatcattttgtgtcaaaaactccatcttatagaaaataataaatttaataattaactagctctacatgaaggatgttttaaattgtcttgacacttatccccttgacagagaaaaggacatcaaccttaaaactaagagcctatttgcagctgctttgtaaggtgagtaggagcaatttttaattccagaagtgtgtagaccacacattctgactccaaaaaaaatctatctgagcaaacttgcacttgcacacattagtttaaccctaaaattcaagatgttccaactgcacctctcctgcaggtcactggtccatttgatctaaaaaaaacagtatatcatggtccatttctccatcacaagtacatattattaattttatatatcactagtttatatcttgtcgccacatgtagcaccagaccaattcagaatttggtgttttttatatacacagaaaatacttttaaaatgctttgggggttcttgtttgggagggagcctgtcctttgcctattgccaaggacatggggctgatttgtttgtttgttacttttgggtgtccttgacttcttgtgtataagggataaagggcttctaggtaaaaaagaaaagaataaattggatgataggtgaaggattgctctatcatgataggccactctctctcacaccatgtagcctttattttgcaaaaattgtggaggagatagaatgattggttacataatgtttctcctttgtaccttgtgcttcttcttctattttttaccgcgtttccatctgccagttaatatggcaaaattttccccaatatatacactccttacataacgatgtatttccattgcgccttataaatcttctgacaaatattaaataaacaatggaatctcagaaataagtaagtagccattacttgggttgttgataaccatgggaattatttccccacaaacaatagtttgctatacatgttttgcacaatttttttacccacaagcaacatcacttccaaatagcagtatcctcaatatgcacctttttttccctttaggaatacgcaaaaggcattcatataattgcattatgggaattatttcccaccaacaataatttgctatgcatgtttgtacaattctttttactcgcaagcaatgtcacttacgaaggagcagtattctcggcatgcatatcttttttcatgaatacgcgaaaggcgcacatatctcattacattaagagttttgatgtgtacatttaacttccagaatttttacacgatttgaatttttggggtgtggattgatttgccgaatgatatttctccttttgtacatgttcttttttaaaattttactgtatttgcctccttccaacttgtataagaaattaagaataacaatagcttgtgccacataacctactgactaataatagtataaaatacaaatgggattttagtaacaaagtacgtatagtcagtattatgataattgataaccatgataattactatcatttccctagcaagaaaaatacacttgatatgcatactttaatttgcataattctttatacacacaaatagcgtcgcttccaaatgaacagtatcctcgacatgaacattttcgcattacgaatctcgactctcgacgtgtacctttagcctttaatttggattgtttttccacatttttttgcacgcgttcgctaaattttacttctaacaattaattaaattggcatccttgtgtccaaaacaaacaggtagcagtaatagtaaaaacaaaactactccgtgtgtcgtaacaaaatttaaatttccccataattaaatgttggtcgctcgattggcagattggcaagatgggatgcatgtgtccggggagcaaatgcgtttgcagaaacggccaagctgcgtacgagtgaagttgacgccaattgtcaaggcatgaatgtcactgtaagctccaggggtatccaacgaactttgtctttctttctccctctcttttcttttgggttagttgatgtataacaaacttgcatctcaaaagtcagaactactataatggcatccaagaagccaaaaaaaaaggaaaaaagtcggattaaatgactcaaaaaaaagtactattccctccatcccctaatataagatattttgacatttttgcttatgttgtttgaccattcgacttatttaaaaaaatttaaaattattatttattttatttgtgacttattttattatccaaaatattttaagcaaaactttttgttttttatatttacatataaactttttaaataagacgagtggtcaaaccgtaaaagtaaaatattaaaatccctactactacggcgcattctgtcaacatgtggcttcagaacttatagctagtactggtcctagatgtagtcatgtagttgtccaaaacatctagtagtacctaatttgggttagtgactaatcaggaaataatcgctaggattatgcccttgccaaactagggatgggttacggtgataatgtactggatgttcttaattaacagcatatcgattaatccttaattaacagcacattaattcatgtagatgatgattaattgtaggacagacgcatgcatatgatggcacaatgaaaccaaacttgtttttcttgaccaaaattgcacgaaatgggaaaaatctagtacttcatggtgggtgcctaaagtcctaaaccgtgggtattatgctgcaagttatcaagctgtaccggcaaagtacctcttccactgagctagctttttcttgtttggtgggctcgtaaactagatcaactctcgtaatcatacgctctctacggtcacgaaaacatatcgttttgaacattgacacacacaacatgtacaactaatttctgttgcccgaattatttgaaaactagataaaagtaataattataagtttttttgggagacaaacttatacctatacattcatctaactattctatatgttttttttctagataataactattctatatgttattggcttcttcaataattttataatatatcacatccatgttcgacattttcaaaacatgacttgaaaatggagggagtaattgtcaagctacgtacgggaattcataagaccaaagcttggatagagtacaaaagagaagaaaaaaatctcgtttttcacgtgcgtgtttcccaaactgataaatagtgtgcacttttacgaaaagtttctatagaaaaattatttcaaaaaatcatattaatctatttttcaaatataaattaatactcaattaatcatacactaataactcattttgttttacgtattttctcaaccttcactcttcctctcctctcaaacatagccgataaggagacgtgagttggcttctagtaatagctggttgcggtgcagctgcaaccaatgcttctgaatatgcctttagagatcatatagttgtcaaccgcttcatcgtgtgtttccaccagatttaaccgttacgattatcacggagcgacctacctaaaaaagaacacgcaattatgatagtaaatatttccccctttgaagtttttactacccaaagcgacaagtttttacccccgtaacaaattaaaaataaatgagaccacatgcagccagtagcatggcgtgcaagtgggatattgagggaactcatcaatggacagttggattggttttcccactgtttgggaggcaggcggtggttccctctctctttaatgtgcccatcgctgatgccagggctttctcttccttccttggaggacaggaccacccaaaataaaactcctctgcctctgccttggctagtgaattcatacagccaggttcataatccccatgacagataaaaaaccgcttgaatgatatatttggatttcacgaaaatcgttgataaaaaccgacaaaaaagggtagaatacaaacaagtattgttaaaaaaaattatttaatttttttaagttgaaggaaaaac

SEQ ID NO: 22165 - DNA, 58941 bp, Oryza sativa
  unsure (1)..(58941): unsure at all n locations
agcctcaataagaggccttaaacgttttgactcataaattcgcttataattctaaaacaaagggcatcatcttttctcttatacttatacttatcagtcaaatttaaatttttaaccttaaatttggagttgattttggggttttttcattgaagtttatttttcagcctttgcttttagatcgctaaaaacacatatatatatgaaagttttattcacaaattatttttcatttacaaatacgccgttttgcttattctccgaataagcgaaacgatggggtccgaaagatggctccaataatttttgttcaagccaagaatgcatatatatagccggaagcccggaaatatatatggatgcgtcccattcggacgtagcgatctcgcgtcgcgtcgccgtcgggcgaggggcgagacgcaacgcaacacaagcaagcggaggcgaggcgagcgtgcgtgcgttcgtgcgggcggtcgctgggcgcgcgggcgggggggagcagtggcggcgacggcgacgggtcgggtcggtcgctttcggggcacatgcgcggggggcaggggagaaacgacggggtttaatgccgcttttgggcgatttggaaatttaagttggatcacctactggtggttgctcttttatttcttcacgggttctttcacacctttgctctgcggctgccctgccctgccctcggtgacgagctcgggtttaaagcttaaaagtttcttttaaaactcgagaagaaaataaaaagattatgttggcagaattcgaaatggatgtttgtaataatgttgcaggtgcttgtcggatgcgatttttctttttctttttctcttttttttttggggggggggggtagctgatctgtttctggaggtgtgaattgtaacaagaccaaaatgggaggatcttgggaccagaaattggcacatttaatcagcccccttaagacagcactgtgcgccagcgattgtaggttgaaacttgagagagagagaacagcacacacaaaaagacagaccagtgaattactagtactacctttgccttgtcaacaaccaacttctgtggctgttactcctactatactgtacttctgagtgcatccttccattggatggagttacaatttaaagcaaatattatgccagttttgtgctaaaagtcatctgattgggaaaaatccagtgacatggacaccctacaggcataacaattctccaattagcccaggggaatcagaaatcaatcaatctaatcagctcgatagctagttgctacgaaggagtattctcctacaggtagatctctgtttcaggctttctatgttatccgatcaggaggagcaaatgcacggacatgtaatcggatcaggtgcaaaacgcaaggacatcaagttgcagcgacaaggcacggatctccacacagttgagcgcaccaaccaacattccggactccagaggacagctctcttcttggaaagaaatgctcccttcttttattacacttgcatatggcattccacttccacaccaaatatcatccttttcaggcatgtggcaataacatcgactctttcagcaaccgcaacgcaattcaaagttttggacccccaaaaaagacaagcggctgcgtcctagcagaactacagaaaaccgtgaccacaatctgcgaacaccaaacagtggacgaaagtcaggaatagttgaagaaaaataggcaggtccgtctagtaccctatattagtacttggagaaaataaaagcagtcccttctaagtacccaatataagattgattgtaaaacattgggtgccatgagcctgtaacatgtcagttattagaaagtatcaaccataaatgtcttgctgtagatagagtgcgtctattaatggcataaaacaattctactaggagtagtttgtaaaaacagtccagtgacttttagtaaaatatacgtataattttcaattcttggatatttaacttaaatgctttcaattatccttattaaccttgattgtttaaaaggattcgtaccacaaatcatctggcaaccatgtagatctgttcactgctctacatcaatgtctgactgttcacctttattggaacctacgcgctgcaagaggaaagaaaagcaggcgtatgagagaaatatatacatactccctccgtcccaaaaaaaggcaaaccatgggttttcgtgccaacgtttgactgtccgtcttatacgaattttttttataattagtattttcattggtggtagatgataaaacatgattaatactttatgtgtgacttatctttttaatttttttcataattttttcaaataagacagacggtcaaacgttggacacggaaaccagggtttgtctttttttggacggagggagtactccagatacaaagaacagagaagcaaatagtcatagcacaaatatgatcaagccatactctcccaaatactgaaattaatagcaaagcaaagagattttcctatttccagctgtcaacataacacttacagacagtgagacaaattattttgctaacagcatataacaatttaagtgagaaggttatcatgtaaaagagcagatgtgatttaccatccgtttgcttatatatggtttcatctcaagggacaacttgttgctcttctcttcgtgaggcttatggtttttctcaaactctttccttgattcctttcttgtaccagattgccagacaccaccaaagttagggagccaactagaatcagatgtttctggaacaagttcacctcgtttttccatctccatttctgctcttctcctctctgcccatgcagctcctacacgctttgggttaagctttccagattttcctttccgagaggatggacgagcataaccactaagtgactcattctcctgatcacgctcgctagcttctaaccagggaggaggagcacccatgtgcacatttgctttcaagccttcataacataacgatattatgttaaatttcacacaacaataaggaactaaaaatagatatctttcatttgctagagctgcagcctctttctgcatccaaattagtgacatgcttcaacagaaatcgttacaaatatatatatatatatattagaaaaactgtaaaagtgtgtagtaccctgactggaatttccaccagagtttctctgttggacctgaaaaaaattaaccaaataggaagaaagcagtcatatcttaatcatgcctgacatcaatgatgtatacatgaataataatgcaacaaagtacgagacaatatcaacgcttgcaactttgcatcagaagagttgtgggtaattatgcttcttttaaggaaattggaacctgcaagctaacagagaaggcttttttttgggggggtaaaagagatactgttagcactaagatttgaaactaaaaaaaatacgtttagcatccccacaactaagatacaagatacccaaaagataaaattgacatgctcctgctttgaacgacatcgactaaatcaattttttttccttgttcgaaactctgaatagaaaacactcgcttagttgttagctttgcctcaaatttcacagcaatgaaacacaataatggataacatccaaaggaccatttgcaatacctttttatggaatatacgcatgtgcacgtgttgcttacttacatgaacagaacaagaaaccgatgaatttggtccatttccgaggatagtaagttgaccacctgtggagaaaaggataattagcaaaatactactaatcaaatggtaaaataatacagtaaggagcattttaaaactcaggttcacctttcatttttgtgcctgcactttgaaacaagtctgtacccagcataacctgttgttcatgtaatgcaaccgatccacaaggtatgatgggcactccgaaagtctcaaatggagcagaatacggaatacttccaaaggaggaagatccctggcatgctgtactattggggtagtatgccccattagtaggactttgtaaaggcataacaacattagatgcagtattactagaagacgggatgtaagtttctgcaaaattatccaaatgtttagaggtagatttatttcggatatctttcagtggccccagagatggtccaatcaacccttcggtcgacgtctcttgttctgtactcgaagactcgcagcacttctcccactgaaatatcagaaacaccacatattaatacaccctccgcggctctgccacacctgccacacctagagtgatgaaacaatgtacttggtagcataaaacagacagcagtgcaccttagcaagctcatcctccgaaatcctaaacgaatccacctgatccatcccaccaccatgcttttgcaggaaagccttcacgccatttaggtgatcctggcttgcgagatgataaatagcattgctactgcaatagaataaaattgggctcagatcaatatagcaatatgtaagcattgaaacttctttctaatttaccctcaacgctaatgtaatgttgctccaatagcgccctagccctaatgcacgggaatccgacgctactgttcaatttgagaactcctaagggcaatccgaactgaaactagaaccaacttatccagatcgaggaaaccctaggagcaaggggacgagttgagtaccaagcgaagcggctgtcgaggtcgacgaggtcggcggagcagaaggggcaccagaggcgggagcgggccgcggaggacgggtggcggagcgcgcggcgcaagtcgaggagcttggagcggaagcgggagagcgcggcggcgagggcggcgcggtgggcggggaaatagcggtggcggcggccctggtcgtggttgcggcggcacagctcgcaagtactcgaagccgccgcgggcgcggcgccccgcttcggcggcatcggcggaactcgccggcggtctcgtcggctcgccgcctccgccgccgcggcttccgcgcttgtgtttggtgctcgttcagaattcagagttcaggaggttggggatgggggctattggaatttcaattttggaaaatttcgtgccgtttggaacaaaagaaaattttccgttcaaaagaaactctttttcacattattcttttatataggagtttacataacaccggcccatatgtatttttttttcaatttgatatcgtataaatcgcgatttgttattttttattttttgctgaatcacagctgcttgacatcccagttctctaacgagtgatttccccactttgcacttgttgatcttgcatcaatttatcactctttctctataaacaactctacacatttcacacttgtatattggggtaagtacctcctgctgagctgcacatgctcccgctactccctgggttataaatgtactccgttttaacttctactagcgtttgaaatttattcagaatataatatgatttattgttttctatttagcctatcatagccacatttaaaattttaaatattaattttagagttgatttttttttaaaaaatatgttctagcattggtttttagccataaaaaacatatatagacaaaaaatatctataaattattattttagtggctaatatgtgttacgacttataaccagctataagcagaatgctcaaactctcgtctcaaccaatctcaggtttcacagccatattgtatttaattaatctactacttactcatctcaatcgatcataattatctcccattaaatttcacttacttttatctccatacaaaattatagacactcttgcaatttgagacagaggaagtttctctattgcttgtcgagagcatcaaatattttgcaaatgaactgtaagctcctatttggagtgtttaagattttaagaagcggcttgttcatagctctaaaaatgttgggtttctaagagtttattttctgaattttacagttaagtattcctggaatgtgggtatttcaatgtttagggtagttgaagatccttgaaaaaaagtgggacgtaaatcctggtttaaaatgcaagaggccggttctcgtcttccttatggatgccttgattgtacatgtgtagaaacacagcacactacaccgaccaaacgaaacgaattgaccgatattaattcgtgaaaagatggacgctcttgtagtcgtagacaactctccagagcatactattccggtcccgtacgtaagaaacgccaacgaacatccattgccgtgacacgcgcgaggcggcaggtgtcccgtacatgctcctgtgaccggcctggtaaaaaaaaaccacagtgcaacgcaaagtacacatcttactcccatatactgatgcggcggcgatgtccatccaatccaccacaaatctaccagacgtttctgtacactgtgcactgttgaggggcaccatcaatgatgcataaacaaccggcaccacattactcccaggaggcgtgaccaccgcgacaatgaatataacttgccaacttgggatggcaaccacaggacgcgatcgatgccctccggctcccccccataactcgagtggttagcgcaggtgtaccgcaaagaggacggcagaatcgaaaaccaaacgcaggaggagcagccgcgatccaggagaaactgtgccggccaacactgttcaggcggagaggagccgcggtcccctcgggaggcttccgccatacggcacggcagccaagccgcccctgtacgcagagaagggcacagtagctgatgtactacctggttcaatcaaagaaggctcacctgcttgtctcttcactgttgcgtcgagagacacggggctcagctggctgcagtgacgagctgcattggagtgatttgaaacataatcgcagacgcaacaaacgtgagatgcgttttgaatgcttaatttgagtgtgtgttagcacatagtagcgtctatctccatttgccatttgggacaggggcatggacagatatctacgtgtgcgtgagtgctctctgactatctgcacaaacttgaccaccggaactaggaataggatggatatatctacgtgtggtcttctgcacctgaacgacgatgttagttgctcttgacgcttgggacacgaaccctcactgaacttgaacttgaacttgggacttctggcgcttgacgtactggaggatcggctccttcacctgcggtcattttcacgggatcaattaaactcaacttgattacagcgccaaatgccaaatactagtacatgccaaatgccagatgtttcagttcagagttgggacatggagagtttaccgtgctggccttcctgaatcgcttgtcctgcgagcactgcgtcccgccagcaccagccaaagactttctgaccttctgcccgagaaccccactctccagggaacaaacggacgcctgctgcaaaggtatcacacagttcatcaccttcagctctacgtttgtctgtgatttaatttacctggattctgagtcgcatatggctcagaatcgtctgtggttagtaggggatcaggtttcggttatacctcgcgcacgcttgtaggagtcctgcttggatccttatccaccgtgaaagcttcctgcccgctctgcatggacacgttctgctgcggctccggaagctcccgggtgcgggtgaggtcagatccgacggactggaggcaacccatcgtcgatccatctctcatttcatggcctataaagagaaacatattggacaatgtcatgttagtactatatacgcaaagacagatgccaagtccatggagatgcggattgttgttgccattaccactcaggtggtctttgcgctcaggctcaccaggttctgcattggtatcaatggcctgcatgatgaagcagagtttcagattaaccatgaataaaatgaatgttgtggaatgcaaagaattactagataaaaacttggtgctgttagatatgattatggtaccatttgttcggctatatcgacttccagaatcttttttatctcaaggagctttctgttggtgacttcagaatgaatgacagctttgcctgtaaaatagagtgacataggccataagatggtatggtgcacagtagtagtgaatcagtcatttgctcaaagattagtactagttctattagtacaatgcatggcggcaatggtcaatctgaaaagataagagtgatgtatctgaagttcctaaaatcattagttttcatctaaagcagcaacagcttcagtacatgtatattcttcacaagtattacagttagacaatgtttttcatgaggcatccaaaatccttcttcaagagaagttgttgacagttcttcatataataagtgaacatgacaaaaggtaatcacttgaagttgcacaatctatgtagaaaatgacactcagttggcatgttgattcagttattctcctttcacagttgtaacagaattgagcaaacaatacataacttgctcctggctgacagactaaaccagaaaagtaaataatgtaccatagaatagaagcatttgagattttgcaagagattagttcaaggtgttacctagtcttcggttggctgaattcttgacatatccgtcttgcaccattttttcaatcaacttacgaaccatgttctggctggcctccccatctagcttgccatgaagtttgcctactgacacataatccattggaagtgcatggtacagtgcctgtagcaacgatatatatcagcagaaatgacatgatgacctccaaatacaagccaagggtaagcgacagagatacaccttcatatacatcagatcaccattgctatttttagttccttcagtaggtgagacattttgcatgatgacctctttctttatgtgtggtgttgtaggatcagcaatctgaagccactctatgatgctagtgatggacagtacaatatgccacagggtaaaactaaaatatagcacatgaagaaaatgtttggttgaccttattaacagaataactatccttttttgctctggatagtaaaccatctttaagtagcctctccataatatctgaaaagtgagtcattagtcaagtatttcaaggctttagtgagagtgaagaaagaatgcctggtaagcacacataagtttttcacaccactaccttcaaccatttcctgcaaagcattcaacaagatattgttaatagccagccatacagctcatacagtatatcaagatattgtttgatttataaacactgatgacataaaagcgggtaaaagtttgtgacctacttgtaagtctagcacaaaacagtaaatactctaaatagctattttattatataaatgaaataccagtaggcattaccattgatatgtcggggaaattaacaaggacatctgaaacctcaagactttcagtgtctcttgagcatatccactctcttacttgagctgttagctcttcctcgtgaacaggatcttgagtatcatctgcaaacatacaaagtcagagaaacgtatgaaattttcaggtactacagagtcagagaatgttgaacatgtattgcacacttcatgaaaaattaaatgagcatccaaacatttgaataataacttaatagttgacataaaattcatttgtatggaaaaggatgcacagatgaagctctcagatcaaattaactgaccttctgagattgtaccattttgacctttgcaagtcccatctattttgataagtatgttagcaccaaaaacagaaagtacaacaagaatacaaacaaagaaactttaccatttggagcaacaatgtaacgctctgcttcagatgggcgaacctaatagaattagcgattcagtctatactacaggtaaaaggaagacaaaaatatgcgtatacatcgaaaggtggcatcacagcacactaaggagaaaattaagagaatctcactaataaagatgctcaattatatgttctcttaggtctttacctcagtgtcagaaaaatcattatcttggtcagattcattatccaagctcatattatcatcttcactgttgacattgttatcatcacaagggtcaaggacactcttgacctgcataaagaataaaaacatatgtagcaatgagtttaattgagaaaacagaggtttcctggtccaaacgactgctatctccataatccactaccttcaaagctaacacgagatgcttgctattgacatttccaacttccatcttcaaggggttcttgttccatatatttatggcctcgttgtcagcgcaacacttaaaaaagggtggctcgtaatcttcaggctgcaaatagcataataaattaactgttttcgattccacgaacaaagttctatagaacagaaaaggttgaatccttcatttgttcagagcaaaaataattatctattatggcggcttcaagtttcagtaaatagcaagaacaaattgctgcactcactgtgacatcatcgtagtatagcagcttcattagaatggtcctctgaggacaaatacaggatagcattaggtaagttcaatccattgtaacaaatctgtgaagtgcaaaaattacctcctctggcatttggtccaaggtcctcataagtgaaaccagtgttcttatcatcttacaagcagagctcctgattgggaaccatatgatcatgtcaggatatcagcagtgactagttaaagcttacaataattactttgcaattgccatacacatataaaaaccaataaacaaccattaatgagcttatctaaaggactaaattgaaaccataccttcagaactagaattctgcaagttgtggaagaatatttaagaacaactcgcagaaaagttggactcaaaattataagcccaactatgtttttaaaaaggatttacatcatttattgccacctcacagtcctatgtacctaaatttacaaagttactggaatctatgtacctcactttttcaccacattccttacatagaaaaagaaaatctgaactccttttagtcatcaatttgctcctacttctttgaaatcataaaattttaaactattgttatgttgggactgcaacttcattaaacaaacactctccaaaatgtataatgctaagcaatatgaaaaattaaccattaaatcgtagcatttagctaagcagcatggataactaactagaagtctagaatgaatcatagcctttaaaagggatatgtatgagagaacctcatctgatcaggagtgacttctgctgcatttgatttaaatgtagcactgtttttcttgctccctgtgcggctcaagttcattgcaacttcatcaccgctcgtgttggggtagctaaatgagactgcaggggagtttgacacagaataagaaaatgtttgacatatgacccacaatcactgatgtaaaaccaactttgtatgctagaagttagccatatttcacatggtaatactcacatgcatactcctcaatcattgggccttcctccttctcacagatgcagaagagaagggtcttgagatatttcttctgtagtgcatcatagacacctaaaatttatcacaaaaatggattaaatgaacaaattggaaaattaaaaagatttaacacgtaaaacaggacatattttcacctttttccatccaatcaatcaacctcctcgactcagtatccatgggcattagcttcttaatcttcatctctgcaataaataaaagggtgttccagctaataatatcatatcatctgaggaatttggtgtataaaagggttagggactataggtaatgtgacctagtgccggaaccgacttatcattgaagtacttctcagggaatagacctctgatgtagctgatgttgtatatagcaatgcggagcaaattccttgtctgtttggtcaaaatatcaccacgttatcacaatagcgttctaccatacataattcaaagagagttcagtattcaatgtaatagaaatagaagggcaataaaatcatcacaaattggattactgattaacaagtttaggccttattggatcctggtccacccccagggatggactgaaattgtagttcagtttcctagcccatcctggagcatggcccagggttttgggcttgccaaacaaggtgaggcacaaaagttcaccaaacaacaaatgtgtcatgcttttcaatactttagcacatgttgaatcaaatagggtaccagtcccattcaaacacacacctgcaataaatttcttaacaaatgcataaatgaacatggaccatacgatatatttcacctactatgcacttgcagtcatgggatcctaagcacttctaggcaaagtgcagctgaccatgtgagcaaacaagtactagaaaagacaaagaaaaacattatttgattggatataaaccaactggttttttgaaagtacaagaggtaccaaagtttggtgatcaaccagtaatcctaaaactcatgtggcaaagccaatgtccacttattaaaccgagtatctaacaaagatgttaaaataggagtgagagtgggggctagtctaaaaatcatgccagcagaggtttaataagctggcatataattcctaaaggcataacataaattccaaattcaaatgatagcgcaacaaaataaccgattataaacagaagtgcagcttttcttatcacaaactaatgcaggattaagcaaatgtctgttcaaacccaaagtagtgtatcggaaatattttaaaaaacagaagaagaattaggtcatagaactatcagaacaggaaatctgggaataaccaaaccaatacgtgtggtactgtggtgtctcaattccacgtccaagcaacaagtttgaaaagagaaactaaaattactcatggaatctgctgctgccaaaaaaactctgaagtctaaagagataccaaaagcaagcacagcaagaattcaacgaactgaataaattttagatgcttctaacaatatgattcaaaacgattggaagtagaaactcttcacaaggctatggaagcaaggaaaaaacctttttaggccctgccaatttgatcgattcagtgaaccgtggggggtatgcacccatgattccagcatataatcatctacgcacaaatcatcaggccaatgctcgtgggtttcacaacgaaacaaaaacgaaacgggattatcaaaccagcgaatgtctcctagaattccaaccaaggtaggcaacgtttgttcaaaacccaaacaactaacaagcctactggaaacatttgaaaaaatcgactcatacgactgtcagaaatggaaatcctgaacaaccaggcccaggccaatacgagtcgtgtctcgattccatgttcaagcaagcatttcggaagcaaaatgaagttactcactgtaactgctgctcccaaaacacttcagaagagattccaaacgcaaagcacatgagaagttcaacgaactgaacaattccttagatgcttctggcgaaacagttcgaaacaacacgacttgaattcgaaattcttcgcaaggatatctaagccagggaaaaaaactttcaaccctaccaatttgatcaactacgcagactgcagagactatgcgcctatgtttccagcacgatggtctacgcacaaacaatcaggcaaatgcctgtgggtatcacaacgaaaccaaatcgaaacgcgattatcaaaccagtgaatgtctccttgaaatcccaaccgaatcaccacgcgagtagcaaaacaaagtgatgtgatccgttcaacaaaattctaatgctgagagaatcgcacaaaccagtagaaattctgctcaaaatttctgcgaaatttagcaaaccaaccagagatttttcacgagaacattatgtcaaaaaattttcacgagaacagattcggtgcctcaaaccagagaaacaaaactcacatcgatcaagcagcagggagaaaaaccaccgaatcatcattcagtgcgataccgaaacgatccatcagttacgcattcgagagatagtgctacacggagaaaccagaaaccaactccaatctgagatacccagaagcttttgaacgggcggagagcaccagaggaagtgaaacaaaaatcccaggactcatgctccaaacacgcctaaatccgcacgagaaatcggttaaaatctgcaaagcaccaatgaaatccacccaaaaacactagcaaagtgagatgctactgatgcttcgcactggccgcccaactagcaccatttggtagtcagcggacggagactaccagagaaagcgagaaacccaaaaccccacgacgatctccaaacacatccaaaatccgcacgagaaatcggttaaaatcagcaaagcaacagttaattccacccaaaagcactcgcaaagtgggggggggggggaaatccgacacgcgtgaccaccaacactcgaatcaaacccaaatcgaacgccagctactgcaaaccccagtacaccacacgagcgatcaaatccacagcgaaaaacctcccaaaaacctcggcagaaaaccctcgatcgggtgaaccgatccgatgtccggcaccgaaccaccgaaatcgaaagtcgcacgggaatcgaacaggagatgggcgaggagagaaaaaaaaactcaccagaagcagcgaatcctgctccgtgatctccgcctccttcgtcttctgagccatcacctgcatcgcaatcacccactccgatcagcacgcacacaccagcaagcgcaacgcgaaatcgaagcgagaacccaccatttcgtctctacggcggcgcgccgcgcgcgagatgagagaagggagaggggagaggagtgggagagagagagagagagagagcgagagaatttgcggggctttggagagctagttttctcttcttcttttttaagtactactgtatatattgaagatttaaagtgttatgaatttttacccgggtgcttttctttcgaggaaattaccgtacccgagcgccttttcttttgaggaaattaattaacttgtaaaacaagtactagtagtagccgtaaatttaattacgtgtctgccacgtcgacaggacgggcacgatgcgtttccggtttcctgcttccgagatttggaggacccgcctacgctgcgccagcctggcagcctgcctccagctataaaagtactccccctcgccgtgattcgccctcgtctcccaccccgctccaccgccaccgtcctccttgctcgcgtcacgccgccgtcgccgtgctcgcgtagtcgcgttcgcgtcccacccctcatccggcgcggcgcggccgcgcggcgcgccccctccgctacgccatggctcttccgacggcgaccgttgccagcctcccggagctgcgcgccctcgtccgggaggtggtcggggagtcccgcgtccaggtacgctccgtcgcggcgctgcgggacgcccccgagatgtaccttgccctctccgccctctccgtcgactaccagtggcaggtcgaggacggcgacctcgagcgcctcgccgacgtcgccgagctcgcccgcgtcctcgacctcatgctcaaggtccacatcccgcagctcaagctccagctcgtcgacgtcgacctgcggcgcgggctcctcaacgacctcgtcggcttccgcgtgaggggttctctcgccatccacgcgctcacccaggacatggcggacgatgtccttgctgccagccccatgcccaccgccggctccggtgccctgcttcttcagacgcactcccgtctcacggagctcctgctggaccgcctcctcctccactccatgcaggcgcgggctctcgcactcaggattggtcatccgatctcgacgagtgtgcaggcgctcgacgagcttctgcacaacgacatcgccaacggcgtgcgagcggaccgtctccctgaggcgactccaggtcaactcgatcgcgctctccatcgcattaccaacatgttgggatcgcctgtttgatttacctccctgtttgatttacgaacagaattttggatgtgtagtagtaagagattgtattgcttagtccccctgttttgatttagggatttgagagttgatctacgaacagaaatttggatgtgtagtagtaagagattgtatcgcttagtccccctgtcactttaaaaaacgggaatacgcaaggagcgcatctttgtattaagaggagtaaaagtctgtacaggtgaaagagaaaacacagcaggacacgggattacaggaagtcacccaagagcattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttctagatagtccatgctgcgagagtagcaatggtatcaaaacctcgccgttgagagctcggtaaggtttccctcttgtcacacaaccaggagtggaatgaggtttcattgacaggcaagcattccgagcgaccgattgccgagagcagtagccaccagagctgtcttgattctgggcatgcgaccaaaatgtggttgatgctttcctcgtgctgatcgcataggacacacatgctaaggtggggcaagcccctgatgcttaacctgtccgccgtccagcagcggttgagtgcgaccagccagctgaagtaacggcagcgcggcggcgccagcgatttctagatcggcgtggattggaacgggattcgaccgaggaacaatgcttggtaggcggagcgggaggagtacatgcctgaactttcccatttccaaataaattggtcctggtgatccgagagctctatctcccgcaaaaacgaccagagattgagatactccacgatggcctgcaatccgagggctcctcgtatatcgctttagggatttgagagttggatgtgtagtagtaagagattgtatcgcttagtcccctgtcactttagggatttgagagttgttatggttgatttaccaattgttacgatttgttgcatttaccaattgggatagaaatgaatgatgaccttcatgtatcagcaaaatctaccaactgggatagaaatgaaatgattctacgctcttgatgaccttcatgtatcagcaaattaaatccagtggctgccagatttttcttttcgttggcttgttacctgacttcttgaatgtgcaactaaccatggttgagtgttgaaatttgttttaggaattgaggtcaagctgtagatatcttgtcagcccaatgcaaccaaaaatatgttgatagtatagctggtagagcatctgtaattgaaattcaaatgcagaaacctcttattaacctgtttatcacttggtgtcaaacaaaaggtagatgttccagttaatgtcactagcaaaatttagagatgaaagacgaaaatgattcagttgtgtcctgggttaatgaagagaaacgcaagcatgtaaagttacaaaacttattggacagtattataataatgtagtaaatgaagagagaaattacataaccatctacgctggataaatgctgagaaaaacacaactaagatttaacatgacaacggctgcaaggcttcgtaacagctaatttaactgtcgagggaacttttcgctcgatgaatgtttcaattgccaataccgctctgttggcttcagtgagcatcttgcctataggaaaacatttcttgtgttcgcctgtagaacagctagaaacaccacgggttgtatctagtgttaggcacttgagtgaggttgtattgtcaagaatataacatgttagctcgatcaagctctttgcagagcagaaaccagtgatcttcacgctctggaggttgccatgacgatggtgttcaggcatctgcctcaattgcaaggaatctccaaaaattgagacatgccccatgcgttcttgtgatacctgaagatgaaaagccaatgtgcttcaattgatggttaccactgtaaatggccaatacataagtttaaagaatgaaaattaacttacatccagaaagaaagtctccaaggaaggagaagcatcaagaaaagaaaccagagaaaaataatcataggctggggaaaaagtgaccattccaacaagagaaatagtcaagcacttgaggtggaggaatttgctaggcaacattggtgtgtcgaccatctgcggaaagataatcagactgatgatattcttctaaagtactgttgtaaggatatagcaagtccataatcatttaaagtttttgggtgtacctcatgaggagagccaatggttagagtttcaagatttggcacattggatggaagctctgcacaagcataatagacagcaccaggatagcacatggataggctcttcatttgcaacgattcgccaagcaagagttgcacatgattaattccaaagtgaaaactaccaagatttggagcactattctctatgacttgcagcattctacattcaaacacttccaggtggctaaggcgttgcaacaggcaaggtatcttcacacaaattattccatagcaatagttaagttccaaccgctccaaagcataagaattagagagaacgcaccctaactcattgcctgtaatatgtacaaaggccagatgcagcctcgtcaagtttcttaattcaaggttgattgtgggatggaaagaacacctgctaagataaagatgccgcattgagcttcctctcccatcagataaaagtgagcacgggaagttgtactcatcatcatattttgaatcaaagtaatttgtgttgtacgataatatcccaagagtgagttcttcaatcaatggtgtaacagcaatctgaagccaactgtcgagataataactggtgctggcattgtaaaatataccagattcaaaccttaatgatttgatgccaatgcctgagtggtttttcagaatgcaatcaactttcttgatgaaattcaagtccggtgtttctatacgaaatataagattaggatgatatcgccagaaactacgaaaagcacgagacacgcacgcagcacgagcagcatcccgtaatggcattagggagtgtatatgactccagatgtcctgcatgtataatcaggaaaatattgtgaatgtaaactattgcctcagttggaagggaaaacagtactagcatatagggtatatccgtatagcgcattggaatttgtggtaggcaaattgaactgcatttttattttgctccttttctctttcaaagttttagtagagtctgtcctgaaaaggataccgtatgtagaccgtcgtcagtgactagtaatgataaactaatatgaaacttatgcttagttaggcaaggactagccaataatatattatatctgagcatatgtgggtaaactaagatgtatgaaatgatgtgttttttgtacaatagcatcctacaaattataaaagatagaaaataaatagaaaaaaatacacatatattctttataaggtacaattctcaacagatttggcagaaagccgatgtaagaaaccaatagctttggcagctacaccgtgagagataatagattgaacagaccaggaaaacaaaagaacgccatcctacaagaatattcacttctcccaccatttatactgaaattagagcgaacagtagtgaaaccacttcacatgaactgtgaagccagcaaaatgggcatggtttacttcaaagctttctcactctcctagtctagacatgttagttgtcaacaatcctgcaacagacatattgcccagcatctcaatgcccactgaagaagattttgagagcagaatgggatattgacaaacatttgtgccacatataactctggttaccagcagtgaccaaactcagatgtccatgggcagttctcatcacttccaagttgccggtattaacttctttatgaaagttagttttcaactgaactaggaaggcatacgcttgatggatgatgaggaagatactaaagacaaattgcaggccaacggttctgtaaacatacattaggaaactgcatctaaaccacagtaatagcagaaaaagaagtacatgaacccggtcactgataaggggagggggggggggggggaagaatctctaaaaaaccaactgcggatctaagacccatcaccaacagttttcagcgggaggggtaaaggtatacggaaaaactgatccgcgatcgatcgcaagggcgatctggtagcgatcagttgccccccctcctccctccacctgatttctttttttggcaccgcattactttcctattttagtaaatttatgcacctaaagtttatacacctcaagtttacacatctaaagtttagagaccaaaagtttatatatccgattcaaatttgaatttgaattcaaatattttttatatatagtatttctatacatctaaagtttatagacctaaagtttttagatctaaagtttatagaactaaagtttataagtcaaaagttttatatacatgtttcaaatttgaatttgaattatatctgatttaatttttaatttaaattcaaatattttctatatatagtatttctatacatctaaaatttatacacctaaagtttatagatccaaagtttataagccaaaagtttacatacccgattcaaatttaaatttgaattcaaatattttctatatatagtatttctatacatctaaagtttatacacctaaagtttatagatccaaagtttataagtcaaaagtttacatacaaattcaaatttaaattcaaattttttatatataatatttatttacataaatttttccaatttttgttttttttaaaaaattttgttgtgtactgtaacagggaagagaagaagaggaggaggaagggagagaagagagacgtacacggggaggggggtgcaggtatcacccgcgcattagcagtccccaaaggtataacagctagaacggagaaaaggtactcatgcagaacttttaggaggttgcagaaccagcactaaagatttgttcaaaaagttttactataggtgccgaggggtgcatttagaggctacttacagcagtgataaactcatagtaatgcttttcctctaatagaagtcttacattatcatcatttggtgtcatacctctggaaggttcaaccctgaatatcccattattttgccgccttcagaatttgcaagttgtagacagactgagccctttcttttagccactgaagcaataaaaaaaatctgcagcacatcacatgtgtacagacattaacaacggaaacaaaaaaatcatggtacaaataaatcagtttggttcccttgtccaacttttgtgaaagaacattcatggctataaatccaatttgtttccattagggaaaaaaaacagttcagtttagcattggtactttttgttgaaataaagaactctctcttttattctacacttctttagagcacatacataacatagtggctcgtcataggttctgcccaagcccaataggcattacagtgaaacttgtcatccagtggtatacatatttctccccaaaacttctcccaaatcttcttgtaagcaagatgcagattcttgtgaaatttcggtgtacagactgtgtagccagtttactagtttagctcaaaagagtcagtttgttctcctcacaaaaaaaaaagttaatttttttcctaagaaggaaccgtgaaacacaaatacacaatacctaaaggtttccgaataatttgctcaagaaacatatgcattaaattctgaacaagatgagagttgagagacactaaagagaggcagaaggaggtaggcttactacgggcttggatatgccgccgctcctgttgcacggacatgagccgcttgaggaccagcaaccccattgacaacacctcagctctgctagaaatcgatggcgccaacctctgatttccccctcctctcggtacccaaaacaagaaaaatcaatagtactatatcgctatttgcagaggcgaggtgagggattctcgccggcgccgacgcggactcccgcagcggaggtggaagggccaacaagccccttgtctgggtgttgttcttgccttctcggcctatgatgggctcagtcaatataataggggcaataatatggtccgtcagtggaggcccgatcacccacgagaaaaaaaaaacgattagtattggtaaaaatttgtcgacaaattttttttccgttaagatttgtcgaattttcagccgttaatctaaccttgacatccatgtactatttgtctcaacgctccatcgacacgcttaactcgctagtgctcgactaccttgtgcatccaatcgtgtagtgtacagtttcctatcaacttttcactctgccaaaaacgtataggggatgaaagtctagtaatgaagagagagagagaggaggtaagttgagaaaaaaatatagtgtaaatatagtacttttagagtgtaatttgtagtaattactttgtaactcatagtaaattacaatgttataatttctattagatttgtatgcaatttatttttttctatttttcactaaatataagttactctttatttttaactaaggttatctttaataatgagttttgtgttatgctaggtatgataaattatacatgctatttttatatgtgtattatgtaagtattaaaaaccctagtgattttggtttaaaaatccgaggtgatctataggtacttaaaatttaccccctcacataaacataaattgtttttcgtcaatatgacgctgacgtgacagtttagtcaatcaaaacaattaaagaaaataagtcgtggactcgtgggtatcactgttagtgctcctaggcccctagctctctctaaccacgcgagaaggccatgacgcatgacgagcaaaacggtggtggaagctggtcgtgccgagcccaaagctctgtgtccttttgttatggcaggtcgtgtcggtaacaccacccccgagcttcgtgtccggctatcagttgctacttgctagtcgtgtcgtgccgcccctctagatgaccaaatgggccgttcggtccggcctgggcccgagaccagctgggtcggtacggcccgacctacacgtcgggtcaagccatatccacccacgggctaataagactcttgactgtgtcaggctggtccaaaagtacaaaaacccatcgtgctcctctttgaaataagtctatttacatatgtcacctctttgggttgtgtcttatatggcttgaataaatctattttgcatccctcatctctttgggccgtggttatatggttagaataagtttatttacccccctcatctatttttacctctctgatcattggactatgtcgtgtcaggtcggcccatcgtgccgaggcagaggcccaggcaccgcccaacggtcggggtaggctagcatgggcttgactccagtcggtgcatgtcgtgcctgggccgagccaaaaccccatgccgtggggagggccctaggccttttggccatctatagccgcccctagtcaaatatgggtgatgagcaaggcaatgacaacaacgacagctgagctagcttgtcgaggatgaacatctctttgcctccttcctcctccctctctctcatccctatctctctcttagcatagatgacgaaggaggcggctctcaatgtggagaagcggcaacacagttgtggtctgaggaggcgacaggtctgcaagtcgatgacactcgggaaggcagcaacgagggaggtagaggaacgatggcgggagtggagcttgatgaggcaacgatgcaagctaagcaccagctctatgaggaagcggcgactaagctcagggaggtaggtcttggcaagacgggaccatggagctcaagcggcggagatcgatagagtggaggtgtatttggcctatagatggccaccctcccgtcacttgctcgagttcgaagcgctaacgtcgccatcacacaaggctctcccgttaaagtacaacctgctatctcctcgtcgatctagaggccgtgtagctagaagaatgggaggtagagaggagtacataacggggagggatagaaagaaatcacgagtagagaatggcaagcttgcaggtggtgggtagtggtccagtggtcctaataggagggtagcagtggcttgctaggtggagaaagtggaggagagggctagagagggtgaggaagaacgtacgcatgtatggccccccaatttgtatagttggcgctcgatatgacgtgatagtgggcctgtatagttggcgctgccgcagctgtacatataaagtactgttggtatagcctgcaacacagtgcaaataagggcagccaaacaggtccagtgtatgaaaactggtagaaaccaactgaagggtctttgaaagttagaagggtcggttatctttttttttttgagttgaggggtttgttcaaaacaatgtgaagagtcgagagggggaagtgtttgtaaaatggacttgcaagaaaaatgagtgaaatacatgtccgatctttaaagtagcatgataagatcgtttagatccttgatactgtaaaatacatatttagatccataatctctgttttatagagatggtagaaattctaaacttcctttaaccgtgtgtaattaccggcatatttttttgcactctatcctaacacacattttttttattccgactcctcccaaacacatactccctccgtattatattttaatgtataacaccattgactttttaaccaacgtttgactattcgttttattcaaaaattttgtgcaaatataaaaatatttatatcatgcttaaagaatatttggtgataaatcaaggcacaataaaataaatgataattacataaatttttttgaataaggcgaatggtcaaacattggaaaaaaaatcaacggcgtcatatattaaaatatggagggagtacacaccacggcaaagaaggccaagattccaccgtcgctcgccatcgcagaggcgtgttggggtttttccgatttgcccccaaattttggggccaatttggattgctaccaaaaacatgccctaacaatattttggtaatttaaatagtacttgtgtttgatttggattgaagcccattcattggtaatagctaatctagtttggcattatctagaacattctttactataatttaacattttgactttatgttggtagcaaaccaaatatgataaaaacaatcttaccttatcaaatatttggtagtaccaaaacttatctagattttgatactaccaaaaagggtaacaatacaaataggcccttggatatcacgcgccccctcttctcacgggtgcggctataaattggagccccctttccattccccgcaatccccccactgagtccagtccagaatcttcccacccaaatttactcctctcgttccctcccccaccaacggccgcgccgcgggtgtcacgatggcattggtggtgctcgcgatcaccagcctcgccgaggcggaggcggtggcgagggagctcggcgggccgcacagcccccacgtcgacgtccgcgtcgagtccgtcgtcctgagcgaggcacccgccatggcggcgatcatgtacgcgctcttcgacgactacggctggctcgtcggcaacctcgacaggctcctcgacctcgccggcgtcgacgagcacctctccatcgtcgccgacgtcaatctccccaggctcgcgcgggacgtgcacgaccccaacgccctcgcgcggctacgcgacagcgccgccaccatcatccgcctcgccaggagggtcggcgggccatccaccgccgcctacaccaacttcggcaaccgcatcaccaagctcgcccaccacatccaggaccccaaccgctcggtgctggagctccgtggccgcctcggcgaggccgccacccgcgtcaacttactcaggtccagccacttcgatttctgagccagacctgaatatcttcaaccgcatctcgctttttgccgtgaggattcgcacgtttcatgtgagagaacagagttcgtcccctagatttgttacgactacctgaacatgtttcaaaatgtcacaaaaaaagtgaaaataatttctgggtggtgttggtatttccctgttcgatttggtataatttgtccccccccctttttttcctttcgaatgaatgagagtatgattggttcatctttacattttctcccatcgtggatcatcctattgcttgctgtctctcagttaatggtttggaattttggatgcactaggatatgcatgatttctccagttttctattgatcccactcctttcggcacttgatgcgattagcgtgtgctacaagaatttggtggaataccgacccggcgaaaattagtttggtcgaatactatcatgtgctttgatcctgctgcattttaaaaaaaaagtaaatggcgtttacagtatacacttgcggggctctggtctctagagagtgttttttttaaaaaaaatcttttacccgagtaattttcctttcgaggaaattataaagtggaatgttcttttaggaaattaatggcgtttacagtatatacttgcggggctctagtctccagagagtgtttttttttaaaaaaaaatcttttacccgagtaattttcctttcgaggaaattataaagtggaatgttcttttgggaaattaatggcgtttacagtatacacttgcggggctctggtctccagagagtgtattttttttaaaaaaaatcttttacccgagtaattttcttttcgaggaaattataaagtggaatgttattttggaaaattaacttgtaaaacaagtagtagtagtagtaagtttaactagaaacaaaggcgcggcattgccacgcccagctgaaattcagcgagctaatttgtccaaagtaacagtaactattacttcatattaagaaggatccatcatatgcccttccaaagatctccatgcggcatatgcaccgtacgtccttagcaacttgtgattttgctaggaaccagcactactttccttgtgtaaattgattaagtccaggaataacatatacaaatactatcacaacctgacagacaagatgaggtactaagactgcatatttatctttcctaaacattatgaattactaatataacaaactcatttgccaatcaatcacctcttctgaatgtatactcaatttgtgccaaacatagatttgttgtagaatcttttcagtgtattcagtacaggctgaaatttttagagaaaccttcgacactacaattcaaagccaaatcatacaatattttaggacctgtaaactggggcctgcctacccaatcagggagcaaaaccgtagctcagcaatcaccatgaagtagttggcagcctctgattggcctgatccttgcttacctgtctcttgttttttttttttgggaacaatcaccggaggggagaggttccccacctgtattccattgcaaaagcactgaggttaagagtacaaattatctcttgttgacccagcttatacttttgtgagagggactaaagtttagtccctacttccgaaacaccaccttactatatggctgaagatagaccaccacaggtaccacttgctgctgatgttgctgtgctctagaactctttggccatggcaagtcctggagacctggagtggtggccattgtttccactttccacagcatgagcacttattgatgatggaagatggaaccaatgacacaacaataagcaaagatagacttcttctccgtgtccctgtggctagaaaattagtctccccatctcacaaaaaactcaacctaggagggtcacattcccttctaaattgagttttttttttgacagagaggatgtcacaccccagtctggcaccgccgtacaacggcacatgataggagcgtgtcatagaaaaaacggcgcgaaccgcttcctacgaaaccgcgatctcagtaccagtcccaggacatagtgctggtacccacggtgacaaatatgattcattgcaaatccttaaaataaatagatgacttatttaccttaatttaggttgcagcttagaacagcctgagaaatgcaaccgacgacgcaaacgaggaaacaccaacaacagcagcagcagcggaaccaacggactaacacccaacaccacaggcgacggctgggaaccaggacgaaaccctaatcttcactttacttcatcttcaacttcagggtggaggaactatatatatttatatagagcaagggtgagtactttcgtactcagcaagtcacgggaatttagatgtttgatgcaagcttggaagagaggcaaggttgttttgcaaatcttttgtttgaaatcattttgaaatcactaagtgaattatttctttttaggtttgggtcgaaaagagacttgcgtctcgattcggcttaagagatgcttttcaacaacttaattggtaatgtaccgacctcccgggtcagatcattacttctcggctcccagagccatttcacttgattaatcggctcccagagcctttttcattttctcgaactcccaaagtccagctgcccagcagcacaacattccgcttccactcgggaagcctagtctatgatgcccgtagacatcccgaatcacacagattcgtttctgaccactcaggtcatccatctgccacataggttgattctggttacgattcccacaccacaacaacttttcacaaagcacatgcaaataaatctacgcaacaggaaacatctcacatccgcccatgaccgtgggcacggttgttcggacagttagttaacctctgcagagggggtacactttacccacacgacattactaacccggatgtagcgcccgttccgtcgtggcgcctagcgggaaaaactatctcttaaaaaccctatttgcgaaatcagtttccttgcttgttgtctagtgtccgtgccatctcagatctcaaatccccgatctatcgtcaagttcaatcccgaatccaagtccttcccaaatcaaatccctccgcaaaagtctattttgcctccctcgggttcgatgggccgaatccctctcggcccatctccccctccctctctctctctctctctctctctctccctctctctctctctccctctccctctctctctctccccgctctgcccgtgaaccgcgtcgagctctccctctccactctcgcggctgttcccgccgatgccacccaaatcgccgcgccgcccgcgcgtgcgcgcgcgccgtggtggccgaccggccagtcgccgccgccgtcagcgcctgccgcgcctgccccgcgtctgccgcccgtgtctccgctccactccaaaccgccccgccgtcatcgccgtcgtcatcgactcggccccgcctctccccgcgcgtgcctccaagggacgggggcagagctcctcctccctctgccgcgtcgccctctctccctcctccttttccccaaagcggcaaggaggcaagccctctttctttccccctttttcccttttccctcccgccggcgtcatcctccccccctcctgtcgccgttttggccgcgagcgccgagcgccagctcgctcccttgaccgcccaaggtcggtttccaaaccgacatcgccgccctataaacccaagcgcctccctcttttccctcccaatcttccccgtttctcgcccgcgccattgctgtctctcccgccagccgccgccgtcgcgtgtgccggaggagccggtgcgcgttaggacgcggaaggggactccgggcgctcgccttcttcctcttccccgacccgacgccggagagatcactcccgtgccgtcggcctctcgtcacaacgccccgcctcatctcggtagtgcatttccccgttctccctcctcgatccatctcctccccttagttttcggtagtagcatgtgtagccttcccgtagctagctagcgccgccccaaccgttgtcgccgctcgctgtgtgctcgccgccgtcgccgccagtgctccgtagcgcccgctcgtcgccggccttgctcagcgtagctccacccaatccgacgctagcaacggattcccgtagccgcgtagatgctctcaccgccaggaatcgacccctcatgacctcatcgccgtttcccccttccctcgccgccggttgccgccgccgtcgagctccctccggcgaatccgagccgtcggctcgtctcccctcatcctgtgcaacatcccggtgtgctcgccttcgcctgtatcgccctggttcgctccgccgctcgccgccgtcgtccgccatccgttccgaccggcgtcgtcttctacctcccgccggcccgcgtggcagccacgtaggcgccacctcggcgccacctcggccgcgaccggatcggctgacctggccagccgctccctccgtttccccccccccccacgtgcgcgtggtccacggtgagccgtgaggctacgcgtgcgcccgccgcaccgcgtcctccgcgaaccgcgcgcatgcgccgcgtctccctccccaaaccctagcacgccccgcgtgcacctcgctcacgatgagccgagtcgccgacaagcgggtcccacccaggaccacgcgggatggacccggcccaccggctctctctctcccctcctcgcccgtgcgcgcgccttgggccgccttcttgggccggccggcccattaagctcggccgagccgccccattctctcgggccgcgccctagccgcccgagggaagtctaatttccctccctcctccttttcctttcttttctttttcaaaaaggatttaaataaatccttttcctttagaccaaaaatccaataatctgagaaattcaatatcttcccaaccgtaagtccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacccgtagtgcgaggatttcgaggatcaagctcaagatctcgagcaaggcaagccacccttgaacatcttgagcctatatttgaacttaattatgttgcttgaaaaatattatgcattgataggatcgcacttaatccgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagatttggaaaacccgacacctgggccggtgcttgcgaactaaatgaatttccaaaaccgcggaccgggaaacgtaccgggtgtacggtttcccgctcttgcacttaaggaccgtttccttggaatttcatccgaacataagacaagtgcgaccacatgggtgaaatgggacacccctgactgagtaactagcttatcgggggagccatgatgctaagagacatgtggattcgccggggtggtgtcggggaggacccctgggcttcctggcatagtatggtctgagacctaatctggtgttggtctgggacccctctcgttggcatatggtgaacctgtgtcggctttcgaaatgccttgtcatgaaatccttaaggtctctagtcgtggccgttctgcacgggctggatgattcgggttagtaatgtcgtgtgggtaaagtgtaccccctctgcagaggttattaaaactgttcgaacagccgcgcccacggtcatgggcagatgtgaggtgattcctagcgtagttttgtttgactactgctttgtgaaatttgctgaagtggtttgggattgatgtttggaaaatctgcggctgatgggatcagccaggcctgggtggccgtttgaaagctgttggccgggtgccaatcttgatcaattcaaaagactgatacattgcatatactccgaccggacgagacgcactgtctcatccgtgtcgtttgagaagcactcacttagttgtttcagaaaagagttcaaataaaatcaattgcaaaaacaacagcccttccttgaagcctgcattaaacacttatttcccatggcttgctgagtactcccgtactcacccttgctctatataaataaccccccagttgctgaagaagatgaagcggatcccgctgacgaggagttcttctaggagcaagccggttacgatgagttttagggtttcggcctagttctcaagtcgcgcctgagatgtgtggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttgaagcgtcacgggctagttccgctcgggactagttcggggcgtgacaccggatcacccagctcgtgagatcagccacgtcgggagaccttaaggctttcatgacaaggcatttcgaaagccaacacaggattgccatatgccaacgagaggggtcccagaccgacaacaggttaggtcccagaccatactgtgccaggaagcccaagggttctacccgacaccaccctgttgaatccacatgtctcttggcatcaaggcttccctggtttgctatttactcagccaggggcgtcccattgcacccgtgtggtcgcacttgttatatgctcggatgaatttcccacaggaatcggtccttatatgcgaatacgggacagtgccacacaggcacaacccccgcatcgcgagttttcacaatttattttattttcaaacacgccgacaccacatgtcgggttttcaaggcttctcaaacccatttcccaagttttcgacaatcaacggtgtatgtgggatatttggtatacgcactcagagagcacgaataccgaggtaccacaagagtggagcgacaaggaatcagggtagtacagcctataggaatttgtgcgactactaggtaggtccgtcggtttagcacgcaaaccgaggccaagcaagttaagtgtgtgattctactaatgcaagttgcaacaaaataataatgattttccaattataggagcaattggtcaaagggtgacttgccttgctcaaggtcttcacgaagctggacgagggatgtatattagactttttcgggcggcaagggcgcggcccgagggttgaaggaggctcggccgagccatttgggccggcgcgggcgcggggaaggtggcccattagggcgcgcggaagagagagggagcggtccggtggaccgagtgcacctcgcgggttccaggtggggcccgcttgtcggtgacacggcccacggtgggatgggcgcccgcgagggcggcgctagggttcggtggggatggcgcacgggcggtgcgccggatggaccgagacgcgtcgggcccacgcgcagcctcacggctcgcggtggaccgcgcgcgcgagcgggagacggagggagcggctgaccggggtcagcttgacctggtccggccgagctggcgccgacgtggcgccttcgtggcagccacgtgggccggcgggaggaggaagaaggggaggccgagatggacggcggacggcggcacgcatcggcagaacggcggcgaggcgcggcgagaggaagggggaccacaggagcgatgagcggagcgaggaggagcgagccaacgggacagattagaagaggaagggccgacgacgacgaatcgtggcagaggtcaccgctggtgagaggaagagggaaactcgccgggggggagagggatcgattcacggtgggggaagcacctccggcattcaaggaatgtgtttccggcgccggatgggacggaggtgcaccgaggagggccggcgacgagcggcggcctccgggagcggacgacaatggcggcgaggccatgccgggcggcagcggggctcggggcggcgtccacgcgcgttcgatagagctacgggtgctagctcaaaagataagggcacgagagagagcgggagggagaacggaggaggcactaccgagccgggcgcagtgatgggcggccgacggcgcggggcgagctctccggcctcgggccggggaaggggaaggagaagggtggccggagtccgcgtcagctcctcgtgcgcacgccggcttcaccagcacgcgcgacggtggagggaggcgaggacggcggcaagatggcggggatggtggttcggcggcaatggcgctgtgggaggaaacgagtgggaggtcgagacgctgagggggctcgggtttttatagcggagggggagaggtcggtttggaggagggaaaccgacattggcggtcaagggatgcaggggcgacgagctggcggtcgtcgacgcgtgcagccaaggcggcggcaggtgatgacgctggcggtgtcgggcaaaagtggaaaaggaggggaaaaaaagggggctctgctctttgccgagttggggagggagagggatgggagcgggagctcggcctcacggttttggcaggacacgcgtggagcggctcgggcatgcgctgcagagctcgcggcaggcagcggggccgagcggcagcgcggcgcaggcgctgacggtggcggcgaccgggcggtcggccacgaccggcgcgtgcgcgggaaccgaaggcggtggcgggttcaaatggcggcggcgggaatcggtgacggggagagaggaacagagagagcgagagagagagagaaccgagaggaaggagagagctttctctcccgagcggctcgcgtgcggcgcacgtgagaagggggaaggcagctgagggagggaggagggctgagggagagaagtgggctgatgggaggaaatccggcccatccaaaacaagaggaggcaaaatagacttttgctgggaaatctgatttggagagaaatttgatatggagtttgaatttgaatgcaaaatgggaatttggatatttttggagtcgtgcggatatttggcaaggttttcaagagaggatttgaatctcgaatacttgaatcggaatagggatttcgaggagaaggatttgatggcgacgagagggatcaaggacagatttgaattgagatccacggcacaacttagactcgcacacaaggaacaaaaattttcgcaattaggattttgccgaattagtttttaacgtctcacgaaaagcggagcgttacagaggagtagtaagctggtgtgtgcaatgtgttataggcttatagctagaggcttaataaaggggcagtaaaatgtggtagatgctacttggaaaatcatctagcactcctatctgaaataaatggacatcttggcatcacctccctatcgccactaatcacctagtaacttgcatggaattcggtataagagatatggcctttttttaattaaaaaataaacatgtgtttagaaccaacagaatgagtacaagtttgtgttaacatgaaaatgggatagtatacatgaacgtattaaggaaatacatcaagctgctaattaaggacaaaaaggaagagcacatgatcaagtgagttcaacaggcaacagcaaactttacttccatagtttcactatcatcttaaacactgctatgatattctctgtcctcaatgcgactgtaccagataacaacacaactcttgttattattcgtggagaccccatattgcagaatttcaatcacttggtactaccggccactactcccagccaaggctccgagcatcaactactcgccaagagcttcagtcacctgcccagcactgcgcagcccagatatcatcatcaagtaggtgaccatgtctggctgtccggggctataccattcgccaccatccaacacacaacctcattggcagagtcaaaacaatcactggaggcgtacaacccgacgagcatcgtgcacgccgagtcgggcgaaatgccatccgcagccgtagcgtccagcacggcgagcagtgcgcccgggtgggaagcgtaagagagcgccgcggtggccgtggtgaagcaggcgtgcggcgccggaggatgcccatttcgtcgagcaggtggaaggcgcggtccgcgctcgcgccgttccccgacttgtagttgcaggggttcggcgaccgtagtgcggctgtgtcagggtaggcgacgtaggccggaaggacagctgcttggcgaggtcgacgaatcggaggaggaaccggtggtctcggaggaggaggcgatggaagggggagcgcatgggtggtgcggaaggaggatgcggcggaggcgacatctatcggagagcggtggttggttgtagccttgcaggatgcagctcacggcggagcgcgctacgtttgggcggcggacaacggccgaacgacgggaggagcagcgctggcggcgaagcgagaggagtccgactggcggagctgccgaagatggccgagttcagattaacgcttttgcaaaaaaaccctccgcaaactacgtactccttccgtcccataatacaagagattttgagtttttatttgcattgtttgaccactcgtcttattcaaaaaatttatgtaaatataaaaaataaaaagttgtgcttaaagtaatttgaataataaagtatgtcaaaaaaatgaataataattccaatttttttttgaattagacgagtggtcaaatagtgaaaaaaaactcagaatcacttatattataggacggagggagtatattgcaacgaggtccaccgcacgagatgagacccgatggctgcgcgcgactcaatccgcctgcgccacgtggcgccgctaatcgcccggtaatttgcatggaattcggtactcctgccaccctcagaaatttctagaacagcctacggctataactacacgccatgttccgtggcatgcctggtgacctgtaaattctctttcctctcttggctgagtttgatgagaaggggattgataagattggaaagatacgcaaaacgagatgagtcattagtgtatgattaatttattattaactattttaaattttaaaataaatcaatatgattttctaaagcaactttcctatagatttttttttcaaaaaacacactatttagtagttcgggaagcgtgcgcgcagaaaacgaaacaaacaaactcacaatgtcattgtgccgaacacagccggtcggctgtttgccgacccggcgaaataattcccagaaggggagagagactccgtaatctatcatggtctttggggttaatgaagagaacgtgaccaatgtaaaatacaaaattaaacattgaactgtacaaaatatacttagtaatttgagacagaaattaaagcatgagagaacaaacacacaagataatcatgttgaaaaaagaattacaactaagattcaattatatggcaacgggggcaaggtttcacaacatttaacttaactgtggaaggaacttttcgttcaatttatgtttcgatagccaacatagccctgttggctttagggatcatggccttgtccataggaaagcattggctgtgtttacctgtagaacagctataaacaccacgagtagtatccagtgtaaggtactcaagtgacgttgtacagtcaagaatacaacatgttagctcgatcaagctcttcgcggagcagaaacaagtgatcaccacactctggaggttgtcatgacgatattcttgcatctgcctcatatttgaggaatctccaaaaattgagtcatcctccatgctgtcctttggtatctggagatgaaaagccaaatatactttaattgatggttactaccatagacactagataactttgcagaatgaaaattatcttacacccagaagtaaagtctccaagaaaggagaagcatcaagaaaagaaactagagagaaataatcatatgcatgggaaacttcagcaagatcgatagtcaaacacttgagatggaggaatttgctaggcaacattggtgtgttaaccatctgcataaatatgatgatcatcagactggagacattcttctaatgtgtaagtattgttatatgaataccgcaagtgtattttcgagtttttgagtgtacctcgtgatacgagcaaatggtgagagtttcaagatttggcacattgggtatagactctacacgagcataatagacagcgttgcaatagtattgcaaagatagtgtcttcatctgcaacgattcaccaagcaagagttgtacgtgtttacctccaaaatcaaaactgcaaatatttggagccttattctctattacttgcagcattctgcattcaaacactttcaggtgattgaggcgttgcaactgacaaggtaccttcatgcaaactatttcatcacaatgctcaagttccaaccactccaaagcataacaactgaagagaaggcaccctaactcatctcctgtaatatggacattaaacagatgcaacttcatcaggcttctcaagtcaaggttgattgtgggatggaagctacaactgccaagataaagatgtcgcattgagcttgctctcccatcagacagaattgtgcatggtaagttgtactccacattttatgaataatgagatagcctaagggagagtttttcgatccatggtgtaatagcaatatgaagccaactatcaaaatgatggctgatgctagtgctccttctagtattgtaagaactatcatattcaaagtttaccgacttgatgccaatgcctgagtggtttttcacaatgcgatcaaatttgttgatgaaatccgagcccagtattccaatacaaaatataagattgggatggcattgccaggaacgatgaaaagcacgagacacacatgtagcacgggcggcatctttgaatgccattagggagtgtatatggcaccagatttcctgcatgcacaagcaaggataaaagattaaaaaacaaactattgtgaaggtaaacaactggttctattggaagagaaaacaatactagtagcttataaggcataggagcactaaagatccattcacaaaattttatctaggtgacatactgacataggaccaccggtgtgcacagttagaggctactagcagtcatagactcatagtgaatcctcacttctaatatcttagaggctacttagagtcttccattgtcggcttttggtgacatacctctggaaggtctagccctgaatatcttgtttttttgttgccttcagaatttgcaacttgttgacagagtgatccctttcttttagccgctgaatcaatcgaaccgtctgcagatacatcaggcatggttatgtacagacatgaacagggaaataaaatagtaaggtggtgtccttaacagctgtcctatacccaaaacctccttatatgctttcaaccaaagcagggtactagtaatctcttgcttcaatagaaaaaagtagtgaactgtgtcaagttcttgcttatattggtcattggaagcaacaaatgcaatatagttttatgggtgcttagcttcatcggttcccccatggagacattgcactccttcctagttcctcccaacttaaccccatatttacccccatacaacccatactacagtaaaactaggcacggaggctcccatgttatctttgggagatttgctccgatccaataaaaagtacatcgagctaccggtaccgtgagacatcaaatcgtttttaatcgttggaacggagcaaatctcttggatctaacaatgccaatcctacctaactagatctaacgatcaaaaatgatttgatatcatgaggtaccggtaactcgatatactttttgctagaccggagcaaatatctatcttttcacacctaaagtcgatctcatattttttttagtgcatggatgatgacagtcaaaataaacattgctcatcgcactactgcacgattgattttactggatgcccccctttttgtttccatgcggtccataagtggaaccacacggaaaaatagggaaccggcgctagggtgtcgcccgcacgggaaaattgattttccggtgcggacgtcctaatccaaccacacgggatattcctccctcctttccctcacacccacttcaaatttttcctatctctctcttcctttttcccctttattccctctcaatcactcccctttctctctaccttatctcttcttttatcccgtcctctctctcagcctccctcaaccctctctctataccttatctcttctccctcaaccactccctcaactggctggggcgaggtggcggcgctcgggcgcggcggcggcctaggtgaggcgggggccaggccgaggtggtggccgggcgaggcggccaccgggccgaggccggatgttgggcgtgaggcagccgtcgtgccgtggtggcatgatgggcgaaggcgggccgccgggcccgaaggcggcggctggtctgatgcggcatgtcgggcacggcnggctgactgggcgaggcggcagtcgggcacggcggctgcctgggcgaggcggtggccgggcgcgacagcgagcagtgaggcggccgtcaagacgtcgccgagggcgctgaccgcatggccctcaccgtcgacgaccacggggctgtcgccgacgacttctgcggcgccaccgccttaccttccaccaccgccacaccttccaccaccttgtcgagaacgcctacctcccccacgtcctcgccgagggccgcgccgtcaccgtccgcaaccgccagcgccgcctcttcaccaacgggtggcggcggtcgggcgcggcaacggcgtgggccaggcgccggcgagcagcgaggcaaggcttcgtcgtcgcttgtcgtcctcctcatggtcgtcacgtgcatcgtcaaggcagcgatgcggcggccgacggcgatttttgcttttttttttttggttttttttttgttccgggtggaataacacaaccgaacggatatatcggtcgttctgcccgcacacaaaaatgctgattttcacagacacccggctgcagacgggccgtacaaccgcacggggaaatcttgtctgtagtagtgtcggtctaacaaaaagaaaactgcgaatatcacacaaacattgccgagtaaatgttgttgcgacggccgacagtaatatgaacaggttacagatggcaaagacggtatatatggagattagattagagaggcaggaggcacgatggagggaagcttaccacggcctcggatgtgccgccgcttccccatgacgctgacgcggcggagggatccgatatcaagcagagaaatcgacgatttcgccgctcttctccctctctctccgcctatatatttcgcttgttcaaggggagaggaggaggaggagatgagaactcgccggaggccgtacgtcgtcgtcgccctgatctggagcctcgcggagttgcgctgctaggtgcgagagaaaggagatatttaactcatcgtaatatggaacggagggatttgtagtactacggtctgatactctgatctattcaggttcatagtcctaataccgaataaaaaccttccatagatgatactagtatctttgaattttgcccagatcattaatgaactgataaaatctggacaaatgtcgttttaataaaaaaacaaaaaaaatcagcttttttttttgacttacggagaaacacgtacggccgctgcatcttatccagtcctgttaagtttcttctcattttcctagcaaagatggcgattctgacacttcgtttgtcggatgggaatgtttggtcgcaccagtcattgcgagattagatcttactctttactctctccgtcccttaatataagaaattttgacatttattatattgttttacctttgtcctattcaaaaaactttggaattatttttttttgacttgctttattatccaaagtattttaagcataactttttgttttttatatttacacaattttttcaaaataaaacacgtgatcaaacagtacaaataaaatatcaaaattccttgtattaaggtacaggggagtagtttctttggttttccttcctttatcatgtccccttccccccttttgtattatccctgtaaataacttttacttctccttgatacaaaatgtgcttcttatgtattccaaaaaaaaacattattttcattttatttgaatcttggtcgttcatattttctaatgataaaacggaaacttgcaaatattctccgcgcgtcagttttggttacacctttttttttgttaacctgacactttagaacaaatattttcccttctttctgttaatataagggaacttgcaatacatctgatgcaccatggttaaaatttcacaagcaaaagttatagtaattgtattatcctgttcaagatttgatgataaaagcaaaactatataattatctattggacagttctaattagtagttcaagagagaaagcaccggacactttaaaatcaccgaattaccaagaaaattaagttgaagaaaaataataattacaaatatgattcaacagcatggcaacggctgcaaggcttcacaacatttagcttgaccgtggaaggaacttttcgctcgatgtatgtttggatagccaggactgcccttttggcttccgttatcatgattttgtccataggaaagcatctgtcgtgttcacctgtagaacagctgaaaaaaccacgagttgtatccagtgtaaggtacttgagtgcaactgtattgtcaagaatataacatgttagctcgatcaagctctttgcagagtagaaaccggtgatctccacactccggaggttgtcatgacggtgtcctggcatttgcctcatatgtgaggaatctccaataatcgagtcatgctccatgtggttctgcgatatctggacatgaaaaccaataataaactttttcatttgatgggctagtcacttaatcataagtttgcaggattaaaattgacttacacccaaaaggaaagtctccaaggaagggcaagcgtcgagaaaataaaccaggtaaagataattataagctggggaagatgagataatggtatgatcaatggtcaagcacttgagatggaggaatttgctaggcaatattggtgtatcaaccatctgcataaaaagcataaagatcatcaggctgaaggcatgaatattgttatatggacatcacaagtctatgatcatttatgttttttgagtaccttgtcagtcgagcatcagagggtgagagtttcaagatttggcgcattggatggaagctttgcatgagcataatacatagcatcggggtagtgcaaggatagtctcttcattcgcaacgattcgccaagtaagagttgtacctgcctacctccaaagtcaaaactgcaaagatttggagccttattctcaactacttgaattctgcaatcaaacacttctaggtggctgaggcactgcaacagggaaggtatcttcagacaaattattccattgcaatacataagttctaactgctccaaacaatgagaatttgagagaaggcaccctaactcatctcctgtaatatgtacattaatcagatgcaaccttgtcaggtttctcaagtcaaggttgattgtgggatggaatccacaattgccaagataaagatgccgcattgagcttgctctcccatcagctagaagtgagcatgggaagctgtactccatattgaatgaagatagagataggctaatggtgagttcttcgatccacggtgtaatagcaatctgatgccaactatcgaaatgatggctgatgctagtgctccttctagtattgtaaaaactattatattgaaactttaccgacttgatgccaattcctgagtgatttttcataatgcggtcaaatttgttgatgaaatccgagcccagtattccaatacaacatataagattgggatggcatcgccaggaatgacgaaaagcacgagacacgcatgctgcacgagcagcatctttgaatgacattagggagtgtatatggcaccagatttcctacaagcactagcaaggataaaagtttttttaaaagaattgtgaaggttcaattggaagggaaagcagtactattagtagcttataaggaatagctctttgggatttgtggtacgcaaactgaacggcacattttcatttttctccttttccctttcaaagttttcttagtggctatcgggaaaaagataaagcagattgtagccagtgactaattatgatcacatagtatgaaacctattcttgcttgaagtatgcagcggtagtcaacaatgttatgtatgaaatgatgcttttctccctacaatatcatcctataaattagtcaaaggtaatgaagaaaaaaataaacatgtatcttaaggacaaatcgcacattgggggttctggtaaacataaacattgatcatcaggaaactggtcgagaccagagtaatcacataaaagaagtacaggaacccgctgataagtgaggaagaacctttagaaagtgaactgccttaacaagattattaaggtgacgccatcacaaacaattttctgcttgagtgataaaggtgcaacagctagaacagagaaaaggtgccctcatgcagaattgtagaagattgcagctataaatatctgttcataaatctggatcaggctcctctaacttcaaaggcacgtgcctttgtcactaacatgtaggcccaatgaaccatggacccatctgtcagtgacaaagacatggtacctttgagtttgaaggtagaggatctcaatccttttgatctagccaccatatgaccaccagtgtgtagttagagactacttagagcagtcatagaatcatagtgacccactttgcttctaatataagtatttcttatcagcattaggtaccatacctctggaaggctaggcactgaatatcttgttcttttggcgccttcagaatctgcaacgtggtgacagaatgagcccttccttttagccagtgaagcaattgaacaaacacatcatttgcgtggttatatgcagacatcaatcaacaggggaaaacatcagatcaaagcacatgaatgaacacgaacaattcaatttggttcagttgtccagctttttgtgaaaagagcgggtattcactccaatttgtttcattacttcctacaaatcaaattcaaccgagcattgctaccttttacctcccaaaagaaaaaaacaattctacactattttgttcctaaattccacagatcataatgtcccattgccccttcttgaattgcttgcaagcgagatgctctttttttccccaaaaaagcaatcgtggctatcaaacacaattgctgaagaagaagaaggtaggagagggagggctactgcggggtcggagttgccgtcgccgccgacggcgatgccgctcctgtcgcgcagacatgagacgcttcggatccagcatcttccccatggcaacgcggcgaatacctcgccggaattcgcgccgtcgccggattcgcctcgctgccaccgccgcagcagaggtggagtccgaagacctaagggcaaagggagtccgacatgggccggtcctgtgctgatatgggctttctgggctgtgatgggctcggacgatagagtccggccttcacaaccaggcccatgtcggtggcagcttgacaaactgagtctattcttttttgttaatgaaattcatttctgatcttcacttcaaagaaatcacaactaattactacaaggttatacacggctataaaattagaaaaagtgatactacctccatttcatattataaaacattttaactgttttagtcaaacttatttaggttcgaccaaatttataaaaaaaatattagcaacatgtacaacaataaattaggttcattagatgcaacattaaatatattttgataatatgtctgtttagttttataaaatgttgctatatttttctttaaacatgatcaaacttaaagaagtttgattagaaaaaaaaatcgaaacgagttataatataaaacgggggagtaggcacatgaatactagccgaggcggatcaatgttacgttgacaattcaagagatggtgaatgaccatgcatgagattgaattagctgcaaattaagctaaagggacacacttggttaagggtatgtcttcacataacgtgttgtagaagtgattagagcctttgatgttcagggacgaatatactccctccttccctaaatgtttgtcaccgttgacttttttaaacatgtttgaccgttcgttttattcaaaaacttttgtgatatgtgtaaaactatatgtatacataaaagtatatttaacaataaatcaaatgatagaaaatgaattaacaattacttaaattttttgaataagacgaacggtcaaacattttttaaaaagtcaacggcgtcaaatattttaggatggaggtagtatatagctagtctgttgcaagtcaataccctcggagaaactgccttggatgaaattccttccttccctataaattattacaccaaactatacagataacataggcagtgacacgaatcatggcatatccgaagcataactcgcaattagtccgcgacaccgaccaatacgcaaataatctaaattcttacgagtacgtgacatgggatcagcggatatatcatatatgaaccggctaattaatctaaaactctaaacttcataactctcttttctttccccaagactaacgcaaaatcatatacacacgcaaaatttaggaggaaattgaacctatcgatttattttggccgtcgaatgcatgctgagattatggatacgcgctgaaagcctgtttggcacagctccaacttcagttccacctctcctcaagctggagctcagccaaacagtttcagctccatctaaaattagtgtggagctgggtggagctctctcacaaaatgaacgagaggtggatttaggtttaaatagcttcacaactccactccagacttaactcttgcagctaaatttaagagttggagctttaccaaacagaccctatgattcgtgtaagttgtaagggagaaaaatcgcgtgcgggggatgactataaaatgcccttgctccagagcgagcaaattaagcaaaagaacttggtgggcacctagcactagcagcgactgtggtatatatgggaggaggaggcggcggcggcggcgcagcctggctggcgtggctgctcgtcgtcgtcgcggccatcgccgccgtggggcacggcggcggcgtgcagccgctgtcgcgggtggccatccaccgcgcgcgcgtcgcgctcgacgcgtccgccgccgtgcgggcgtcgccgtcgctcctcggcgcgcaggtacgtacgtgagcgtgcgcgtcctttaatccagcttttgctgtgcgccctccgttcctgccgctctctgcgttctctgcaacgcacggcaaagctactacctccgtctcaaaataagtgatgtcataagtatccgtctcaaaataagtgatgtcgtaagtatctgtgttcaacgtttaaccgtttattttatttaaaaaaattaaaaaaaatagtcacacataaaatactatttatgttttaccatctaataataaaaaaataatcataaaatttttttaaataaaatgaacggtcaaacgtttgttttgaaacgagtgaagtactcgaccacactacgcagtagcaacattgcgcgtacctaattaggtatactcgctccattacatcttacaagtagctttaaccttttctactcaaactttttttgagtttgatagtatcactagaaacatttagctacatttataacatcaaatttaaattagttttattaaatttaacatttaatatattgtgataatatttttgtctttgttgctataactttgtataaatttgatcaaactttaaaaaaattgattagaaaaagttaaaataacttataatgttaaatggagagagtttgcattagcttctcagttggctactaccccgtatttcgtaagtgcattatccaaaccattaagttatatttttttaaaaaaaacttttgtacgtaattttttattaaattatgtttaatttataataattaatattcaattaatcgttgggtaataactgttcgtacgtaccaaggaaaagccatccattccgttgtatcaaaccgagcctagcagtgtttgaggaaaaagaaatgagaagatattcaaaacgagataaacaattagcacatgatattttaaacttgaaaaataattactatgaactatttaaacaagtttcctatatttttttaaatttaaaagacatattcctccatctcaaaataagtgcagccgtatgattcaaatttgaactacagcgttacacttattttcgaacgaaaggtgtatcgtttaacagttttaaaaacatgcactactgtaaccactcatctgaaacgcagccttagcgacaccacacaagccaagcctggtttagttcccaacgttttcttttcaaacttctaacttttccatcacatcaaaaattttatacacacataaactttcaacttttccgtcacatcattctaatttcaattaaacttcaaattttggcgtgaactaaacacacccgagcgatttacttcaaattttagaggatcagatccgacgaaattcaaactaatcaaatgaaagtgtaaaaatccttcatcacaagtaatgcgaataaaaatagtgaccggtcaaacaataccgcgcgtcgagtcaactcccggccccaaaacttatcaatctgtccccgcgcatgtgaactcaaacccatccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaatggcgatgccgctgggtgggattctcctcctcttcctcgtgctcctcgccgccgccgcggcgggcggcggcggcggcgtgtgggcgttctcctcgtcgtcgtcgtcgtcgtcgtattccaggatcggcgagcagccgctgtcgctgatcggcatccaccgcgcgacggtcggcatcgacgccgcggcttccgtgcaagcgtcgcctcggcttctcggtgtcaaggtaggtacacactcgtctcttcgccctgctcgccggaatcccgagctccggcggtggttcgccggccggtttcgtcttagctcagctcgccgttgtgtttggcgcggcgaggagagacgacgacgtgtttgcgcgatgaaccgtacaaaatttggatagataagccaatcgccgtcgccgttgcagttcggaacgaaatcaaatttctcaatatctcaaacatctcctaatgatatcaatcgttcttcctctcgccagattggattttcttttttttttaaaaaaaatggagaagatgattacatcactagcctctgcatgagtcatgaacaaaagctggggatcggggccctgtttagattccaacatttttcttcaaacttctaacttttctattacatcgaactttcctacacacataaattttcaactttccgtcacatcgtccaatttcttcaaaattccaattttagtagtgatgccatgtttttagtggcgaaatgtaccatggatattcttcgaaattgattgattgattgattggtggatgggtttgagtgtattgcccatgcttgtgctagattgctagtgtggtcacaggccacatggaattgcttcccacgcctgatagggtcaaatggtatttgcttcgactttccatttgtcagtgtacggttttgatgcactacgatctgcatgattgatcccatttcgtttttatcttaaattattgttgctcctattggtattcgatgtgatcgaatcaagatttgtctcctcgtaaaaagaaaatcaggatttctttgacccatttccattgtttatctgacactgttgtggatacagggggaagatactgcctgggtaactgttgatttcgcagctccgcatgcgagtgacggcgattggatcggagtattctctccttcaaatttcaagtatgaaacaagtatatttgccatggatttcaaaatttgaatagtgagaccatgtgatgtgagtttgtagattacaatcacaatgaccatgatctgatgaactcttgcactttcctgcagcgcgtccacatgccccggtccttctggatcagactcaggacctgttatatgctctgcaccaataaaggtttgtaggaataatagcatcatgtttgtaaaagttctgcaaatgaactcctaaactgattttttttgtatgtctggtttcagtatcagcttgcaaattattcttcagattatggcaagacaggaaaaggcactctcaagtttcagttgatcaatcagaggcaggacttctcctttgcactgttcactggtggtctctcaaatgtgagttcaaaacatcacattgtaatttttttttagataattcacattgtaattttatccagtccttattactaaagaaatggcaactgacttaatgtatttcatttccagccaaagcttatcgcagtatcaaataagatcgccttcgcaaacccgaaagctccggtttaccctcgtctagctcaaggcaaatcctggaatgaggtgaattatcttcttctctctgactcacatttgcaaatcatcctcttctctctgactcacatttgcaaatctagatatacagatctaatatgagatgcatcctagcttaaaacgtcaaatctctgaagaatttgttgctttgtcttgctagatgactgtcacatggactagtggttatgacatcaaagaggcatatccctttgttgaatggggcatgaaatggagccctcctacgcgcacagcagctggcaccgtcacttttgatcgcgaaagcttatgcggtatggaccgtataaaagatcccttttatgcattatcttctgtatatgcatataatagcatgaaatttgtgaggagcttgcaaaaatgtcaaaattacacaatcctagatgtccaatcttgatgccctgatgtggtttaaattgtctgaagttagtacattgtgttcctcacagtagtttttgcttgtgcaggagaacctgcccgtactgttggttggagagatccaggtttcatacacacagcattcctgactgatttatggccaaataaagagtaaattacttcctatggctctatcaacattttttttcaattgtgaatactggtcttctgactatgccatttttcctgctagatactattacaagattggacatatgctacctgatggaaaaattgtatggggcaaattttactccttcaaagcacctccttttcctgggcaaaagtcactgcagagggttgtcatttttggtgatatgggaaaggtaaaatatacaccagcgcaaaatgtatcgatagttttagtactctctccttcaaaaataattactccctctggtcaaaaatatttatcgtttgggacaagatttagttaaacttttaagttcactgcttagctcagtcctgaagcaaaactacctcatgtttcttctgaattcacatggttttatcacttgcaggccgagagggatggaagcaacgagtacagcaactaccagcctggatcactgaacacaactgacacactgatcaaggaccttgacaacatcgacattgtatttcacatcggtgacattacctatgccaacgggtacatttcccagtgggatcagttcactcagcaagtcgagccgatcactgctcgagtcccctacatgattgcaaggtctttcttgatgaacatctttggtttattaaatctccaagccggttaactaattctatgataattactaacatgtttgatacgattggtttgattcagtggaaaccatgaacgggattggccaaacagtggatctttcttcaatgggacagattctggaggggagtgtggggtgcttgctgagaccatgtactacacacccacagagaacagggcaaactactggtaagtctcagactctctctgtatatataatcaactcaaatttcaatttccatttttttaaaaaaaaattgaatacgtttgtactgaattttgaatatttttttctaaattttagttggaggcacattcttagtttataaaaccaacagaaaaggcatttttgtttttgaaaaccggatgtttcgagtaaggtcgagatcacaaactggctcggtgatgctcaaaaagttcaaactaaatctgaattttgttggcaaaatttggtcaaatttcatcggtagtcaacggatttcatgaaaaaaaaataggggaaaccgtttcagaaagcagttcagttttgcggactctgcacgtcctactgggatccaccgacctgaaattttcattccgaaattgtgaaccctgctgtcaactggttgccattgtagaccggaatgcctgaattttgaacaaacaatcttttattttttttgctaaaatttaaaatattcgaaatttgttctgaactttgttgggcaggtacaagacggactacgggatgttcagattctgcgtggcggacagcgagcacgactggcgggaaggcacggagcagtacgcgttcatcgagagctgcctcgccacggtggaccggaagaagcagccatggctggtgttcatcgcgcaccgcgtcctcggctactcctcgggcttcttctacggcgccggcggcgccttcgcggagccgacggcaaggcagagcctccagaggctatggcagcggcaccgcgtcgacctcgccttctacggccacgtccacaactacgagcggacgtgcccggtctacgacgggcggtgcgcgtcgccggagaggtcgcgctactccggcgcggtgggcggcaccatccacgcggtggtcggcggcggcggcagccacctgagcaacttcaccgccgaggcgccgccgtggagcgtgtacagggagatggactacggcttcgtcaagctcacggcgttcaactacacgtcgctgctctacgagtacaggcggtccagcgacggcgaggtgcacgacagcttcaccgtccaccgggagtaccgcgacgtgctcgcctgcgtcgccgacagctgcccgccgaccatcccgccggcgacgtgatccagctccggtgattccgccggcgagtctgccggcgacgtgtgcactattgctgcttggtggtgcttgcgggcctcgtctgtaatcttgacttgtcaatcgtgtgtaaattgaattgcgaaatatttcgaaattaagtcaaataaagaaatgttacaaaattatgtgttttaaatccttaattactcctcgtctgaaaattaaacaagttattttcaaatttgaatgcaaacgaagcagatccccacctctccgggcttgatccgcaccgcacaatgtggatcggacggttcatggccctcaagggggttcggcgaataaatctccgaacccctcctcgcctcgactcgtactggttttggttggatcggggcaagaggaattcacaacccagtgaactataattaaaatatttagaaatatatatatatatatatatatatatatatatataatcaaacaattaaatccttaattacctcgtagaattcacaactcagtcagctaattcattataatatgaacagttttcctactgatctactccatgttcatgtgaaattcaaatttttaatttgaatttggtgaggcgacgattagttagttggccaaggtgtgggggtcgcaggcgtcgacggcgcaggcgagcacgtccttgtagcccctggtgatggagaacgcgtcgagcacctcgccgtcgtcgctgcggatgaactcgagctccagccgcgagtggtcgcgcgccgtgagcttcacgtacccgtagctctcgctcctcgccgcgctccactgcggccactcgccgccggcgtaccccctcagcctggcgccgcccgtgccggccacgacgtggatcgtgccgcccagcgcgccggtgtacgccgccgccggcgagctcccgttcccgccgccccccgccgccgccggcgccgccgtgcaggtgttctcgtagaccgggcacgtccgctcgtagttgtggacgtggccgtagacggcgaggtcgacgcggtgcttctgccacagcggctgcagcgtccgccccatgggctccgagaaggagccctccctggcgtagtactcgttcgacgagtagccgagcgggcggtgcgcggcgaacaccagccacggctggtgcttacggtccgccgccgcgaagcaaccgtccaggaacgcgtgctgcgccgtgccggggcgccagtcgtgctccgtgtcgccgacgcagaagcggaacatgccgtggtcggcggcgtaccagggcttgccgcggttcgccgccgccggcgcgcggaagtaggtctccgcggggacgccgcactcgccgtgcgagtcgtcgccgccgtagaagccgccggtgtcccgggacgtgcgctcgtggttgccgctcgccaccatgtagggcacccgggaggcgaccggcgagatctgcgccgtgaactggtcccactgcgccaggaagccattggcgtaggagaggtcgccgatgtggaagacggcgtcgtagttgggcaggtccttgatcagccgctccgtcgtcacctgcgcccccggctgaaatccggcgagctcattgctcccatcactttgcccctgtcccaacaaaaaaaaaaaaactcagccaatacactccaaattcaaatttacacaaaaaaaaacatgtatagacagtatattttaaatttaaacagaaactcttagccactacgtattaaatttaaatttaaatttaaacagaaactcttagcttctacacttcaaatttaaatttaaaaaggaactcttagatactacactttaggtttaaatttaaagttagacaccaaggaatgacttagtgtcaatggttttaatggtttcaaggagaagcaaatattcctagtgagcgtgctcaacaagaatcgaatcaatggtttttcttccttgttttttttatctttattttcttccttccttggcataggccggtctggctgagtgcgtcatgtaacaaaaactatattcttctaatatattgacgtgcaatccttttgcgcgttcgcaaaaaaaaaaggtgcatgccggcaactcctgccacaacgctatgagcgcatctcagaattaaatttaaacagaaactcttagctgctacactttaaatttaaaatttaaagcatattacaagtctacaacatatggaaacagatcagcacgcattttcaaataaaatgtgaacattgtcatcagaatgtgcacaagtttgatgaaattcttacgagtcccatgtctccgaaaatgacaattcgctggagtgaagcttgtccaggggaaggtgatgcacggaaggtggacgacttgccccatactatagttccgtctagtagctcgtgcccaatctgataagaatacctaaaacaaaagcatgaaaattacatgaatattgtaaattaaaattgttgctgagaagctcaatgcatgttctctcagtgttcttactccctgtttggccacaagttcttcaggaaagctgtgtggatgaagcctgggtctctgtaaccttctgcattagctggtttacctgaaaatttttccagcaaaacagagtcaacttacctgtaattctgaattgagcttttgtactatatgtaaaagttttttttaacatgatttggatgttttttcagtaagttgctctgaactttaccacacaaatggtttcttgtgaaggtgagggtgtcggccggcgaccgtctagctctagcattctccttctcgttcattgtccactccacaaaggggtaagcttcatcaacgttgtaaccacttgtccatgtcacagccatctgttatgaacaccaattacatcaagaaaccaactaaaaatttatgcaaattatgcaaactcacctcattccatccttttccttgtgagagacgagggaagactggagctttcgggttggcgaaagagatcttgtttgaaactgcaacgagtttaggctgcaaaagaatcatacaattagctacattatcctagctcctagctgctgtttttcagcaaagaagatcaaatcctaatcatagttccaatgttctaaagtcatgcagtgtaaatctgaactcacattgtccttgccaccggagaacagcccgaaagcataatcgtagcgctggttgatcagaagaaagctggtgtcgccgctgccggagctcatgaaactcggcgagatgttagcaaacttgtactgatgaaacagacaacaaaaacaatcaaaacaatcaatgtcatccagccattgagatgtacacacaatctgtatcagaatatacatcttgtttttcttcccccctactactccctccgggttgataatatttatcgttttggacaagagcacggtcttcgaaaaataactttgaccattatttttaattataatatgtataaaagtgttaacaaatatatgattttattacagtatttttaggactaatctatatatgtagtcaccatatttaaaagacaaatatattaaaaatgattcataataaaaaattataaagtttgacctcacctttaaatatattaaaaatgattcataattaaagattctaaagtttgatctcgcccatgtctaaaagggccagtattatcatgccggagcaagtaatcaccaaccttgatgggagcgatgggtaatccagcaggtgcttcatcttcacctgctgcattgattctgctactgctctgcttccctcccatgatcaaactgcagcatcacacacagagtggaggggtcgtcagattggattaggaaatttgaagctaacaatgttcagttgatcgatcttgatcttgagatggataacgagtttactcgaaatcggcaggggagaagagcgcgatccagtgcccgtcggtgggcgccggcgtcgtgaagttgacggtgtcccagaccgaatcctcgccctgccggccgccgcgagaagaaaaacaggtgagattcagagatctcataagcttgcattgcgcgaggctgtgtgatactcacgttggtgccgaggagctccggcgaggcgcggatggcggagccggcgtccatggcgacgcgcgcggcggccatgttgagcgtcaagagcggctggatgttgtccagcgtcgcagacgtcgagttcaccgccgccgccgccgcggggctcaccagcaagaagtcagcgtcgccgccggcgagaagaagcgccgcctggagcacgccgcgcgcggcgcccatcgtcctctctgctcgccggcgaacacacggcgaggcttgaagaagaaaactatggcggggaggaggaggaggttgaaggctttgcaggtcacgaatttatagggattttgctaaaagtttgcatgaaattcgtgtcgttagtcgttaggcatctggttattctggttagtttcgtttgaaattttatcccgaactaacgacgcagataatctacgtgattttctcaaggctttgctataaaatctgaaacgtctctcctacctcgatcttgaccgcacgatttagatcggacggtaatgtaggcccagttctgggttacctatcctccgaggggcaaatggtaatattcaacaattctagggtcctatatgcaaatgtcgcgacgccctttctcccgcgccgatctgcaccgtgcaagatggatctgacggctgtaagcctatgttaggggtacggagaataaatctccgaactcctccttatcctactccctccgacaaaaaaaagataaacatgggtttccgtgtccaacatttgactatcccgtaattagtattttcattattgttagatgataaaacatgattaatattttatgcgtgacttatctttttattttttttcataatttttttaaataagacggacggtaaaatgttggacatggaaaccaagatttgtcttttttttgacggagggagtacggcgcaaaagctc

SEQ ID NO: 22166 - DNA, 2032 bp, Oryza sativa
tccgaacccctcctcgccttgattcgtacagactctggttggattgggacggatttgcagcgcaagtgcagctatattgtatgggctggaacgggcagcccacactatttagggcataacgtgattgcagttgtgtatctggccgaaattatttgggcttttgggtctatttggttctctaccctaccaattaattggtagtgccactaccaatttttttttgatagggcaaagttagctagtctatataggccccgttcgttagtcctgaaaagtgtggattaaattttagattaaagttgcacgcttttcaaactaataaacggtacgttttgtgcggaaactttctatatgaaagttgttctaaaataccagattaatccatttttcaagtttataataattaaaactcaattaatcatacgttattacaattaatccatttttcaagtttataataattaaaactcaattaatcatacattattacaatctcgttttacgtgaaacacttcatcttcaggagattcaaacaccacctatgtttggtttaataccaataaaaagccaaaatttaatatgggtgaagaaaattctagagtatagccaaattaagcatgggcactactaattgtttagcgtcaatccaaactagcatgtttactattaaagttactaaaattttagtacgatcatattttggtttcaatccaaaacgccctttgacggattacggtccacgtgcggcctatattccatacgcggcaaaatactcgcctgaacccgttaacgactcgtttgtgaagctttaacgtcaaagctgcagccaaatgtacacctctccaagtctcaaacgaattgactcttgagaagcgttttttctcaaacggctgaacagtacactttttaaaaaggaataagttcctgaagaaaaaatacttttaaaaaaaattaactaatatttaatttatcatgttagttgttctgttacattcgaacagtcttattagaatgcgcttgcaggcagatctcatttcttgcattcccagcaaggaatgcagacatgcagtacacatctgaacgaaaaaaaagggctcaaaacaaacaatcacgattagcacacaatttgcattgccctccgttaacgccatggttctggtttttggaggctaaacaacagctacagatgtacaccatacttttctttcggccgcccgggttcataccaatttctctgacatgttacctcgcataccaatttgacaaacgatgtagtactgcactgcagccaaatacaacagctaagactcatccacatagtttcatcatggtatgaaatgttgcttccgatgcatgatccttctccagggagcaacacctccagcgattgctatggaagcatcaattatctgtgccgaagtagcggtcaccgtactctcccaaccctgggattaccctgtattcctcgctcaacccggtgtcgatctcggaggttacaatcttcagcctcggaaatcgcttgcagacgcactgaattccctcaggagcctgtttacaaataaaggtagacagatccagttaaaactaaaatagggcggagagcaacagaacagttagtttagtatgttaatggatttaccgagataagattgagaaatatgattcgctcctctggaacaccttttcttatcagaagctcaatagcttgatttgctgagttacctacggagtacaaaacaacgatgaaggacactcagttataaagtagtgtcagatactggcgctatgaataaaattgcagatggcctaaagctggtggagcatctagccaaacattgcagcagcagcagtctttgattgttcattcattcagaacataatcatggactaatgattcatacttgccttatacttttttaaaaaaaatcaaggtgttcccaacagggaaaccaataggcaataatatcttcaaatgtccagaaaagcttctggataaatgcaagatatataagtgcaggcatgcatagcaaag

SEQ ID NO: 22167 - DNA, 4036 bp, Oryza sativa
tgaggatccttttttaataatcattaatcataaaatctatgtacttacttgctgtccattgtctccaacacgatgtattagaatcttgccaatttttattcctttacaacaagcacgcaatgcattctccatactttcaccactgcaatacaatgatacatgttaatgaaaagatgttgaaatatcttctgtaatactaatatttcacgacattacggaagaatgacaggaaaaaagtaatttggagttaaaaattgggacatgatgcatggtaccatgaagatcgataaatgcactagtctgacctagaaaaaaatgttacagaacacataacatacataaaggaagaggttccaaaatccaatacaaaacaaagtataatgtaaaattctactaataacaaataatcttgagttctaaggtagcatctcaacacaaggatccagaaaattgctgttggacagagtcaattcagtatgcagccatccttcaaaatgcacctgccaatgttgtctgcttgaatttttagtttgctaattacttcatcatttcataacgtaccttcggacaatagacactccacagagcttcttgcaaaattcaactcccatataaatggaccctagacccagaagaaacaaattatacatgcatgagttgatgttctgaaaaaggaaagcattgtagagctagctaatttcaaatactaaatgcatagaggtacggcatgcagagtatcatgtagcaaacttgttgggaagttctaggtatgctgtttttctatttgcactaaatcagacccctaaaaacctgtttgcagccaaccataaattgctactcctacgtcgaagggaaaatttcagaagcatatgaaagtagctaattccaaaggtctgcagcagcagaattaattaagtaatggttctccataacaacgagtcccagctgcaggccacatctgcagcatcaatcctaaatttttttctcaacaaatttttgggtgattttagagaattgttatgtagcacactagtcaaatttgaatcagttgtcttacaactatgaacaattaaaaaaactccttttcgtaggtggattcacaccagttcagaacttatgatataaaacaatattagcattagcaaccagaatgaaaccgtgcaccccttgcatcacagtgggatggagccgttttaatggcaggatgggttatgtgcgctctcttttcagtcttttgtaggaataatttgtaacactgttaaacaactgaaaaagaatgaaaccaaaaatatgtggtaccatttgaaaatacctgttggagtaataatctgcttttctgtaaatggcaaatgccccagtccgtgctcaactacctgacatggcatttccataccaatagcaaatgagttgaatcaattcaaaatctggatcttttaaaaaaaaattatgaagttaaagagaagttataaaagctatatatacaaaagtagtaccaaacggatcaaccgatctgaataaaagacaaagtcaggtgtagtgatgtccctgtcacgaatcagagtatgcattcctcggatctgttgaattcaccatgaaaagtagaagaatattatgaaatttagcaaagaaaagcataaagtttaaagataagtgcaaataatctaacctggaatgttgtttgaaccacataaacatgtggatagattttgcacaagtcatgctgaccaagcttagtacgaatatgttgaacaatcaggtcaattgccacatgattatcacctcctcgtggtatgatcacgtcggcatattttttcgaagggagaacaaaatcatcaaatgctggcttcacaaacctgccatactacagatgccaacagaatttcaaattatatatgtagaaaaattgaaatcagaaaggtaaaaagacaaaattctgtttccaaagcacaagaccaatattaatataaaaacgcaaaataaaacaagttgaagtacctgctcaagcaccgagctaacatctctacctctttcaactgtatcacgccttattcgtcgagctagcctaatatcagcatctgattggatgcatcatgggcacccaaaaaagaagtgaacaaatattccagctaataacaggaagcagttcaaggcaaacccaacataataatgaaaatgagaaacctgtgtccacaaaaattttcatgtccatcagattgcgaactctttgatcatggaagactaaaatgccctctaatataatgacatctgatgcattgacctagcaaaacaaaattttatcagtcatttaataagcaacattgcagtttattcgcttaactgttaataaggaatcatgaaaatacatcaagaaaaattaacaaatgtgcacagtaacattcgaaacaaaatgcaatgttgtcaattttcttttttttcatgtacaaagggcatatatcagctataaatggtcatatcattgcagagagattaggggggaaagcaacaactattcaatgttattcaaaaggccaatgacttgaaacctagattaaaagctcacagaactacctttctaaagctttcagaggaccgtcggtgattcttaaaatcatatataggaacatttacaggctgtgcccgttttagctgccccatgcattccagaagctgctctgtgtcaaatgcatctgcaagcaaagatatttttgttcacattagaaacaaaagaatgccaactcaggctctgatcactaaaacagggagtgtaattccatccaaacgacaagtcaagtaccagggtgatcaaagttgtaatcttgggcatgtgcagattcttcagcagttaacccacggtagaaggaatcctgcaagttaaaacccaaatgaaatttactggctcttcaaagcatttctggtggagcgagacgacactaagacttgtcaggaaaaaaactgaagtaactaatgacgcatcatttacaggtggactattggttgaaagatcaactaaccaatgtggcatatgggttgtcacacagacaccaagaagataatttcccaaataaattggactaacggtttctggatttataaacatgagaagaacatcaaagggggtggagccaggacggagctgtggacaatacacatttagctgtgttttgctattccatggaaaacatggttgtgccacatttctgctaactataaatattttgagttgcatttatcacaaactgatattcccatcctctagatcatgtggtgcctgaatggatgcccccaaacatccagttaccgtaagtgacctaaatgcattcatgctagaggtagcacaacttgaggtaacattcaggcatatcccagaaaaactgatcagacatcaagttacccgtgtccattcatgccatgttttccattcatataaaatataaggttgtgaacagtttcattgcttagtttcacagctgtaatatgagcattaggtgcaatgaattgcaagaaagatgaatgcatagagacactcatctagcagaatagatctaaacagattacttttccaaaaagtagtagggaaatggcagaagcacgttagtaagctggttaaaggacacatcaaacctactcgaaaatttcctaatcctgatcactatcagtccatgatttagcacatatgccgcattatgcaaccccagagttcagctaagctagtaacacagatcaatgtgaaactatagaagaaaatgatggcacacacacctggttgacgagcacgacacggtggtcgtgcagctgctggatgatcatgtcgcacaccgtcgtcttccccgacgccgtcccacccgaaaccccttgaaaaatccaagagaaatcctcgcaaacagaggctaaaccaagcaaaaaacaatgccgacgaggaagggctcgaattagttactaccgatgacgaagggctgcctgagcgcggatggcgacacaagctccgcggcgtcggcggcgacgccgttggcgtagacggcgccgttggagtgggcgg

SEQ ID NO: 22168 - DNA, 6056 bp, Oryza sativa
ggtttttaaacgaaaattaaaaaaaaaagaaatgtagtttgggaatttcgaataagtagtaatttgatggggaaaatgggccgggttttgtggtggggcccatggtgcatggacctggtgtttgtacaccgggtgtattacaagtggggccggatgtgaaggtgtatgaaagctgggtctagggtggttgggatggggaagcgtacggttcagtggacaggggacatgaggcacagatgcttcctagcctggagctccactatttggaccacctggctgtcattgatctgtctcactcgagggagttactgcctccgtcccacagtaaataaagttttattttttttcttgcaacgttaatacaaatataaaaaaaaagttatacttaaaatacttttatgataaatcaagtcacaaataaaataaataataattttatattttttaaataagacgaatgaacaaacattaaaaaaaactcaaaacgacaagtattatgggatggaggtagtaaaaaaaaacatgaatactagggaagcatctgatattgaataagtggaaggggagagattttgaacccaagccaactaaatcatcatcttgtggagttagctagaggatccctgggcgtttctctcattcgagtgagtcaatggcacagtgccacagtgtttgcatatcttcgttctaagatataaggatttttaattttacacacaattactaagacagtgggtagaattaaaaggagaaaattatgatgggttgaaaaacaaaggtaagtgggaattaaacggtggaaggttgtaattgaatgaaaagtgattgttaataaagaagttatattttgagataaattttgaatgctagaagtagttataattttgagacgaaaggattcgatttctgcaaaactcatttgaatttggtggtttttttttcatataaatttgtcaaaagtttaaagggtaaacatggaacgatgaattcgtacaagtctgatgtcacatatttatgcagatgctccagccttggagatagatagatcgatagataaaccatgggattcacaatgtcttattccctctgaacagtatgggatgggattcatgtaaacctcgtgttaggaatcggatccaaaccgaaacacccagcgaccacatatgaagacaaagactgacaaattcagggcaggatgcaaatcatgcaaagtatcattaagctttacttgtgacttgtccatcaaaaacggacccaagagttttaacatttagtaacactggaatcagtgccaactgccaagggcacattttattatctctcaacagctcacgtagtgcaatctggggatctctgtaaagaagacgtgcagagtggccctagtttacaatagaaaccgagtacaaaaccacagatcagcttttgttctgagatccttcaacgctcttccttagtgccgatatgacctctcctggttcagctgctccaaatattgagcttccagcgacaatgcagttagccccagcagatgcagccacatcaatggtggaaggacccagaccaccatcaacctaaaacaaaaaacaaaaacgaatatgttttgataaaatggaactaaatagcccccgagcgtctgtacgattaaatcagtgtgctttagacaagaatcataaataacattgcaccacactacactgtgaagaacatattgtacctcgatgtcaagggatgggtacttctttctcagggcacgcacctaacgcaccatgtttcaaaatgatcagaatagttgtaaaacatagatacacaaaaatacagtataaactataaacaatcaggaatactaaatggcacttgatgcagtaataataccttttccatcatttctggcataaacttctgaccaccaaagccaggttcaactgtcataacaagaaccaattcaacaggattttctgcctccacctgaagaatttgttatcaatagaacaattgatgatgcgtgaaactcacagagcaagatatgcccacagccttaactagcattgtcagaaatcagtttcagataagtgagagtgaagttgctagccaacaatatgattataatgaattcaataggaaaaaaaggttaggcagtaaattgctagctccttatcacaagtatcttgagacctgatcattattttgttaaacaaatgtctcttgatcttcgatgcaggtcatgctgcagaaaacagacatgtaatgctggatatagtgaacgggaagttagctatgcctgaacatgggaagaacaggatttgcttatttaccaatcaaagaaataacatgcaaaatatattgccactagagtggtacagaatatacagcaaccaggactggtacatgatcaccgttcaagagttaagattcagaactacagagggaatatgcctggatactgagaacaggataactataaatgaaacaaattgcgcagctcgagtgtaaatgaacataagcttactcccagtttgagcacttattggatatgttaagaaaggcatttatgtcataattatgaactgcgtgtggaaatagagcatgggatctagagaagttatattgagcaattaccaggggaaaaacttcctccacaggagtgcctggcctcaatgatacacccggtcgcataccctttgctttgatactttggatgagttcttgccaattgtctgcaccaggtttttcgtaagacaaggaaaaccattaactgcttctcaacaattatatatttacctctggatacttctatatggaatgtgaaacctgaggcaccagcttttgctaatggttctacataatccgaaggattggtcaccataagatggcagtccaaatatgccctagaaaatttcagaatggtgagcattataggtacatataggaacaagagttaacaaggtgagtaaaagagcaccaccatacttggtgtgctttctcaagctctgaatcactggagctccaatagtaagattaggaacaaagtgcctgcatatgtgaattagttctttagcactacaacaccaccacttcaatcgccattgatctatcatattctggtgtttgcaatacataaactcacccgtcctgcaagagcatatggagaaagaaaccataggtcagcaaaagccaagcttcgcattttcgattcataatcaataacacacaatcctcttgaaaaggaaaaaaagaagtgaaacgtgatcaccagagaaatcaggattaactgaaattgtcaccatgaaaaccaggctgttagaatgaagagacagaaactaacgcacacataacattctctcatagtctttgctctgaacatctatgagctatgctacactaactttccagtaagacatgaaacaggatatgtcgaacaaaaggtcattttgaacaaatattatcagattcctgcgatttagcacatatataagtgcatggtaactccaagctaaagctcaatcctaaccctgaccaaatcatcctacaaaccaaagggcacgcacggtcaaaagatttgggggggaaaccggatactactagagccactgctttcgcgcggatcaaaaggtggggggcgaggcgagagggggatcgcacacgttaccatgatgtccatgtggagccagtcggcgccgaggcggaccatgcggtcggcctccgcggcgaggttggcgaagtccgacgagagcatcgacggcgctatcttcgccgccgccgccgccgccatgcctcctgcttgacctgctcccgaaccaattccgatagtgttgggtggtggtgtgtttggggggcggcgcgagtagaagtgcggtaggtgacgttcttcgggtaatcggcggccgctgggaatgggaaacgaagaggttcggtcgtgtgtatggcccacttgtcagtggcagggattgttttcacgaattattatctattttaataataaatttaatagtttaaataaagaactttaaagaaaagcttataacagtgagaaagtttgagtttagactttagagacgtgtaccagataattcatcacaataagtcaataacaatacgatgaattaacccagaagaacatgattaggctgaattaaaacaaagtactcaaagcaggcacggctggtcgctactcgctagttgccagcgtaaaagtagatcagcaagtagagcggcgatttatttttgtccgtcctgaaacacatgccttcccaatccgtccaaaaataaacgaaccaccattctaaaataaataaacaaacctagtcaataaacatatcgaatatcgagcaaacacaagcacagttcaacatatcgaccattgtgatatttctgacaataaatatgttcggtctcatttgcatcaaggcagcgattagttcaacaaagcaggttgggagaatcctggtacagaatagaagcaagaaagcacaggcgtttctatcaagttcagggcatgattccctggcgtatcagggagaatgttcgaagcaaatttgttgatgcaaatttgcggtaactgaagaacataatcgtcgatctagtccttcctcaggtcgatgtactctcgcttcgtcccagctttgttgatgacaactatctccagcttatcaccctgcaatatttgcatgcttcgagcgtcagtaaagtggcaaatacgacggtgtgaaacacattactgatgggattgcagtactgagatggtgaaacatacagtgtagatgtccctctcagttgccgatgcaaacacatccttcactaaatcgaccgcctctgtctccgacaaaggtgtgacggcatcctgcatgcatcagaaatattcttaggactagtggagctattcaaatcagcagttgagcacttatttctgggtggcacataaacttgcatgtcaaatcaaccagatgatcacatgacatgatcaatcataatgcacatgccaggtaacaaactagtaaaacttcagtgccttactcttgcagggagtaatagtggactaggtgattttagttggttgtccagcactggcatgatcaaagcagatcctgttccctgtgcactgtagccagtcctctcataggacccaactgcatcataggtgaaaacacatcctttccctgtgaaaataagatatgtgtttattagctattagagaaatatatatgcttcaacaaacacataaaacataaattggaaaaggagaaaaaacataaataaaaatctgcaccttaccttcactatcaagcccaccaagtacattgaaagcataatatgggaagaatcgcttgtagtacagagtgttggagagcagttgtgccatggcagggcagctcatccttttattgtgctggtgctggtacagctacaaaaacaaatgggcagcaataatttagatagcaatactgggagcatcctgaacattcagaagtgcatatttgcattagcttgaacacttccaagtgtataaaactataaacttctttactaacaaataatgccaataaattgcagcctagccagcttaacagagttcctgacgaaagggaagtttgatttgtgaaactaacagctgaccagctaggaggctgcgtagagaagcaaacagaaggaacaaaagaaaaaatatatatttctgacgcaagatgcaagtcaatcagttcatctgcctttagtatcaaaaattatactagcagcattaagtgcacaataaacaactatcatttcttgtattgatataacaacaaaaggtctaaacgaaagtacaaccctgttacagtggagaagttatggctcgggaacttaccaattctctggcagccaagttcttgtgcagagctttgatatcaccttggaagccggaagatgctagtgcgcatttgtccgctctaaacacgaaaaaaagaaaaaatgtcttaattttgtattattgataacgagcatattggaatgtcatagcaataaagaacaagacttccttccgtttttccccgcaaaaaaaaatacttcctccgtttcacaat

SEQ ID NO: 22169 - DNA, 23161 bp, Oryza sativa
  unsure (1)..(23161): unsure at all n locations
tagaaagtcttacattgtgaaacggagggagtaacacgcagtggcatgattaaaggtgctcagtaacttccatgcaagcagataataaatttagaagaaagtaacctatagcacctcaaaaatatatcggtgtaatcacaaactaaccatgccaaataaaagaagtgcagcgtattatcaccagtagacttaataaactaattgggtattagagaagtgcagcgtattatcaccagtagacttaataaactaattgtgattatcacgtagttacagtaggcaacaatagagcttttctgaacatgtttctataccaagtttgaacttacagaagaaactcaagtagttcaagaagaaagtaatatcacatggtatggttctattggaccagattcagactagaattgagaacatggaaaaggctcaactaaatgaagtcatcaatgttaagttatacttgtatgtagttatgtagtgtacagtaagtgctatctacccttttcacaaaaccatgcttatggagactacattaggtaaaatcgccactcactcttggcaagattatgtgctaaaaacagaggtaccacccaaaagaaaatcgattttcaaaatcactgaacaaaggtaagccgaggtcaccaagcatggtaaaacaatcccaaaagacaaacaacatcagcaatttaaaacgacaagctttcatttcctcagcctatgttcatatcccagtgaatcattcgaacaaaccattcctatagatgaatgaaatagtgtacataaatgttctaacactgcctatcgaacaccctaagacaagggcaacactaaactcaaacaaaatatgagcatacactaggagttaaacccacgagcacgactacccaacaatgtctctgttctatggatcaagaaaatttactgattacatatcgtaccttaattgcaatactgtaaaaccatgttgtgtacagactgcacgagttaaaaaatagttgccctaaaattactacaatcaagaccttacgacaagtaaaccctactttatctccccaaaccaccccccaagaatccagccaccaaaccctagctaaatcaaccaaagccatcaccaaatcatcccccatcccaccaaccaattcgactcccaagcgcatcacaaacccacacagccctcccaatcaacaaaccctaagcccaaagcgggcagatcgggggccgcgattcggccgggacttacagctcgcagatcttggagtggtcgcgcgtgaggatgttgtatccgacggaaaggcgggtatcggcggccaccacgcagtagtccgcgccggcgatggccacgcacgttctgcaggcacacacacaccaacaacaacccgcggccgtcgtcagcgagagccggaggaaaccacggcggcgggcggggatcgagtatgggggcttacccgccgttgttctcgtagacccagtcgccgcgcctcgacatggccgcgatcggggagctaggtcgtcggcggcggcggcttgcttgctcgggatgcggcggaggagtcgccggagtggaggaggaggaggagagagagtattggaaaggacacgcctcgctgcgttgcgcttttctccacccttgatccgactcccacgaggccatgggccttggcccaacttcgtattgggtctggatatggatcgggcatgggccggcccgtggtttttaatgggctttttagcgagcccgctttccatggtgacggttgcgattgcatttatatcgtcttgggttgaaatgcgagcccccccccccccccaccccaccccgcgtttgaaacgaggaaattcagtttgggattcgatacaaaggccggcggtttgggagagcaccgaaatttggtcgatgaaattcgagtgaaatttaaccctgatgcatggtacatgtatggccctgtttagttccacaccaaactttctccaaacttccaaatttccatcacattacatcacatccaaaattttcctactcacataaactctaactttttttccaaactactttctccgtttcacaatgtaagtcattctagcatttctcatatttatattgatgttatctacttagattcattaacatcaatataaatatgagaaatgctagaatgacttacattgtgaaatgggggaatatcaactttcctcaaactttttctcaattttaggaactaaatacagcctatgccattgagtttggctctactctttcgagggctgctatacgtacgatatgttttgtacaatagttgtacgatgaaacacttctccagtgtttaactgctgtatatttagtcccacatggatagatttaccttgtgtcgctccgcccacatgcatactaaaataaattgcaaagcgaagtagtttatgatgacatgttttgcaaagcaaagtttatattaaaatactaatataaaaaaatacaagagctaaatacatggtcttactcttagacattgcacggaaaaaaaaaagcgactagcgtaacaaagaatatgtttgtgatgcccaaataagatggattaagatggacatacctctttgcatgcagtctagattagtatcgttgtagattagatcagactgtcagtttagatattaacttaggtttatacagcataaataagaaaacaggtaaaagagggcaaagagtttgtaaactttgtatatgggcttctgggccatgaaggacttgtattctcatcatgtatccatgtttccgtgccgtctgtttggttgccgtatgttcgggcatagtcagcgccgtttttttgacaaattgacccttttggaaaacttatttcgaaactaacccctgccaaaaacttcaaccaaaaataggccgtcgcctcagcgccaaacacattggcgctgacgttggccgtgtcaacgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctaggacctcagcgccagccataatggcgctgaccatgggacactcagtgccagcccacctggcgctgaggtgggacttggccgcaacccccaaggcccagaccagcaagcctgctggatggcttgcgggctgggacctcagcgccagccataatggcgctgatagtgggacactcagcgccagcccacctggcgctgaggtgggacttggccgcaacccccaaggcctagaccagcaagcctgctggatggcttgcgggctgggacctcagcgccagtcataatggcgctgactgttggaaactcagcgccagcccacctggcgctgaggtgggacttggccgtttcggccgtggcccagcccagcaagccttctggatggctgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaacatancatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcttcctacctctagtgcgaggacgaggcacgtcgggggtgtacctccagtcctgcgaaggagcccgccggcgtcatggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacattgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggatttagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccgatacaaccaggctagggcagccgacccccagctgaaggtacccgcctcatcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggtgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccagtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatacttactgacgcattagattccttcacatggtacggccggtggacacggatagaataactctgtagccatattttcagatcatccatcgatcgaaactccaaccccttctttggttcatcacacattggtcgaaaggcnccgtcatattgtggatccccatcagcaattgctagcccagatctggtaagatcctcgaattgtgttatttcggggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttaccattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattatttataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccattccaaatatattttgtcaaatgtatcaataacaaccaaatagataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgtcgcacaaatcaccttcgattagagaggtttttgggggagattgggcgaggagaacacggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagttttcggcaggggttagtttcgaattaagtttttgaaaagggtcaatttgtcaaaaaaacggtagtcagcgctcgtttttggtataaattgttatactaatctattagcatattagataataatagtttagaataatgatggtagtagataaggttttattttttctgtgagatttttttaactaacaaattaaaaagaaatatacatatgaagtcatagtttcaaaattttaaatccagatttgaaaactttcaactcgaaatttattttttttaagtaaaatttgaaaaactttcaactcaactttaaaaactttcaacccagatttgaaaactttcaactcaagatttgaaaactttcaactcggatttaaaaactttcaactcgggattaaaaactttcaactcggatttaaaaactttcaactcaaaatttgaaaactttcaactcgagatttgaaaatttttaaattaagattttaaaaattttcaagtcaagattttaaaactttcaacaaaaaaaattgaaaacacttactgctggaagattaaaatgtaatcataaaaaaacgcaaaaaaaaagaaacagaaaaaaaatcacggaaaaaaagaaagtgaaaaaaaaaagaaaacggtggtaggttagagaagaaaaaatcacgcgcgtgcgccgcgtgggccatatgagtcgggagtgcgtgctgccggtgtccgtgtgcgaattaggattctcgcgtccgttcgtactaatttcataagtgagaatcgtacgtgaagcctactatttcccccggccaaaaaggtgacattgcaagtattgataaaaataacatgcaccccaaattatctacgtgcacttaaaaacttgggtagtcatctgtggtctagttggtatagtgttgtggaacgagatcctctgactttgtgaagtcagagaagcacagtaccttggctttgatccattctcacccgtagcgagattaatcgatacagtactgctgtttttcgcgtcaacaagtacgctacagtatcagtgaatagtgaattagcacaatggtttttactgttttgtattgttgctacagccaaaacttcaaaacactgttatgtaccatagcaccaggcttattttactgtgtttatctgccgttcgcttgcaaagtcaaagagccggatccgtaggtgttgtacatccacgatttcacgtcatgaaccaactaaactctgcttttgatacaattgatcggtatatatactacacgccaaaaatctccctgcagtttttagtaagcgatgccattaacttttaaacatatatttaatcgtgtaaataagtcatacttgaaatatatatcttccatgataaaccaagttaaaaaaaactgataactacataacttttttaaaaaaaaaagaataatctacatattaaaaatcatctattaaaaacctaaggaacttggtcaaaactccggttttcgaaagctgctaatttaattcaagcattgggaacagtggaacacactgcctatgaatcgtactgtacattgatttgcttgtaccttgtattgatttctgcatgattccttggtttctttttttacacatttacttttccttcaccagatggaataatacacaggaatactagcctaagggcctatttaaatagcaggaatgaaaaaaaaaattgaaggaatagaaaaatcacataactctaacaagaatggaagtgattgaagtgtaaaatagataattgtaaaacacagaaccgtttgattgaatcgtggaaaaaaaacataagaatcggatgagaaaaatatacttaaagggaagtttcatccaaaatctctatagaattgtccatttcatatgaattttttttacggaagttccatatgaattttaaaggattggatcatttaattcgaaggcatttataggaattttttcaataaaattaaaatccttcaaaatttctattttttttctccgaattaaaggagcctaactttttttttctccatgcatgatgcatccaccaccttcctgacctctccctctatatacacaggcgccaccaacaaaaggcacaccaaaaaaaaatctcactactgatcatcacattcatcagtggagtgcagctagctagctagagctaagccaatcgagatgatcgggtggggcgacgtgtacaaggtagtggcggccatggcgccgctctacttcgcgctgggcctcggctacggctccgtgcggtggtggcgcctcttcaccgccgaccagtgcgacgccgtgaaccgcctcgtcgcctgcttcgccgtccccttcttcgccttcgacttcgccgcccgcatcgaccccttcgccctcagctaccgcgtcctcgccgccgacgcgctctccaagctcgccgtcgcgctcgccctcgccgcctgcgccgccgccgcctccacccgctgctgcggctccggcggaggcaagcgcggcggcggcggcgggttctcgtggtgcatcactgggttctcgctggcgacgctgaacaacacgctcgtcgtcggcgtgccgctgctggacgccatgtacgggaagtgggcgcgcgacctcatcgtgcagatctccgtggtgcagaccatcgtctacttcccgctgctgctgctcgcgttcgaggtgaggcgcgccaccacggcggcggcggcgccgccgccgccgccgacggggaccgacgacgacgacgtggaggacggcgccgccgcggcggcgacggcggcggcggcgaggcggtcgctgtggccgctggtgagagcggtgtggctcaaggtggcgcgcaacccgaacgtctacgcgggcgttcttggcgtcgcgtgggcgtgcgtcacaaacaggtgtgcctacgtaagcgactgcatgcatgcagaaattctcgttttgtccgagtctctcattttactaggtgattcccgcgctttgctgcggaagttccgaagtaacttttaatatgtttttaacagggatggatccagcgtaggtgctgtgggactcgagtccccctaccccgcttaatcgcattagtaattttatgaatttgtagtagtaataaaccaacatcattatcaaaacaaaatcagtttgctggaaatgtaagattctctagtcaaaatgttagtaaaaaaacacattaaacaggccataggaaaatgtttatatatagcctactaactgagctttctttattaattagtactctataaaagggacaatcaaagtggatcggaacaaatacaaccattgttagtggaacggctgacatgaacttgtaaaccatatttttgttaattaaagtaacttgatttgactacaagcatctctcatgtttgccccatattaatcaagaattgaatacaagtaaagcaacacactacttgaatatgtattggacgacagtccaatcaggcacatatatatggagaacaactttggcaatttgccataaagttgtctgattcaaatcaggagagaatgtttgctgcaaatgatcagatatgtacctttaatcaaccccccccccccctgaaaaacttgcatattacgcttgtttaggctatggcagattattccaagatcctgttcccaaatcaaacgatgaattctcgagagatttgcagggaattatctttatttgtggcttgatttattgtgactgtcgttcttgctttgcaggtggcatgtcgaaacgccaagcatcatagaggggtcagtgctgatcatgtccaagaccggggttggactctccatgtttagcatgggtacgtaattaaccaattaataatcagctatcacacgacttgatcattcctaacttcttttataataaatatgcagattaaattttttacgtaaaatgatgtggtattaacgtatgattgattgagttttaattattacaaactaaaaaaataaattaatataatattttagagcaactttcatatataaagttttcgcacgaaacacaccgtttagcggtttgaaaagcgtgtcacgaaaatttttatcttcatccaactcttgttggagaaatgaacgggacctaaggactaatgaacaagaaaacgctgtactctcctaactgaaatctgcatttgatttgtttgtgtttgtactctcctgtactgtgcaggtttgttcatggcgttgcaggacaagatcatcgtctgcggcgccggcctgaccgtgctgggcatggcgctgcggtttgtcgccggcccggccgccaccgccgtcggcgccttcgccctcggcctccgcggcgacctcctgcgtcttgccatcatacaggcatacacacatttacacgaaattcattcgccaagttctttttttcttctttcacctgaaatttgtctgaattcaaacggatgcatgcatgacacaagtcctcacgatgaaactgctcgtgatgaacaggctgcgcttcctcaatccatcacgacgttcgtgttcgcaaaggagtacggcctgcacgccgaaatactcagcacagcgtaagtagacaatcttatatacggtttaactggatttcactgaacttctttagtttgatctgcttcagtaccttctgtcaaatttatcttccagggttatattcgggacactggcgtcattaccggtgttgatcgtgtactacattgttctaggcttcatacgatgatcggattaagtttttttttttgtttttgttttttggcacgtcagaatcagagtgcaatgcaaagtagcatggcatgccatcaagctttgtatcactattgatcgagctatgtacttacagaatctgtacttctgatcttaggtaaataatattaagcactatttactcgatgaatgatgcaaaaaaaaaatctgatgcagcaactgcaaatcaaagtacaatagtacccaaatcaatagctagatacagtatatgtgctctacagtggaagaagagttcagaacttcagagttcagatacgaacgccatctcttcaacctctgacatactcctaatggacatggtaggtagcatctgataattaatgccaattaagcagcaccaaaaattgttcggattccatatattgatcatctgatactgcaaaattttgtgcgagtggtttaacgagcattgagtaagcttgcactcatgcatgtttcttcagattcgtgttccattttgtgaagtgcctctgaatttttgtggcattaattattctggttgtcccagagcatcgatcaagctagctacttctgccattgttggccatcatcgattctcttctcgaccaagaataatacttatcactttccacaaatttgctttcgcttggccttaggacaaatgcgttttttttttgtctgtcaggacgtcatgaattgacatgatgccatttgatttgaatgttgaaatgctacaagaatgacctgtttggaggagctttaaattctgaaaagcagctgtttggtaaccaacttctgagaatttggaaaagctctgaaacccagattctcagaagctgtagactgtttggggcagattctagcagaagagctttttggaaaaagctgcagctaggacaagctctcccaaacagggccaattggcttctactccatcactaagcctcaaattgatttgaatgttgaaatgcctcaaattcattgttgacgaatccttgtttgtttggggtcagacgaggccccgacaaaattccaaaatcatctggtaaaacattggtacaattcaaggttcacggtgccatgtaatggatctgactccaataatatccttcgctgctagcttcatccctgatatatgataaatgaataaattacatattggatcactttttataatagttttaatttgaactatcttgaactaagttttcactttttttagaacaaagtttttactttggaccggataatattttcttctttgttacgcctatttccctttggaccggataatatttcctttccgttacaccctgggccacccacatagttctcctttcacctcccctcgcgtgcctctatcattgttgcttaaccagtggaactgcatcttagtggggataattaagggctgctatgttccatttattgtatatcccgagtgatttctccactaagatggaaaatggaaatggattgttaacccgacaaaaaaagatatgaactactttaggaaagcaaaaggagtggtgattatgcaaaacttggtgtaatttcacatcaacgtagaaactgcattgacgaagccacctaatttagttattatatatatagtgcgacattgggtggctttatccattctaggcagcaacttccaattaggagtgttattgctaattaatttgctataggcacaagtgggtgtgggctttttgtttatgctgtagaccaggcccagaatagcccagagtaattaagcccatggtggctaaaacccggctccaagagcccaagacaggttgcccgcaagagagatatgaatctaaatatttttttatattgaaatttaaatcttgagttattattttcaatagtttgtcggctatgggaaatcctgatgccaatattttcaatagtacatgtcaatatttaaaatttagggaaggatcgataatatagcggtaaggttatggatgcatgattatacccgtcaagatttaaatcatagcgctcatgaatattacgaacacattggtacatttttaataagatttaatattaatcttgtattttccatgtgtgttaagggtattcacaaatgtgagtgtggtgtgcatacgcagtgtgcaccagtgtatgcgcactatttataatcaagaaaaactagaattgattgttttttttgttatatatagtcatattacttgttttttacatgtattcgtatgcttcaaattaattaccgttacagatttattgtaagtcaaacatttcagcctcttatcattattttatacaaatttaacattataagatttttatttttacattcgttatcagaaaaactttcatgatgtataattcacttgttgtcaaactgtatggattattaaaattaatgataacgaattagagatagacatgattgatatagtacgcacaataacaataaaaagtttgaaacgaatggaatatttaacttctctagactcccttgttttctcagacgagatgacaaaaaactgtccggaaaatatcctgcaggggcgtaatattcggccatttactacagtggttaataatacaccaacaagtcaacaacaaaatgcagttagcagacagctgcgcaattacgttgcgtgtttgcatacaaaccgataattgattaacaaagttaatgatgcaagcacaggcgttagctgcaaccgtaagttgacttaaatgagaaagaatttgagatcgaatcgtttagtcgctgtcagcatgtgtaccacacctctcccgtactgccggcgtgctcagctaatgctcgaagcctcgaaatcagcaaaaaggattaataaaataccatttactaaataaactacaccatgtaagcaaataactagtaataaaatgccgtctgaattggtttgattggtggggaaaaatattaaaattatgtaagatttggatcatattagaaaatttctcctatttggtgctttaaaataaagctccaagaatcctatgaaatgctcaagaaaaaaaaaagataattcgaaggaaagttagcatgacgttgaactgtatgaaaaccttttctttttgagtctttttattcattctttaagagtgttcataattatattattcctcttatattttctctctacaacttatatgaaactaaaaattcttttagttttcatatactcattttttttgcgggaaagtttttttttaatatactctcttcctacaaatcgaatgatacttatataaattaattattaaaaatccaaatccttttttttaaaacggaataaacccttaccgtatcatacggttaaaaggaccctcaaacatttaggatatttaactatttattaccactcttatatatgataattaaccatttatcacttagatccacatgttacttatgcataaggccccacatatcattgacacatggttgccaaatggttaaacgccaaatctaagagttaaaataaaaagttaaatgccccccaattttagagcggaaatgctactaggagagccctcgcccgcccagagcgatcagatttcccaccccctcccttcacctggttttcttttttagcatcgtattacttttctattttagtaaatttatgtacctaaagtttatatacctcaagtttacacatctaaagtttagagaccaaaagtttataaatcaaaagtttatatatccgattcaaatttgaatttgaattcaaatattttttatatatagtatttctatacatctaaagtttatacacctaaagtttatataactaaagtttatatatccgattcaaatttgaatttgaattcaaatatttttcacatatagtatttctatacatctaaagtttatacacctaaagtttatagacctaaagtttatatacccggttcaaatttgaatttaaattatatccgattcaaatttaaatttgaattcaaatattttctatatatagtatttctatacatataaagtttatacacctaaagtttatagatccaaagtttataagtcaaaagtttacatacccgattcaaatttaaatttgaatttaaattttttatacataaatttttctaactttttattttttaaaaacttttttatggtgtactgtagtaggaagagaagaaagggggaggaaggggagaagtgggaggagtgcctacagcggagtggggggatccaatcgcctggcgatcgatcgcgcgttaggccccccattttagaggcgttttctagtcagtttgatgaaatttgagcaaaaaaacgccgtagcctgacagcctcccctccccttcgcctcgttcctatcgcctctagtgcccaccaccaccccccaacgcccccgccgctctcctgatatccactagtggccacgccgcgccaccccctacccctcgccacgccgcgccacgccacgcctcgcccatcttctccctataaacccccccgcgcccccagctgctcgggcggcggcggcggcggcgcgaactcgaatctcttctgtccccttccaccaccgtccccccacaggagatgctgcgctgccacacgccgccgcaatgccgcctcggcgcgggcggcgcgggcgcgggggtgctgctgaggcagcggagcgaggtggcggtgcggtgccgcgcgcagcaggtgtccggggtcgaggcggcggcggggacaccggcggcgcgggcggcggtggagggtggggagaggacgagcctggcggagcggctgcggctggggagcctgctggaggacgggctgtcgtacaaggagagcttcatcgtgcggtgctacgaggtgggcatcaacaagacggccaccgtcgagaccatcgccaacctcctccaggtgcgccccccaccacccatgccgggattcctccccgtctcccaaagctactcttcgctggtcagattcgtgctctccgtggctcgatttggggtggagtcctctcggattgcgaaatgtgctgcggccacggtttgtgttgggggggagtggaagcatcgtcttcgttcttgttcttgatagattcggtggtttggatctgaatttagacagctccaatttctccgtacaattataatccgacctcatttgctgtgatgtgacaagatttagtaatactaactttcctcaaatccgtgggctatcatttgcgtagattgagctagagctttgataaagtcaggttgttctagtcttattctagtcgatgtcttttttgcttttatttatattttctggcaattaacaaatcctgagccggcgaaatcgcccatcgaaatttcatgggcatatgcttgcattcctaggtggtatcacactcctttctaatgctgattttcttgtccatgtgtaaatataataaagctataattcctgaattattatgcttaaatacctgataagtacttccaataggggttgtgtatcatgtcagtttaggtagttctgttctgtgtgtctggatgaatgtgcgtggctgttaaaaaaatattgaaattctgatttttgagttctactttggcatcaaatcatgcaaacaagtcaaaatatgactgggcgtatatcgagctagttctggtggaatatagtggattgaatataatcttgatttaaaaactaaggcagtatcaaatggaatgcttttttttcctgaaaacttctgatcattgaatttgaaaaattgataaccagtggtaacaatacgtgtttccgcgttccagaaaaacaataagtgtttctgcttctattagcatttttcttagctatcagtgttggctttatttatatgaagaacactgttgagaagcatctcattattttgtttgtactatgagcttttaatggtaagatttcttgtaaatgcaggaggtagggtgtaaccatgcacaaagtgttgggttctccactgatggttttgccacaactaccacaatgagaaaacttggtctaatttgggtgaccaaccgaatgcacattgagatctacaagtacccagcatggtaagttttcaggattgcatcgaacattgctcccacccttgtttttttagcaagatctagttctgactggtggttctgctctggtcaggggtgatgttgtggagattgaaacttggtgccaagaagatggaaagatcggtactcgtcgtgattggatccttaaggatctggctaatggtgaagttatcggcagagctaccaggtacttattgctcaagtataagagtattcataattacattattttgaaagtggttgcctgatgtgcattcactcaaccatgttgtgcatgctgggattctgaataggtattgagggggtccactggtgatgtcttacatgttttaacttaatatttctcacctctttacttttctccccaccttatttccacttattacacctacacttctccaaatgaattcaaccaaggtaagcctgtaaaataggaaaactcaggtactagattttagcaatctcaaaagagagcgtgaatcgaaacactggaattttttttaatgcccaatgatcttggtgcttgtcttatgcttgaatgttcttacacttgctggctggcaattgtagcagccttaattattcgttcttaatgagtgagacctgctaatgattaattggaacttagtagtttgtactgaacgaaccgttctcttttggtggaaaacaacaaacattttcattatttagtgtttacagtgtaacacagccatatcttcttgtttgtccagcaagtgggtcatgatgaaccaaaatacacgcagacttcaaagagtgagtgatgacgtgagggatgaggtttttgtacactgtccaaagactccaaggtaaacctcctcttgtactcatttagccacagttttcttgcacatgcacatttttgttgctttgatgcatctctgtttttactcttcaattgagccacagattccctttctttaacttggctctgttaaacacacttggatacatattcagtggttttgaattactcgagaatcagaagaatatgttttctttgtattcgtagttgcaaataattcattggtagcttgactgaagattgtacatgtattttctcaaatgactgttatggtataataattattgtaacaagctaccattgtgcagattagcattccccgaggaaaataatggcagtttgaaaaagattccagttcttactgatcctgcacagcactcaagactaggcctagtggttagttctcgtctcagaatgcggttcttttgctctgtccctaaacaattctgtgctgacatatattaatttctgtattgcagccaagaagagctgatctggacatgaaccaacatgtcaataatgtcacttacattggttgggtacttgaagtaagttttccattatctcagttttgctaccagttaactgttcttgcttcatgtgacaggctgacagccctctcctggctgtaatcttactttgagcagttatcatccttgttgatttgtgatgatttctgatctctttctttttccttctaaatggcagagtatacctcaagatattattgatacacatgagttacaaacaatcactcttgactacagaagagagtgccaacatgatgacatagtagattcacttacttatatcgaggaaggagaggagaagagttccaatggatccgcatttgctgcaccgcacccagaagagcagcgacagttcttgcactgcttaagatttgctgggaacgggaacgagatcaaccgtgggcgcaccgtgtggaggaagctagctagatgaattccctagttttgatcatacagtcatatgtattctgatccttccatttgttccatcattttgctcttggtgtctggcatagccctttcagagaatcggttgtaccccaaattttgtgttaatttgttacctttgtaatgtaccgtggtaacaattacagtttgtgacattcgtcttacctgaagttgtgcgttgctgtatactttgtactagtagaatcagtgtttatgaatcttcaaataattctatcggcaacagatagcaatggcatgccaagtttggttcttcctgtatagaatacccagctgctttcactattactatgatatctcagtgataaaaatgtctgttttatataatattataataataaaacgtgtgcatgatatgttggatttagaaatgttatgcagcttttattgtttatcatgtcataagttttgccatttaatttttgcaagtctctatgaacaattattcaaataatagatttataaattactctatttgcaagtgaacctttgctcctcatttgtggattatatgacaccgcagtcaacttgttagctgttatttgtatattgtgtttagttatgcccctagatctttgagggatttccttagattggattaatggtgagttgcttcgagctgaacttattactgattcttcttttcttcaggtcggtgttttcttattcttcctccattttacaatataagacaatctagacatatgcatgtgtttagattcattaacatctaaataaatgtgagcaatgctagaaagtcttacattgtgaaacggaggaagtagcctgtaaataaaaggcataggcaagatacctagcactactaaaactttgtaaatcaaaataggagtaacagctttcatagtttttcctgttgcaacgcacgtgcaatcatatgcacaaaactgctgcaaaaactacgaaatcttcaaaacatccacgggtgcatagaacaagccaaatattagctcaggaaacggaccatcaattaatcccaaattcaggttctctttgagaacacacaaacagtaccatcaccacaagggaccatcaaccaatcccaaattcaggttctctttaagaacacacaaacagtaccatcaccacatgggaccatcaactaatgccaagttcaggttctttttaagaacacacaaacagtaccatcaccataaagagtacagacgcctaaagaaacacacaaacaggtttacaagacaacatgaaagctctcatactacaggagctggggatatatacagtctccaattctcttaaccatggagtaatgtttgatctgagcaac

SEQ ID NO: 22170 - DNA, 195 bp, Oryza sativa
gccaatgggttaggttgactggtggaggcgtaatgattgatgacagtgggatgacaactgttgaccttaacaaggttggatactcggacgaaccttttgtccttgccaatgatgtaacgcaagtcttttttgggaaggacatgtctagcaaaggaaagaagggcagacggcctgatgagcctaagcgcaagtggt

SEQ ID NO: 22171 - DNA, 18186 bp, Oryza sativa
cgaacgttaacgtgaaatgcaatatatatatatatatatgtatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagaccttgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcatacatgactattttagtcttagcatgtaatattatttgagttttaatataagattactttatttgagattagacttagtatataattatttactacggaaatggtgcgacaagtagcaattgactattggtgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagactagcacgtaagtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagtcagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaacccccgtggacagaagagggcacgcgggcaacgaggtgcagcgaagaagctcgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaagaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtataggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggtgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgattctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatagattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatatatacatatatatatatgtatgcatatatatgtattgaaacatatatatgcatggtttatatatatatatatatataaactatatatatatataaaccatgcagcaacagggccatgcaaaaaaaaaatggtcagctcgatctttagtcccggttggtaacaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgatctatctatcgtttagtgatgatttgtctgactcggccagaactcaagcgagctggattagtttttactacttaatttgatctgtttcagttggtcccatgccgaaaccaccacaatcttgttcagtatgatggagtgaacgtgtattcctgtgcggggcgtcgcatcgcatgcaaacggaaccgatcccgcgtgaggctgcaacctagcgctagcgtcggacaaaaaatatacggaagagaaataggagaaactcaaaacccaggtaaacacagatgacgtaacaaaattctgacaaaaacatcttgaatttttataataggtaaagataagtagatatttatctataaacttagttaaatctgaagtaatttgactttgaccaaaattaaaacaatctataatcttttttttcaaggaaaaacgatctataatctaatacggagggagtagcagagaagagatgcagtatatcggtagagagcatcaggtcggaattttttttctctttttaaaggagcgcggccggattggtgttacggtgttttgtggcagcgcgcgcgaaccacgcggttacggcgagttcgaatctaattcgactattcagtagtcgagttcgaatctaattcacagcgcaaaacgagccttcttcttataaaatagacaggcagcacagcaacacaggccagcaatacaccagatcgatcggtcaagcacaagcgctagccctgcaggctgcagtttaacacgcgaaggtatggcaccaatatcctctctaaccccttgtagttattccatataatgtagttaactcgtgactttgtgagtcttttctatggtttctggaaacatatttatctctatccttctactacctccgtttcataattttaatgcatttttttctaattaaacttagggagtagctatatttatgtcgtcatatttttcaccaaaaaatagtcggcatatatttacattgtaagttcctataaattacatatgtaattttagcgtatttataatgtaagtctcaaaattacatatgtaagtccgaaaattatatatgtaattttagtgtatttacaatgtaagtctcaaaattgcatatgtaagtcccaaaattacatatgtaattattatgtaattatagtataattagtatgtaatcatctatcatcacgatatatgtgtggaaataatcttctctcacggaagcacatgcagtgggaggcctgtgcggctgtgtgaccaataggcatgtaatccgactgtaatcaagggaaatttatggcgacataaatgtagcaaatccgttaaacttatttagatttaactaagtttataaaaagttttactccctccgtttcataatgtaagttattctagcattttccatattcatattgatgttaatgaatctaaatagatatatatgtctagattcattaacattaatatgaagggacaattacattgtgaaacggagggagtagtaatatctactatattaaattagttttattaaatttagcattcaatatattttgatatacatttgttttgtgttaaaaatattgctatatttttctaaagatttaatcaaacttaaaaactggttgagtagagtaaaagttaaagctaattataatatgaaacggaggagtacctttcaaaaaaaaaaaacgtggtcagtggtaggtgattattgttaatattctcttggccactgacgatgtactccacgtaggtcttttttttttcttttgccttttctgttttagtcagctgtacgttattttgttctaaaaatctggcgaacgtcttatcatttttaggtaaattaaaaaatattgtgagggaaatggagagcgttttttatgacaagctagggaaaaagaaacagatcccatctgagcacttatttaccttttaaaatacaatttaattttcttgtcaatatgagcagtcttataacctttcaattttctacaccattatagcagaggaactgaggaagaaatgctagctcacagtatggagattagtaaggaaggccaagaatatttagctcttttggatcctaatattgtgcctgtgctactatttgttgattacaacgttgatgatagtgagtataacactgatggtgaagattattccatcgatgatgagggtgaggagttagatcacgcaagcaacaattcacttgatgaggatatcaatgaagatgctgaagatgaggaagatggtaaacttggggaggtagatgataggtgtgaagaagataatgagggaagtgaagaggatgtagggacagatgaagttacggataatgatgatcaggaggaagatgacactgtgttcttctacagtataaccaaaagacaattgatgtccgaaagagtggaggaattcaatacacacttctactggaccacaccacagggctggttgcttatggtgcatcctgaatcacataaagttttcttatggagtcccttcatagatcagaggatcaaccttccatttgatgaagacggtttctttacaaataatacagtccagtgcttgttatcgcataaaccgactgattcaaactgtgttgtgctagtggtgaattgtagaaacactatattttggtactgctatcctcaaggacatacatggttcaagcatgagtatcaatcaagtattattagcactcgtgaaagccattaggacgtcattaaaacgatgaagctactcacagcaattaatgggagattctacacatatttatgtaatgataaggcaattgtggcacttgagttcttgccaaagccaacatttagaactacgccggttgaggatgcaccaaatccaagttattggtccatttatactagttacttcttagaatcttgtggagacttgtttatgttgtcatacaaacatccagtgttatgtgctcaaaaggtttcgcagattgaagttcacaagctcgatttatctagaagaatttgggtgaaagttagcacaattggtaacatggcattttttgttgacagtactgattctggagtatcagcatcactcaatgcagaagatgttggattaaagagaaattgtatttattatgtgagacctaaagataagggattatatatttatgacatagaaagaggaactactagcgtacacaatccaggggtagatctagccgattacctgacacctgacattatgatgactccattatcttgaatcattcgcgctatatatgttttattttcttttgtataatattctatttttgtaatggtatattttggagtgaaatatatattggcacgttggaagagaatacaatcttttatttaatgctacagtacaactttgccaggtccaaacgttttagttatatttagcggattaatgccggtaaattattcttgccatgtttttcaaatatgagttatcaaaaacttatgctacaccggtattacttagacattcattctaatttatttgttagatttagatttatttttatctttacttattataaaaattgaagatgagcatgtaatcatccttattttcgtctgtaggctgactttggagctgggatgccccgtgaacgggtcacacgattgcgcgtgcctgtcgtcttactcgcgaacacgtcgcgcgcgatgggcaacgtcaaaacgacgttggactaattgtccgttcttgtgattggccttttcagcgtgcgtggatccgttgcaaactccgaaactcgtgtgttctatcgtgtgtggtcgccagccttcatcagtcctcatggacacctaatcgcatcaggattcattcccgtgttcgatcacatatcaatatatcatgacaagattacatctacgcaaagtttaaaagtttttctcattccattgcaccgcggagccatcgacccaaccaaagttgcacaaaaatatattcctcttttttaagttatgatgatgaatatactagcaaagtcccggtgaaaaatatattgcagcattactaggagagaaactgaaattatgataaacattaattagtatattatcatggttcaatttttgtgatccaaaccattaagaaaacataaacttcaccctaaattgtaactttacttttacctgttgcaacgcgcgggccctttagccctctttttaatattattagtcattttgattttttttcctaatcaaacttctttaagtttgatcaagtttttatataaaatttagcaacatctatcacagcaaattagtttaattaaaaataatatttaatatattttaataatatattttttaaaaaatgtttctatatttttctataaatttagtcaaactttatagagaaagaaaaatcagtcaaactttaaagagaaagaacaatcaagatgacttataatatgaaacgaagggagtatataatttatttcatacttttatagcaggctggtttttgtacgaattaagaattgaattggcatttaggtatgtaggttctaattaatttataggccataattaaattatgggaattgttatgcttctacctgctaaatgttttggggaaaatccaaataacccctacaagtcaatggtcttttcaatctccccctacaacttaatgtagtgcaaagcactccccataggtctattttctcttccaacttcccacctatgtctagttttcggtgattcttcgtcacactaagtgatttctagatctctagtgtggtgagcaaagatgtcccatgtgccttctcaatgaatgcaactgccaacagaaccttgaccgcaaccatggcatagacgtcctcgacgatggtgcacctgtcgtcgtccaatgaactggaaatttcatccgcagttctaccgccggtttccatcatggcatcaactgttgagattataggcatataatgatttaatctattctataaataaatcatgatattacagatgaaaactagcatgaacgcatcattagatctatacttgtaaactacacagtataacatgaacagatcaaatatgcgcaacatattgaacacgtaccgaggtgacggaaagaccggctgcttggtcgaaacttttcgcaggcgtctacgaaggcacgaaacacgcgagcgaagaggaaggcgagccgtcgcgaacgaacagggagcagtcgcgcgaagcgcttcccaaaaaccttattgccgccttctcccggtgcaggacgtcgaaggcagaggttccggagacctgctctcccgatcgttggtgcacgcaggcgagcgggatggagtagtctacgagcgacggcgcagtacagagtaggaggcaaaccctagattgatttcgcgtgtgttgcgtgaagacggcgggtcggtttatatagagaagggccgcttgatcagggcatccgcacgatctctactgcgcgtaaccgaaccggataagtcgcgcgtaacttatccgaactccacgccgtttgcacgcaccggatttttcggaacgtttccaaaacaaaaacgaatccgaatttgcagcaaaacaaaactgcaaaaggaggctacatctgcgcaagggtgaggagtcaattttttggaccattcgacgtgtacgtcgtgcacgcgcgccgtcggcccggccaggcgagcgagcgcacgcgtgtgtttccccttttctctacaccacacatgcttcaagtggttaggagggcatcctcccttttaaggaagtccccctctcttagaataagcaaggtggtactaaactccacatgcatgccatcccatgaggtgggcttttgtgattttccaaagaattaatcttcgagtgggctaaggcccattcattaattccaacatcaacaacaagcactcatgtgtggcctactccagaagtacaagcagtaccacaggattcggtgatggccatgttggctgtttcaactaccccaccatcgtgtgatccttcaactatactagcatctccgaagaaggtaatgctcatggtgttattaatgtattggttgtgcaacatattcacaagagaatttctttagtgttagatccaactttaattgttagtgtaagaccaatgttcagagaaaatttgttcaaatctcaggtgggtattcaaaacatttttttttaaatgaaaagcggcaaaagacttgccgaatatattagaagaaagaaagagaacccacatagttcagtttacatattacagactgggccactaggggtgagacgactaaaaactgatggacagtacttgataggattacaatttctcagaaacgtgggagaggcaactgaaaaacaaactcacagccccttaatgggattggttagctagatcaagctgggcaagccacttgattctcagtttgggagatttgaaggaaaatcctacggttatgctctagccatacaatccaccaggttacctggaggtctcccaatatcttcctcttggctattggagaaatgttgcaaagcatctcccaccaatccatcaaggtgggcgctgaaggatgctgagaaaccatatcatggccctgccactgacaaacttggttccaaatggctcgtgtcttcaaagtcacctctacaaagactgcatatccaatcacagggccaatgtctcttcaacaatttttttcacagggtaatcaaaacagaggatccccacatatccctaaagttggaatgacttttgaatcagaggatcaggcatatgaattttataactactatgctggtaagatcgggtttagtatccgaaagagtcactcaagattgagacgagatggcacaatatatcaaaagcatattgtttgcagtaattaaggagaaagaggtgctcattcatcacatgatactgtaaagaaaatgccaccacaaggacatcgtgcgatgctcgtgttcaattcaatatttgtcggaagggcaactggagggtgcaaaaggtcgtacttgaacataatcattaattatcttgcaaatccagataagagacacatgttgaggtcaaaacgtcgtttggtatatgccgataaaatttttattagtcagatgcgagaataagctgaaatgtacaattttttcaagcagtggtatggaggtactcagaatgtaccttttttatgaatggattgcaataatcatttgggtcatgagcgcaagaaatatttggaagtgaatgatgcacaaacagttagaagacccttcctttttttttatgccatacaattagatgaagaggatggttggaaagatatttttttctggacagacggtcagttcatcatggattatacttgctttggtgacattgtatcatttgacactacattacaaacgaataagtttgaaatgatttttgcagggaatttaactatttcccactattgcctttgccacttatccaattgcccctcttagatttgcctctctcttcttctttttttttttttttgcccttctaagataatggcttcttaactaattgccactttttcttacgtggcttgcaatcctaaaaaacagagtgggacccacaaatcagcctcttcccttcacttcatcttcctcctcatcctccagctcgctgatagggaggagcccgctcctagtccggcatccctccatgcctccctctgagcctggcaccgacgagctcccgtgcacacgcctccctccgcgagctccctacctccctccaagcctggcgctggcgagctccctccatgccctgcgtcccgcaagctccggcggccctctcctcgacagcaggcggccttcctctcggcggcgatgcgggtgcttggtgacaacaggcagtcctccctccatgcccggcgtcccgcgaactccgacggccctctcttcggcggcgggggatctcgaggagcccatccgccgccgccccgtggtcccgccatcattgagaggagggccgccgtcaaccgccgaggatcaatgaaggggaggacggcggggctggccggagcagcgtcagcagccggcggggcttgccgggctgaagggagagaggaaggggagagtttgtgagactgataagtgggtcccacattgatatttacattggtttgccacattggcacaccacgtgggcaaaagtggcaaatagttaagagcaattagcattgtattttcaagcacaaagcatcgtccttgcttgtggcacatttatgaaaatgctagtaaacatctcagccatgtaatttctaaacatcgtcaatttcttccacatttcaagaaatgtgtctatgaagagaggtctgtcatctgtggcacactttgaaagaaaatggcatgaactactgagtgcttataatcttgagcaaaactcatggttgaaaagcatatatgatttgcgagagagtgggcttctgtcttccgccatgattcaaagtttgtaatctgaaatatttaatctctgtaaaacgttaagagtttgcaaggattgtagtgcagatgctatgagctgtgatttgacatcttcttttgttgttcaaattgcaaagaaatcgagatccctttgtaatttgtacaatgtatgtaaaatacatttggcgtgttaagtgctctgaaatctgcattctgatggatgtgttaataaatgtgattatttatctgattccatagataaataaaatatggaatattgtgtaatccgaaatcttaaatgtctgaaatcgtatagtccagcattatgcatcaatttgatgctgtctggtgaattgataagtactccccaaaacgtttcggcactggaggctactggttataatacaaaagcgttttgaaccatagcttctatagccgccaaagcagggttgagtcgagctgacaaaggcacgcgagccgagcgcggaggatgggccgccacatatcgcacacggtgtggagagccgaggatagcgcaccattggatcatgcacttgtgcacgcgtcagatatgttggagcagggttgcagtcttgcagacgagagaaggttttttgcagccggtctccacccgccccagatcagaattttttttttctctttaatctggccatagtcggatagtccggcatccacggagcccacggggtatgcatgcgtatgcatggtaacagaacgtatgcacggcaaattaacaaatcccagtatgagttttgagttctggagtccgggacataattcttctggcaccacggcaagaagacggaaaggaagcgcgcgcgctgcggccgcccgtctccacatgtaggccgcgcccgcgccgtgtaaagccatgtgcgtgtgaccttgatggaggtgcgaggcgaggcgcggctgcgctgccgcgcgcgtagtactggtactgttctgcgtgccgctgccgccgaggccgagcgcgtccagattcaccctcacaaccacgtcccccgtcttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctggaaaataaagtcaggtgtaccgactagatgcacctaataggtgtagcccccgacaatgtggttaattgaacaaaccaagcatatagtcaaggaataaataatccaatcaaccgagtggttttgataatcgtaatcaaccaagtgacttgatatcaatatatagcatatgcagtgtgaaccctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcgtatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatagaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtgatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactattaatccatgtggaatgtatccggaacaagtccaaatcggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcggaatccaccaatcatgaagatgaagaaaataattggcggcgacaaacgcatccgacggtaatgatgattagcggcaacagagatagccgactatgatgacgaagtttcccatcaacggcagcagagttggctatgttgatgaggcttgacaagatgttgatgaagatgacgatgtcagtgatccagtcgatagcgatgtagcagccgatgataacgatgagatcctctatcggaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagaggcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcaacggcacaagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccgacgatgaagatgtagatgcccaacaacagcggcataatgggccaatcaacactggcagaatcatgcagccatggaagtgaagaaaccagtcggcagccatggcaaacgtaggcagcttgtgttgaagatactggtgcctattagtagtgacagcgatgtagccagccgtgaagaagatagcatcagttggcgttataacaggccagccgtacaggcggtgacaccagtcagcggcggatgcggcggccggtcggtgaagacgtagacgcccaacaacggcagcataataggccagccgtgtagggggaaacaccagtcggcggcggtcgaggcggccggtcggtgaagacgtaggcgcccaacaacgacggcataataagtcagccgtgcaggcgaaagcaccagtcggcggcggacgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagc

SEQ ID NO: 22172 - DNA, 369 bp, Oryza sativa
gccggtcggtgaagacgtagacgcccaactacggcggcataaaggccagccgtgcaggcggaaacaccagtcggcggcggcgaaggcaatccagtcggtgaagacgtagacgcccaacaacggcggcataaaggccagccgtgcaggcgaggacaccagtcggcgacgacgaaggcaagccggtcggtgaagacgtaggcgcccaacaccgtcggcataataggccagccgtgcaggcgaggacaccagtcggtggcgacgaaggcaagccggtcggtgaagacgtaggcgcccaacaacgtcggcataaaggccagccgtgcaggcggaaacaccagtcgcagcggtcgaggcgagccggtggtgatg

SEQ ID NO: 22173 - DNA, 530 bp, Oryza sativa
catgtgttatggtgttgcgcttctccgtgaaacgtctgatgtagtcggagaaacgttcattatcaccctgaataatttgatatatagaggtcccaggggtgccacgagtgggaacgtgccttggaagttggcgatgaactggacctttaactcggctcatgagtcgatagcattcttgaggaggctagttagccaggcccaagttgccgaagtaaacatcgatggcaaataattcgccatagcgcactggtcacctccggcagcttggatggcggtggagtagactgacaaccaagaagtggggtcagattttctgtcatatttgtcaatcccatctgctttaagttggcaggccactgcacccaacggagggtgttggtgaaggcggggaccccctctgcttggtcagggtgatggaagtggtactctatagattgaatctgtattggtgtgtgcacaacacgacgtgtgaatagcacgtgctccctccggtttcattttaattgacgttttggacaatgacgggctgc

SEQ ID NO: 22174 - DNA, 617 bp, Oryza sativa
ggcaacttcgtccttgtcagtaagcatgcctcccggactattaaattttgtgtaaaaattttctatacaaaagctttttttaacaaaaatcaaataaatctatttttttaggtttacagtaaaacaatactcgtcaatcatgcgttaatagtttatctcatttcgcgtgtcgtcaaaaatcccaaacgaactcagcctaggtttattttggagttgggttttttctagcttcgggaatagggatgataattttgccaatggatccgggtatctgcggatacccagcccaatgggtatagatgtgggtgtgattttttacccgtgggcacgctcacccaagacccgaagatgacatcttaggcaacaaccaggtctcattttttacccatagataacccatacctaaccaaatacatatgtattagcttatttcgatcatctcttgattcttatacccctttctcttagtccatttatgatgctaagtttgttactgatatgatacatatgtattagcttatttcgatccatctcttgattcttacgcccctttctcttagtctatttgtgatgctaacttcaacatcgcctatatatattcgttcatgaacaatgtt

SEQ ID NO: 22175 - DNA, 20682 bp, Oryza sativa
  unsure (1)..(20682): unsure at all n locations
catcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttgtttagcaaatgaactaaatttctatatattctttcttccacacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggatgggactttagtcccggttggtagcaccaaccggggctaaagatcaccgggatctttagtcccggttggtattaccaaccgggactaaagttaccatctttagtcccggttggtgttatcaaccgggactaaagataccgggagggcctgacaggccctgacagcattcgaaccgggactaaagatgatctttagtcccggttggtaacacaaaccgggactaaagatcaaatatgcccgttacccttttgaaccgggactaaagaacatctttagcctcggtttttattgcatccgggactactgtggaaatcggccgaccgacgaaagatggtttctccaccagtggatatagatatagatatagatatagatatagatatatatatgtgtgtgtgtgtgagaaaatgattctatacacccaggtgtacgtactcctggttccatccaccgtccatccgcacacaccacctttcaagccagctagcggatccaataccgagcccgttttgatttttgtttccaaaaaaaagaaatcctcacgatcttaattattccgcactagccggaagcccggaaccctttcgaattgctcgtattaatatctcgtgggtggttctaaacagaatcgatagatcgatctgcaggttatatcgcgatcggacgattcggaggtgacggcggcacgacccatcggcgattcggaggcgccggcgtcttccattactggtgcctccggtatggctgtccccgggcgattggctgggcgaagcgctggtgaccaaacaacggcgccgttattcttcgggcattggcaagcctgtgtgtccgtgcggcgacggcatcgatccaggcccgtgcaacgatcaagatgacgatgagcgccgtccagaactgcaacatcgacgatgctggcaagttcttctttcttccgattttcttaatttgctttttcttgcagatcgataatgcatgcatgtatactctttcattttcctattagatttatctctcttaatagcagaagaggatgcagacatgcatgcagtccccgacctgacgctgatcgaatgataaagcatctaaagaaacgaatttgtttggtgaatgcagatacgagatgcatgtatcgtggacatggatggtgctaaccacagaacagtccagcatgtgcggacgtgcggcgactgcatcagcgttggcatcgaacccgtgattcctagttgacggtgttgatcaaggaagacacattcttggccccttctctggcacgcggtcggcgtgatcccattgatgctaaccgatctgttagcggggatgcagagattcttcgatgagacttacatcgagggtgatcccgttatgtttttttagtctccatgcatgttttggtttccgaaagtcttgcattgtttttcttctttggtctgtccattcagaattcagtgcccttctagggtattttttttattcataatgcaacaacccgatactttaccagtgatccagtctgtgaatctttggtacggtaacacttctatatcattgaatgatacaatttattcatagttagcaacccgacacgtcccaaatgtacacactcttctctaagaaaaaatggtatgtgctattttacttggaaaaaagtacatattctattcatggaaaaaatgccatataccatactctcaatgaaaggtattagcaatataatgctctaaagaacagcatatacccataaaaaatatatacttggtatgagaaagtgtataccggtgctaagttaaaaaaaagggtatatactgcactaaagaacaatatatatatactcataaaaaatatatactggtattagaaagtatatactggtactaagttaaaaaaaggtatatactgttactaagttttaaaaaaagagtacatacgtatactgctactgcagtttaaaaattgtatgtacttgtacatctagtattctagtatataccggatcctccataaaaaagtatatgctgaaactaatcagggatcagtatataccggacataccggtttccttgaagatactgatcgaataacaagaagtagtatatgcagtatatatactgacaaaaaaaatatatatatgcagatactgatcgaacaaacaagtagtagtccctagtatatgcagtatatactgagcaagcaagaaagaagtacatactcaaccgatcgatttaagtatatactgaatacttgagaaaaagtatatactccttaacgtatcaatttagtatatactggatacttaaaaaacagtatatacttttaggaaaaatactgtataatccaaacatatgcttgacgtgattaaagagagcaaagtagactgctccaatgagacatatactgcccgtaattacaaagtagatagtgtatacaggtactatatataccactactttgtgaagaaaaaggattaagtatgtacttaaaaacgtatgctctcttttctaatcattttgatgaagaagataagctccacgtgttctgagtatagttacgtgcatttaaattttgaaacacacatgcactcggtcagtcggttgtaacaaaactaaaagaaaataaaatacctttttaaaaaaatctgactcaccatgaacccattggataatccaatatggagagggtgtatgtactcccggtgtatataatggtcatcatatatatatatatatatatagagagagagatctactctaggcgttgcgcgttactccctccgtctcataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaatttcttgaataagacgaatgatcaaacattgacaaacaaaaactcaaaaagacaagtaatataggacggaggtagtaccaaataccgtggcgcgactaacaacgataccccacagcgcgtcctgtttttccgttcctagcgatatccctcccaatgttatctcaggaaaaaaaattactatgtggatccgtgatttccgtttttagtgtgatcgcttcctgatttttcgtttctgtttttcacgagtgctcccctgaccggaaacaataaatccagttgcgtttgaaccaatcaggctatcgtaacaaaattactgatgttcgctttttccgttccgcatatacctcctgctacttgcttttcatttggtccaagtaaaaaaattactacctatcgtgctccaaaataggccaaagtaaaaaaattactacatcctacgggtcagtaaaaaaataattaaccgcctcttgtataccaacgtagctctagtaaaaaaaatgatatatcctactagtcagtaaaaaaaataactaaccgtctcttgtgtaccaacgtagctctagtaaaaaaaaatgatacatcctactggtcagtaaaaaaataactaaccgcatcctgtatacctacatagctctagtaaaaaaggtgtgcctcggcggctgcggcggcaacaatttgggagggatggacgaggacgcaggcaccgggatccccatgcttccctccctggtgctggctgaaatccgccccaaatgcatagcctccatctccatggcgttcccatccggcacacatggcagtcctcttctttgaccaccgccggcaactacacgtctggtggtggcatgactgtatctaagagcgtgctcgaaccagacaagacactaatttaacaaaacactaaaaaacaagaccataacaaccattgacatgtatagagctagcgtaaccgttggcatagtgcgagtgatttccgagggcactcaatagacttagggtttgcctcaacagaaccccctcatctgtgaatctgtgatgggctatggggggtacatgcctcgtcagtgatgagtgtcctcgccatctccactcattgcccctgcacatgcttcagtgcttcactaatcaccacagtgagctgtttaaagtcaagtatctgacacataaacaaaaactgcttcatcatatatatatatcactgaaagcatccaaactagaattgaatggaaatatatggatctcattctcatataagaatgatagtacagatctttaccaaaaagagatatggggttctcagtcaccacaatagcactacacattcacagaacgggatgatatgaaatttatcagatcgacacaatagaagggaaggggcaatgcaccagatttggtccgggaaaacggatccaagcagccgagtcgacaaggacgttgagcagcctgttgcctcgagctcaagggccgatcgtcacatccgcaccgtcttgtgcctgccatcggatctggctgccctaaactcaatgcatggccactcaatccagatgagctagggttggaggaaacgtaactccacatagagattgatccgtcggtgaaagtggtgcatcgaggtggaggacagttggtggaggtggagaagagccggcaaatatatagcaaattcgaatgtgggatttgggcagtccgtcgacgagagcacgatgagctcttgggccgcaatgatcttagagccaatggctcgccaccaaacctcatcctagttctctgggggggggggcctaatacgcgactagtcgcgtggcccccatgcgcgcgatcagttctagtactagtagtattagtctagtactggtactactgtagtactactactattactacactgctattactactactactagtgttgttatactactactagtattactactataaataaataaataaatatatctatattttttgatgtataaaaaaaatatgcacgtatacaaactttgtatacgatgtgtacaaactttgtatacgatgtgtacaaactttatatacgtacgtattaaaaaataaaataaaaactagaaaatacatcatgtatacaaaatacaaacttttgcatacgcgtatacaaactacgatgtgtacaaactttgtatatgatatatacaaactttatatacgtacatattaaaaaaataaaataaaaactagaaaatacatcacgtttacaactttgcgtatacaaactttgcatacgcgcatacaaactttgcatacgtacgaatacaaactttgcatatatacgaatacaaactttatattcatgcatctttaaaaaaactagaaaaaataagcagaagagaaaccggaaaagaaaaacgaaaaaacctaacaaaaaagaaacgagaaaaacggagaaaaaaaaagggaaaaaaacaaccgaacagaaacgacaaaaaagagaaaaacggaaaactcgctactccctcctcctctcgcgcggggcgtccgccgcccctctccgcgcgcgacacatgtccagtcgcgcggggaggggcgcgcgcgactgatcgcccattagctttttcgtagttctccccctccacctccatctccgcctcccccttcacaggaatcctaattggcgcgtacgcgccggcccacacggcccaagacacggttagttttttttcccgaattttttcatatatgtgtaaactttcaacccagatttgaatactttcaactccgacttgaaaactttcaactccaacttgaaaactttcaactcagattcgaaaactttcaactcgagattcaaaaactttcaactcagattcgaaaactttcaagtcgagatttgaaaattttcaaatcagatttgaaaactttcaactcgagattcgaaaactttcaactcagattcgaaaactttcaactcgacatttgaaaattttcaagttatgatttaaaaactttcaactcaaaacatttagaacaaaaatacgtgtgctaaagtttttaaaaaagtaatcagaaaaaagaaaaaaaagaatcagaaaaaagaaaaaaaagctaaaagaaaaaatcaaaaaaaaaagaaaaaaaatcacgaataaaagagaaaaaaaggctgatgtgtcttgtgggccggggggcagctgcgcgcgcgccaactagcaacccccctccccccctcatggacaacctcgggatgacgagcccatttctaccattccgccctctgcttaattccctccttgtctctcccaccgcctccatccccgagcaaccgcccacactgctggccttttgctggctcgagagagagttcaagagaccgagagagagcgaaacggagattaaaaaggaaattggcaaattgcctcgtcgtacatgcaggcctcgtcagtgacaaataactgctcatctatgatggagttgtgtctcgtaataaataagcgcagccataagtttccgtgtcaaaaataagcgcagccataagtttccgtgttcaactttgaccgttcgtcttatttgatttttaaagaaaaatctaaaaagcatcagtcacataaagtactatttatgttttataatctaataacaataaaaatactaattataaaaaaaatttaaataagacagacggtcaaaattagatatggaaacttatggttgcgcttattttgggatgaagggagtttttatttaacccgatagaactaacattatctgtgacgggtcataatcatccgtcgatgatgtatcatcacggataaacgggaaaaatatgtggtgaaaacaaaaaatatagtggaaacttgaaaactaccgttggataaaaaatggacgtcggagattcatcaacgtcatcacgagtaaaaaatttactcgcagtaaaatttttactcatgagtaaatccgtgagtaaaatttttacttgtggtgacgtggacaaatcttagacatccattttttattcaatggtaactttcaggttttcatacgtggtttccaccacatattttctccggataaacagttatgtagcagtgtatcttaaatgtcgcccatatgtatacaatcattgatcatgtagtgtctccctaactaatgctataagaaatttgcataatgacaaattgtttgtacaactctcattaattctaggaaaaagtataaaatacccccaaactatcacggtcgaccgaattaccgccctgaacccgaaaatcagacactgttcaacctgaactttcaataccggacgaagtatccccctcgacccaatttagagcggttttgttctacgtggagtacacgtggcaaaccagccagcattttctttaaaataatggtgggatccacctatcatacctctcttcccctctctctctcttgcgcgaatggcgcgcgcggcggtgaggggacaggtggtggcgcagatgatggcgcgaatggcggcatgcacggcggcacgcacatgatggggaaggggtggaggggagtggggagggggacaccataaggagtagcaacccggtggttggcggcgggcagtcagtgaaggtggacggagtagcggcgagtccagcaccccgaggctgtggcctggaacaacggcgcagggatgagagttgtccatagcggcttgatggatagaatttggtgtctggtgacggagacgggcttgaaggcactgatgacgacgagccccgagcccacacgatcctgagtgaagagcggaaggttggcaccggcggagggcgggcccaccctccacctgaggacgcagaggatggtgccggtggcaggccggtgatggctcgggcaagggaggccatcggcagagaaggagccggaggagggctcggtgcaccggcgggggtagaggcaaagccccgtcagcgaaggagaagcggtgccggcaacgggcttccatgagacataggttggaggctggtggagaggaggcgtcggtggtggaaaatctggtggtgggcgacgggtgaggaggagccgatggcagggagatccgccacacccgtctctggcctacgcccccgccacgctcgtcgccggccacggggtcaccactcccaacggctcacaatagagagagagacaggaggggggaaggnaagaggggaaagagaggggtgagagagtatggtaggtgggtcccaccatgtcacgccccgaaccagttccggcgggaactagcccgtgacgctccaaattaacctgttaatcgataccagtcccaggaaacagtgctggtatcacagggagacagaatatcatagcaacagaggtctctttattatagagtaggagtacagtcatgttgggctgcggacagatcctgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatctgcttcatcttcttcagcaactgggggggggatatttatatagagcaagggtgagtacgggagtactcagcaagccaggggaaaataagtgtttaatgcaggcttcaaggaatggctgttgtttttgcaattgattttatttgaactcttttctaaaagcaactaagtgagtgcttctcaaacgacacggatgaggcagtgcgtctcgtccggtcggagtatgtgcaatgtatcagtctttagatttgaacaagattggcacccggccaaaggccttttaaacggccacccgggccaacaccttttcaaacggccacccgggccaacaactttttaaacggccacccgggcctagctgatcccgtcagctgcggattcttttcaaacatcgaacccgatttcacaacagcaatttcacaagcagtagtcaaacaaaactacgctaggaatcacctcacatccgcccatgaccgtgggcacggctgttcgaacagtttgttaacctctgcagagggggtacactttacccacacgtcattactaacccgggtcacccagcccgtggggatcagccacgtcgggagacctccaagctttcatgacaaggcatttcgaaagccgatgcaggtttgccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcacgagtatcgaggcgcaactgggtggttacaaggggacatggcatagcaattaacaatggaaggatcaaatgcgacaaattaggtaggtctgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgagaataaagccctattaatgacccctaagcgtgccattagatagatctcgagatttgggaaattttggaagttgaacggagtcaaacggagttatggttggaaagatattgaatttctaagattattggatttttggtctaaaggaaaaaggatttaattaaatcctttttggaaaaaggaaaaggaaatgatgaagggagggaatctagactttcctcgggcggctagggcgcggcccaaaggtattcggctcggtccggccgagctaaacgggccggacggcccaaagcggcccatttacgcgcgcgcgcgggagaggagagagagagagagagccggtggaccgggctcacctcgcgcggccccgggtgggacccgcttgtcagcggctcggcccaccgtgcggagggagcacgcggcgcacgcgcgcgggcgaaagggggaaagcggtgcgcgcgcggtttacggaggactcgggtgcggcgggcccacgcgcagcctcacggcttgcggtggaatgcgcgcacggggagggatcggccggggtcggcccgtcccgagctcagccgagctggcgccgacgtggcgcctacgtggcggccacgtgggctggcaggaggtagacgacgaccggccgcaaatgaacggcgggcgacggcggcgagcggtagagcgggccacggcgataccggcgaaggcgagcacgccgggcggtagtacgggacgagaggagacgagccaacggctcggattcgccggaggttgctcggcggcggcggattgcggcggcggcaaccggcggcgggagaagagggaaacggcgacgaggccacgagaggtcgatctccggcggtgagagcatctacaaggccacgggaactcgatgctagggttggattggacggagctatgccgagctaggctggcgacgtgcggctacttcggagctcgggcggcgacggcagcgagcacatggcgagcaacggcatcggtcggggcggcgccggccaactacgggaggtctactcgagctaaaaccgaagtctaaggggggggagacggagcgaggagggagaacgaagcgaaacatcaccgcgggaaggagaggcgctgtgacgagaggccgacggcgcgggagtgatctctccggcctcgggccggggaagaggaagaagaggcgcggccggagtcctcttcggcgtcctcgctcgtgccggctcctccgacacgcgcggcgacgattggagacggcgaaaatagagacggcagtggaggaggcgaaaatggggaggaaaggagaaggggaggccgggggtttaaggaggcggcaatgtcggtttggggaaccgacttgcgcggtcaagagcgcgagctggcgctcggctagcggccaaagcggtggcagacgggatgacgccggcgggagaggaaaaaggaggaagggaaaaaggaggaggagaaaggaattctctcctttgccgattcgggaaaaggagagtgggcgcggggcgacgacgcggcagagggaggtgaggcgcggcctccgggccttggcggctagcgcgcggagtggcgggggccggcgatgacgacggcgggcggtttggagcggagcggcgacagcggcgactggcgcgggcagagctgacggcggcggcgaccgggcggtcgcccactcggcttgcgcgggcgcgaggcaacgggcgacggcgcgcgggggggtgggggaaaaaggcggggcgcgggcggctcacgcgcgcacgcgcgcggcgcgcgggcaaagcggcgggatcgggagagagcgagggagcgcgagggagagagcgcccggggagggagagagagagagagagggaaatgggccgggggggagagatgggccgggggggcaaggtagactttgcggaggaattgattcggaagatttggattcggaatttgaactcgacgatagatcggggattgagatcttgagatggcacggacactagacaacaatcaaaggaacaaaatttcgcaattagggtttttgagagataattttcccgctaggcgccacgacggaacgggcgctacacaccattttttaaataaaaaaatactgactggattgccatgtgtacgtcccataggataaaaccgcttcggattgtgtcgagggaggttattcatccagtatagatagttcagggtttaaaacgtccgattttgtggttcaagggataattcgtaccgtcagtgatagtagtgatagtcaggggattatttgtactttttccttagtactatcgtttggcagtacgccagtaccttatcagtccaacaaattaaatgtgctccgtctttaacgttgggatgccacttccctgttcctagattacgttccgatctttatcccataataacaaaaggctattccccataaagctcagattagtggttatgcctcgcctcctaatgcaagttttatagtggagatgatagttaaccttaatttagtccatatcatcaacttattaattaagaggcaatacatagaacaaattacctctagcacacttgtcccaatacatcgtattaaggtcatctttgtttaggttaataagccaacttataagtcgaaaagtctaagcttaaacaaacttttcatttggcttttttgaagtcataagccattctaacaccattaagtcaaaagctaggttggagaagctttttttatcttatgtgaggtcgatgtatgactccaccactaaacttaggacattaaatccactgcttacaaaatcataagccaataaactgatttaaaagtctaatcctaaacaaagagggcctaattttactttatttgtttcctatcaattcattggtctcttgttcttatctatcttagagtttgtgtagaggtagcccttgcatgagaggtggcttcttctctcttctttcatatctctcatccaccttatcgtatgagcttacatggcacctagagacaagtgcgtagaggcttgtagtacttgccttaataaactactcgtattgtatatattactatgctagtgataactgctacaaatacatcattgagtatgcaacttatactgattaaaaagaactttaccccggctaactaaaatataggagaaccctctatacaacatatataaacaaatttacatatactatataacacgatgtataaatcaattatcaccaaagtcaacccatgtactgtaatctgccctttctgtcccccaatattcttttgttgctgctccgtatgctaattcataagaccaaatgtttgaaccacatgtttcaaggtacgtatctgcgcagaacggtaactttggtacgaatgccaattggccatcgcgagcaacaagatcaacgtggacggtctcaggccacttatagaatcttggaaggaatatcatattctgcatccacttaaatttggacctcttcatcatcgtcgtcagcgatccagtgaatattgtttggccttgcaagctctctacctcctcccactccatcgtttgatcattaagcttgacaacatggacaaccttcccacggcgtcctattagtacaaccatcaactcacctttattggactcgaccaagtagctgtcttcacatttgaatccgaagccgttgggcttgttaagaatctcaaacccttcatcaggcctgcaaggattatacaccaccaatttcccgtcttgagcaagaaggtatagcaaaccgttatggaggacagggttggtgactggtgatgcccgaagccgtggacagtagagatgattctccgtcgacttccagccctcccactcatcactggtgtgtcgaatggagctagcaaccttgatggtgatagttgccttgacaccaaatagcctctcatcatcacggtcggagacgacaaaattaaacaacatataaggttcttgcggcaatacttcaacgagggcgccggtgacaaggtcgatatcatacaccaaggctttgtccgcgcacatcttgaggtgccgtcccgtggagcagcaaatcttcgcgccaggcaccttgagagtgtcatcgacctcgaaattcttatcgtagtaggggctatagtatcggatgttggcggtgccaacctcggcggtgttgagcaggagcggagtgatccacgccgggtaaaagggacagagcgacgcggcagagcgccagtgccggcacaccaacgcgacgctcgggtggctcgaccaccgcagactccccagaatcaggacgagcacgtccgtcgggagagacgaccagccccgagcctgtgacgtcgatgccatctcgatcgcttgctcgatctcgccggtttaaaccgtacccagtgccggcctgatcgggagagacgacgtgagcgcggtgtgtatcttcgtctgcctatggcgttaattttcttccacttatgacttgctaatatgtacgtagggcgcagtggagcgaaaataccaatcggtttacatgtgggagttgcaatgcgatccgagttgtccggggaaaaacaaacctacacgtaaacgtacatacgtgtgccgctggccggcacggtatagctctgctgcacgtacggtcggcaatttggaacggtgattttccttagaaagggatcggattttttttctactagaaaaaaatgcccgtgcgttgcaacgggtgaaggctattttaattatattattgttatgctagaaaaatgcacatgcttcgttatgggtaaagcaacagttaaatgctataaagtctagagttaacatgtatatatatataataatgtttcaagatagataaattattcattaggctaatgataatcacgccggataaaaacacgctctctctctctcaacccttgtgtgacaaactgtgatatcattgcactgggtaatggtgaggtgaatgaaatttgacctcaatgatttattgaagcacctttatagttatcacaaatgcatatttgtgtttggataattaatccgctctacacgtgcaggatgtgaatgatgtccctaacacatggtcccgatgattgtagcattggagaaacggacgttcgagcaacgcacctttacgtataagtaaataatgaatttttttgggagttcattaattattttaaactacattttttatgacacttttataatcttttttcataattgatgattgctataacattgcattgattataatcacaatgcaacagtacagtgctatgctctaaccgacaaaacctgaacagtgccagccgtaccatgccgttcctttttcttttgtagaaaacctcttagcacataattaattgagttttattattaaaaaaaattaagaaaaaatatctagtattttatatcaacttgtatatagaaagttttaaaaacacgctaacaaaaatcgagatagaaggaacggagccatggtgtgaagtttcacgccatgcacatattcaattttcatgtatttttaaaaaataccggttggttcacgtgtttatactgatttttttatataatataataatctttatttttcgaattaaaaactggtgcactataagatttcagaatcactaaaagtctgttaaagaaagaggtgcagaacttttgatttttcagccatcggatgtgcatgatccgtgctagtggttgagagaaaaaaaaatacgcgcaaatatgatttgggacgagggagggaaagtagacttattctagggcctaggtcaacatatatttatattgatttttgtgaatataatttaattgtttttaattttcgaattaaaaactgataagataaaatttcataatcaataaaaatctgttgaaaaaagagaaataaaatcgaaggcaaatataatttgatgtgggggaggcaaagtagacttattttaagagaggcctatacagtgcaagtaataatacacatgtaagagatattacggtatatagattgaaaccgagaggagcggtggctggcctgtgctgctgtgctgcctgtctattttataagaaggctcgtgttttgcgctgtgaattagattccaactcgactgaataatcgaatcagattcgaactcgccgtaaccgcgtggggttcgcgtacgcgcgctgccacaaaacaccataacaccagtccgaccgcgctccttattccgacctgatgctcagctctctaccgatattgtactacatctcttctctagtatctctactactccctccgtattagaaacataacaatcgacgccatcagatcagataaccaacattttttttttgaaccaaaagtttgcatagacatcctgtcacaccccaatccagcactaccatacaacggcacctaacgggaccgtgtcgtaaaaaaaacggtgtaaaccgcttcctacgaaaccgcgatatcggtagcagtcccagtacatagtgctggtaccgacggtgacaataatgaaccattgcaatccttaaattaaataaatgacttatctaccttaacttaagttgcaaccctagtaaaaaaaaacggaccagcccaacggttgaaccggaaaaaatcggaaccagcccctcagccggttcggtttgctgtaaggaccggatatgccatcgaaccagtcacaaccggatgaaccgggcggtttttggtgaaaaccggcgaacaggacgcatatgaacaagcggttctggcgagcacgtggaccaggctacaaaggcccactaggcttataattgagaattgtcaccacccctacattcacctcaaacctactgcgggagacggagcaattaccgggaattaattacctagagctagctaaacactaaagcaatcaatatattttactggattacagggaacaagatcccgcacgctaattaggaactaaccaagagttaattctcaccgagcaaatcttaattactcagaatgataattatattaaagatgagtaattaacaaagtaaaataaataagaagatgattaccgacaactccagaattcctccgacttcttctactatactctctccctaattctagtatacaaaaaagtacaataaaacctcttataattcagctcaagcttggagtgtgtgggtgaagtgagaatgggagctcaatttataggcaggtaatggtggttataactatgtgaattgtaggaattgccctacaaccaccatcaggagaccatctagaacgtccattacaaaacctggattcaacggtgatcaccagggttcagccgaacctgggctgggcccccagatttggtctgggcctcctcgctgctctgccttatccatttattcggtagttgggcccatgttctgatgttttgatggagtttaggagcccagctcttgtatggatagaattcttcttcacttaagtctaaatttcctcccaactttggtggtttatcacctgcatccaaatatacacgaaaaatgttagaattaaaccctaccactatgtttgatgtattattaactatgttttatgcaggtattggcagcatagaattgtcatttaatagctgccaacactggtattttgcaatcagttttgttttcgagttttcaacaatctaagtgtgtgatttccacgaccagagtgagacgagtcttagctcggtcgggggtgagaagttacaaattgatttgcatgttttgcacaactccctgagttgacctcaaagttggttttcccaaccaaacgaatttcccaatctttcagagtttggttgtctccaaacaaccaggtacttcttgggactgggcaacaaccagttacttctagggactccctgtcccactgtctccttgatagccacttgcttttccaaacatcaggtttcccaaaccacaacaccttttcacaaagcagggtaacacaaaatctacgctaaggaatcagtccttaaaagtgaccgcacaagcatcacgcacaggaatggacttgtgtcgcgagttttgtttttaaaactcacattctttcacaaggcaccgacctaggcgtcgggttttccaaagcttttataaaccaagttttacccaagatgtttctcatattttaaatttgcaagcgaccgtcgatactcgcacaacgtgcacgaatatcgaggcgcaacaaggtggttacaagggaacatgatataacatttaacaatggaaggatcaaatgcaacaagttaggtaggtccgccagtctgccttgcagacgaggcaaacagttccagtgtgtcacgcccagaaattcacgaactagaatttctaagctgaatgtgcattaaaccccctgtccaggaccagccagggtacacaaacgacaattgttgacatacagatccacgtcttacaaaaatataaaagattacaaatgcagcggaaaagataaaagcgagataagcctgaagacttgactcctgcagcgggcgattccattccacagacaacccttgacggcagcgacgaaaccaacctcttcgagacatcaccaactgagaagaatttcaactctggtgtgggggaaaagagagcaagactgagtactacccactgtactcagcaagtcataccggaagaggaggtatgatgcaagatatatccaagggaggctaaagattcttttgcaaaaagccggcatttcaaagcagtagttgaaaacagtaaaacaatttcagtaattaatcaatattgaccaatcactgctcaacgctacaccacgttgagacaggcccaaaccaccacctgaactaaccagttccaaaggctaactaggggtgagactaatcacggtgaatctggtcgaccgcccataaccgcgggcacggctattcaaatagttttactctgatcagaggtgtacaactgtacccacaagacacagccccacgacacgttcccgtgcgccgacatgccaccacgacataccggaaagaggccgtgacaggactcttcgcataaccccctctaaccgatcgcaccacaccttagggttcgcccccgtccccagcaggcaacgggcagcccccctttcgtgccgtggtgaatccggaagccgatcaaccggacacctcggccgacccatgtaacgccccgattttcgttcgggattaaaatttatttaataatacattttctagaaattaaataaaagttaaagcaatttaatcaagtgaaattatggaggaaattaaaatttcctttaaaaatcattggctggaaatattttgtaatattctttgtgccctaatgtactctccggaattttccgtgaattttcggagctcaagaagtaattttaatagcacaaagttcatccaatcaatttaaataaagagaaaacaaattaaatttccatcctcaccttttgggccggttttcggccaatccacccctttcttcattccccccc

SEQ ID NO: 22176 - DNA, 24201 bp, Oryza sativa
  unsure (1)..(24201): unsure at all n locations
ctctcccatttccccctcctccccgagcccgcggcgccttttcccgctctcaccgcgcgagccccagctccgccgctcctcggcgaactccagccacgccgcgccgccgctcccgttcaccccgcactgcgccgtcgccctccccggcaccgcagcagccgtgcgcaccccgtccaccgctccattttccctctccaccttcgaagcgccgcagccacgcgcaccacctnttttcgccgccaccgccggctccagccgcctcttctcgccgcttcagccaccgccgtgccgtgccgtcgccaccgtcggcatctgcgcgccgagctccaccccgtnctacacctctttttcccaatctcccaccaaaattccacctncactggtcacccgagccgccttaactataccgnctccagccgncgtctntcgtcgntctagccgtcgccgcgccgcgtcgccgcgctccaccgcaccctggctgccgctccattccgtccagaaccccacgggagccgcttttccaaagtcaaggtgagctccactccgtatcgccgccgtcggcagtcgtttttggtcgctccgtgccggctcttccctccctaaccgctccaatatcttcccaaggtcttgccggccctcggccgcggctccgttgtggtcgggcgtcgtcggaacgctgttcccgtcgcctcccatcccggccgccgccatcctttccgccgccggtcgtcgccgaggccgcccgcgccgtcttcccgagaaggcgtcgccgccgcccgttgcccctcgccgccatggcgctcggtgagctctccctccgtctcccctccctttttccctgcatcggccgcttcccgtgcccgccgctgcgccgcgtcttgtcgccggcagccgtccggccatgcgccgccgccggcgttcgggtccatgccgctgccgcgcgctggccgtggcccgttgctcaccgtggaccactgtggtcttggtccacggtgtagccagtcaccgtggtggaccgagtccaccgtgggccgcccccttggcctgctgacgtgtggggcccgcctgtcggcgccggccctttgctgacgacagcgcttgtcatttcctttgagaaattaattattaattgcgcaataattcggtttaattctagaaattcatttaaatggctcaaaacttctaaaatccatatctaattcattcgaactccgaattgagccgttcaacttgcaaaattcatctaaaattgagctctacatgtttgtttactttttatgtactgttttcttggtttttattagtgtttttcctcattttgcgtgccagcgtgtagaatccgtcgtttcggaggtccgcggtcgcgaggaaaagagttcggaagattgttttgaagaagcaaggcaagtcacacattccccttgagcatattgagcctattttataaatgtttcaccgtttgcaaataaatatgcatgttttgctaattacatgggatctgggtatcacctatctgctcgcttgtgccatgtttacttgatatctgtcctttgtcaaccttgggtaataaataaactagctcatgttacttatgtgacctagctagaactatatgcttagccctgcttaaataacactagctcagttgatgggataattacaatattagacctttttagtatcagaatgagctgcgtgctcaagacatctggccatgcttcatggtcgtaattatccaactaaaatgcgactacatggtgggctgtgggtgcatggttttgctagtcgcacccatggcaattaaggaccggttcgcgggaaaccctggaagaatttatcgtgcttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccggtatgtcgtggtgacatgtcggcgcacggaaacatgtcgtggggctgtgtcttgtgggtacagttgtacacctctgatcagagtaaaactattcgaatagccgtgcccacggttatgggcggtcgaccagattcaccgcgattagtcccaccctaataaatcgacccaatgcaccgtagttcaggtgggttggttgggtctgttcaacgtggtgtagcgttgatcagtggagatttaatgttactttaattactcaacagttttactgttttgctcaataaaatgttttacaactgcctttatgcaaatggccacaaaccgtccttgtgttccccttgcacgtctgcatcgttggtgtggctgctgaggacggtggttgtactcagccttgctattattcccccttttcagaagtgtagtgcttctgagctgaagacgaagttagaagaccaaggctcagaccccagttgagttttgcctgtggggtggagctgaagccccgctaggatcgccttttccgctgctgttgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaacccaactccatcacgcccaccctcgcctgggtacgtcggctagagaaaagctacactacaagcccaaccgttgcccacgctggcttgtggtaagtacgataagttcttccagggcatcctgcgaaccggtccttaattgccatgggcacgactagtaaaaccatgcacccacagcccaccatgacgtgtattttaattaaccaacaccattacggtggcactaaaccaaaactatgccgataatcaagtctatgctttaatgtgatccccctttgtgcactagttgaactaagcatggctaagcatctcctaaatcaacatctagtcattttaatacccaagttatcaatggcgtaagggaaacaacataaagctgagtaataggacccatcccacatgatattgtaaaacaatgcaatatttaatagaaatgcggaacatttgtaaattgggtacaatatgatccattgtaatgtataacttgccttgctctcgcactgatggaaccacagcaacgtcttcgagaaaccgcgaatcgacgaaacgaccgaaatctacgcgacaaacaaagcacacaagcaaaacatgctataagactactgaaacaggaaacaaaaccagtttttaatggattctatacatttttatgaatttactgagacttgaatggacttaatcggagctcggatgaattagatatgaattttagaagattgtttgtgtttttactaataaagaaaagtccttaatgaattattgagcaataaagcatcccagtgctgacgtcagcacaaggatgggtggcgccgacacgcgggacccgcgggtcagtgattcaaggagagagaggggcggctggcaagcgggccccaccgagcggcggctcatgggggaggaggagacgcccggtcggctcggctcggcctcaaaccggccgaccggttatgcgaaggcggcggcgcgcgcgcacggtcgccggcgacggtaactgcggcggtaagccgctggcgaacagcgcaaaggcggcggcggcggccgaagcggcggctcagcccggacggcgctaggagggagaggaaggggaaaagagggggaggggcgcctcaccgcgagttggccggcgtgggggaatacgacgtcgaacggtgacggcgagcggccggggacgggcgacgataggcatacgagctctgagacctcctagggaccaagatgggagggattagagggagaggggtggttaacggcgagcggattcgccggtcgaaggcggcggccatggggtactcaccagcgcgcgaggagaagcaagctccggcggcgggattgatcggggaaacggcggacggggtagcgcacaagcttgcgaacccggcgccggcgacggcccggtgcggcgacggctctagcggtggcggagtgcggccggagctcgcggcgaacggcggatggcggggtgaccggcgcgggagcaatggagagctcgggagggcttggctgaaaaaggaaaagagagaggaaggtgcgagcgtgctaaaataaaagggggggcggcgagtcgtggccgggacggcgcaatttccccggagtagtggggaaggtgaaggagaagagagaaaaagccgggattcaaatttgaatcccggccatctcgcgggcccgggggtgagcgggagtggggcgtgggcccgggaaagccggggcgcgcgggggagtggacgacgtggcccggggtagcagggagcgcgggccggcggttgagaaggaagcccgcccctccggctggaggttaggggcgatcccgacaggtgggccccacctgtcggcgcccgggagaaggtggggaggccggatggacttcggggagggggaggacaaggaatgggccggcggcccaaaaggaagaaaagaggggaaaaaaagaaaaagggaaaaaggaaaataaaaggatttctagggattctttaatgcttgtgctctattttaattggttaaaattatttccaaggctctgaaaattccactaaaaatcccgttagcttattttgacatgtagaatccaagaaaaattccacatgccgattccgattatcatttgcatttattaatttgaggaattagctctaggttaaattgaacaatttcttcggacgatttattttacaaattttaaagctggaaaagggaacttcagggcgtgacacagtgcaatcctatcggtgcataaatattttgcaagcaacataattaagttcaaatattggctcaatatgttcaaaagtggcttgccttgctcaaggacttgagcttcacaaatcttcaagaaattcacgcttgaagaaaatccggtaaccgcaacttggagctgaggtggcggtgcgggcggaggggggcatccgcggcgacgcggccggaggggaggtacagctcccctccctctcctatcccgcagctctactctccctctgcgctcggcctcgacaacgacgatgccgccgccgccttgatccgaggaggggaggagggcaccatcagctggaggggaggccagcggcgccgccggtgggttggggtggtggtggcggatttatttattcgctaaaaatattttcgcaggcgggtggttctacctaatgattttcgcaggcggtccgccgggccgcctgcgaaaattatctattttcacatgcctttacgtgcagacggtctcttccccgcttggaaaaaaactatttttggccgcctcgaaaaactatttttctaagtagtgcggattgtatgtacaatctatcacacctagaaaattgcataagtaagtattttatttaatactgttgtgcccgttagagatatgggattgtttatgaccatgactgatggttaacgacccgtcacaaataactactcatctatgatggtgttgtcaatgggtatttgtttaaccgatagaagtaacgttatctgtgacgggtcacaatcatccgtcgatgatgtgtcatcacggataaacagttacgcagaagtgttttttttttttagataatgagttacgcagaagtgtatcttaaacgtcgcccgtatgtataagatcattgatcatggagtgtctctataactattgctataagaaatttgcgtaatgacaaattgtatgtacaactctcattaattctatcgtttggcagtacgccagtaccttatcagtccaacaaattaaatgttctccgtcttttaacgctttgataatccacttccctgttcctagattacgttctgatctttatcccataataacaaaaggcttgtcgaaactagatttcggcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacagtagcccccgagacctttgcagtcaaccatcgtagccatctcaaaaataatccgagtgcttcaaacttttcatgccaaggcccgccgagtagcgaagacgaagactgtaaagggcgaaaagataaagaatatggtgcatcgaatagatgcacctaattaggtgtagcccccaactatgtgattagttaacaaactaaacatatagttgagaacaaaataacagcacaatcatgcatcatatgacaaaagcatacgcggcgcctaaagagacattcttgccgactgctttctagccatatgagtccgagtggtttacactctaaaaggttcacgaatgaacatactggacaggcatccgaatataaaactctaaagattacccaccaaatattataaaaattatggtaatgaataagtctaatagcctaggctatgactatttaccataatgaaaataggtaaataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgcgcgcataatattgccaaagcaaaatatgcctaagtccctaaggaacacaatgggccacgctgttaaaagtattgggctgaagtactgttcaggcttaggcccatttgcacctccgatacccttaacaagaaatcccgagatccaagcgacgcttcgtcttccccgccggaactctcaccattttccccactccttgctacagtgcagcactgcgccggcgaactagggttcaccattccactcaaatccaccttcgaaaagtgcaccaaaatccttcccgtgatccaccgccttaatccctcatttctcccaagccatccctcgaatcagatcagcacatttgagaaaaatcgatggcggaagagagagaaagcttcgaaagccaatgggtgccgtccgacatgacggaagaaaacctgaaggagatggtggcgcacggcgttctccctgccaaggagatcatcgggtggcggccagcgtgcggtgaggcttttccaacccctgatacacatgagatcgtagtcttctcgcatttcttctatggcggcttcgctcttccgacctcgaaatttttccgcgggatcttgaacttctatggaatcagcttgcatcacctaaacccaaattccatagtgcatatcgccaatttcgtccatgtttgtgaagcctttttgggaatcaagcctcactttgccctgtttcgccggatcttcttcctcaaaccccaaccgaacaagagcaaaccgtgcgtagtcgggggggcaggattccagctgaggggaactctgagccaaaagtatttctctatgcccttcaagacttcgaacaaagggtggcatgcaaactggttctatgttcaaaatcctgagcctgctcttcccgggtactcttgtcttcctccggtgtaccaagatacctggaactctcttccaatcggagatgaagcagtccaagccttggagttgatggaccgcatgttaaaacttaaagaacaaggcttgcaaggagagcagattactcggcatttcattaaatgccgactggcgccaatcaaagaaagatcccgtacagcattcgagttcgacggcaagcatgatcccaaccgtgaagaaccggactctctggacttcaaaatcatgaaggagagaatgtataaaattttctcaaatgctattgtcgtcagctactcgcatcagctgccagttgtgccatataatgcattcaatccgcctccgcaggtatgcatctgaaattcttcaacccaaggtcaaaacataatttaatcttcatgttgagttggctaactgcagaagcatctcattcaggaatatgtattgatgaaatctgatcccccaattgctcagcgccgatctccccgccagcacaccgttcagggaagtggagggccgacaatcaggtcagacccgcaacctcaaacttcccaaccgactgggcagacaggttctcgcaagagaaaactggtgctaaacgacgacgaaggcgacgacggcgacaaatctggggacaagggctcgcctcacaaactcccaaagcgtaccatgcccaagaagaaactggctggccgtcaaatgccaaagattagaacatcctccaggtaaaaactcctcggtaccatctctctttgacatgcctctctcatagaaattatgctgaatatcaaaagaacacttggcaggaaaccatccgacatagatccaaccgggaaagaccctgatccggctgtggcagaaccaaatatatccaaggatgctgagccgactgccgaaagccagccgactgccgaaagccagccgactggcgcccatgcttcggatgacaaggccaatccgagtgaccagccgccgactggaaaccagtcggcaacaactgaaactgcaacaacccgagagcccccaactagaaaccagtcggatgtaggtcttgatcaagaaatccctgaagttgaagcgcaagcgacagcttctcaaggaccagaggctggaaatgactcgatgattggttctcctgataaagaacaaggatcacctcgcgctcagccaggcacatcctcaggtaactcatcttctcaagtgatatcgttctgaatagctccagcttgctcgtctaatgtcttggaaatacatcaggaacactaggtgatgacgaagaaacaattcctcgcataaaggcagctgatgacttccgtcctcctatcttgctcaaatggtgggacgagaactcgcaagctgccggcatcgttataaatcgtcagaaagaagatgaggaagtgtgccagctgaagaaagcacttggagaagccactcgcattgtaaatgtaagtcttctaggtaactgcctttgatgactttattgtctcgttagcaaaactaatccatgaaccaccatgcagaggatccatcttcgcaatgaggccaagaccacaaccttagaaaagctggttcctcatttgggaactcttgaagccgttagggaccagctgcatgaggccaaggagtatgctaaaaagacagagaaggagttaagggaccgaattgcccagctccaggattcaaacttcgagctaagtggttcatcaaaaggtaaccttccagatctattccattgatctatgctgtcataactgtatcctcaaatatttggatttcaaacagcacaagctaccaggatggcacaaatggagaaacagattgaagccttgaaaagagacaaagtagaactagctgtgcaaagggactcagccttgaaggaggtcgaaggtactgccaaccgacaatttgaactttcctctcttttatgcagcagattcttattataaatatgttttgtagaccgtaaaatcaaatctcaagctcagtttgatgtcctgattggtaagatcaagaagcttgaaggagcaagagacgaagtcgccaatgtcgctacaccactcatccaagctatgttccttaataacagtggtccgagtgcacttgacgcaactgaaatctttgacaagctgagagttgcaccggatgtatacttcaagaatatcaagaaagctggaagcatgggagctagcatggcattggcgatgaccaaatccttgtacccgagaattgaaatcgacaccattgatggatttgcagatgggacaagtgaagaagctgctcttgatcttattagtaatgctcaaagtgcggctgacaagattgcaagtgatgttgtagagcaattccgcaacaacgaccttcagccgagcaataataactctgatgatgaaaggactgattctgactgagtgtaaatgtaacgaatggaggcttaatttgtacaatactggtgtatttatgctgtgcttgatagttctagccaagtctttgatttcttaaaagtttttatcaagctttgttgagcctaaaacccaaataagctattaaaaactttcagtcctcgcaaactaagtagaaaaagccaaacaaggcaatgatagaccaagtaagcaaattaaattgataaaaaatcacactccattattataatgatagcccccgactgacaacttcaagaagaaaacttgatgttgacagtcaagatagggaagtacaatgataaacttaagcgtagaaacgacgaagatgctcaatattccaagagttgtcgacaagagtaccgtcttcgcgcttgagtcgataagaacctggccgggtgacttcagagataataaatggcccttcccatagaggagataacttgtgccgatctcgtgtagtttgaattttccgcaaaaccaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcctcctcgtaactttcttcacggaaatttcgaaagcgcaaagactcgaattcaacttcactcggcaacattgcttctgccccatagacaaggaaaaaaggtgactggcctgtggcccgactaggtgtagttcgcaaagaccaaagtactgatggcaactgttgtacccatttgccggcatagggttttagccggtcaaaaacacgcgctttaatcccttgaagtatcatgccattggctcgctccacctgtccattgctcatggggtgtgccactgaggcgtagcaaatcttgattccgaagtcttcacaaaagtctttaaaaactccgccagtgaactgtgtgccattatcggtgatgatccgattgggcactccaaatctatgcacaatgttgatgaagaagtctcgagcattatccgctgtgattgtgacaaccggtttagcttcgatccacttggagaatttgtcaatggccacaaagagatgcgtgtagccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgtgcagcagcgtggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgaggaagctcttgagaagttaaaaatcgtatgaagggctctcgccagtcggcttcaaccatagctacgtcatgagtgtcggcatcttgagtagtatctttatgaggtacggtcggtgtataaaggtgttcgacgaaaacatctgagggcgccgtctcgcgcttggatccaaaattggcaagtctgtcggcggcttcattgttgtgtcgaagaacgtgactgagctcgagtccatcgaacttgtcttccaatttgcgtacctcttgtcgatatgccatcatgttgtcgtcaaggcaggaccactctttcataacctggttgacgaccagctgtgaatcgcctcgaacaattagacgctttatccctagggaaattgcaatccgcagcccatgaaggagggcctcatactcggcaacattgtgggacgccgaaaaatgtatccaaagcacgtagctcaatctttctccagttggggaaatcaaaaccactcctgccccagtgcccgaaagtcgtttggatccgtcaaaatgcatggtccagtgctccttgttctccgcgggggtatcctcctggcactcggtccattcggcgacaaaatcaactaacacttgggacttgattgaaattctgggcttgaatgatatgtccaaagacatcaactccaaagcccacttagcaatacgtccgtttgcttcgcgattgtgcagtatgtcaccgagtggaaatgatgtgaccaccgttaccgagtgaccttgaaagtagtgagatagcttcctggtagtaattagaataccatataacagcttctgaacttgagggtacctcgttttggagtcggctaggacctcactgacaaaataaatcggtcgctggactttttggacatggccttcttcctcgcgctcaacgaccaagactgtgctcacaacctgggaggtggctgatacatacagcaacaacggctcctgcgggtgtggtgaggctaggactggtggctcggtgaggagttttttgaaatcttcaaaggccttctgtgcttcgggtccccactggaaatcatctgttttcttcagtagcttgaagaagggcatcccccgctcgccaagtcttgaaacaaatcggctgagcgccgccatgcatccagtcagcttctgaacatctttctgggtacttggcggtttcatgttgaggatagcagtgactttctccgggttggcttggatgcccctatgagacaccataaagccaagcagcttccctgacggtactccgaaggtgcacttttcagggttcaatttcatcctgaaaacacggatgctcgcgaaggtttcttctagatccaagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtgatgaatgaagtcttcaagcagtcggattccttcagtcggatctgatgataccccgagtagcaatccagaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggttagccagccagtcgggatgaaggacttctttgatgaagcctgccgctaacagcttggttaattcctccttgatcgcgtctttcctgtcttgtgcaaatcggcggagtcgttgtttgataggcgttgcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagttttggcttcgctttctccactctttgaaatcttggtagcgggcacttctccttcgctcgccgtggctgcagccagtcggatatcctctcgggcagacgccatctcgcgagtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtaagctgtctcgaaattggcgacttcgaagctgatattctctgtgcgaaagttttcccgagtgccgaaagtgaccgggagggtgatctggccgagtggagttgcggataatcctggaatcactccgtgaaaaggcgcattgcttggttttagctcggagcgagggatctgcatatcatccaaggtcttggcgaagaggatattgagtgcgctgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcgtctttcttccttgacgtgctttgttcttcgtcggagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcaagaagagtgactggcggttgcaacaagttccgcaggcttacgcttgcgatccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccgactagttcttcgtggcgaatccctttggtgaacgcggcgatgatgacgtcgtcggtaatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccgcggggcaatccatggagccaagatcgggcggaatccgctaaagccactggtaaatagttcgccatggccttgttatctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggtgacgttcttcggtctcccgggcttggcgttgctcctccgtctcattattggccatgaaaacgccaaagtagagaggagtgtagttgtcatctaggcttccgtcgaagtcgtcgaagtcgttgaagtcgttgtagcgagaactaaattcgtcgtactccacgatgtcagtaggacgtgagtcgatggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtggtagtggagacggccgctaaatcgtcggggagcttcatcaggactggtgggtaagccccatcatcttgatctggtgttgttggagaagatgcgatctcggccgagtggtttgaagccgactcggttgagatggtcttgaagtagctttcagccgcgttcgggaatccgaacgagaccgaaagccggttctctcccgactggtctgattccgagtcgaggagagaaatcttgccgaagttgttggtgacgaagtcgaggctgccgaaccaaaacgtctgcccgggagggaagacgaggtcgtcgatgccggagacggaacccattgcactgatcggcgaaaagcttgacgcaacccctacctggcgcgccaactgtcgaaactagatttcagcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacaaggctattccccctaaagctcggattaattagtggttaggcctcgcctcctaataaactactgtatgttaagtatgcatgttatactgattaaaaataactttacccggctaactaattaaaatatactagaaccctctatacaacatacttcctccgtttctggacgccgttgactttataagtatatatttgaccgttcgtttattaaaaacttttatgaaatatttaaaactatatgtatacatataagtatatttaacagtaaatcaaatgataggaaaaaattaataattacttaaattttttaaataagacgaacaatcaaacatattaaaaggttatcggtgttaaatatttagaaacgaagggagtatataaacaaatttacatatactatagaaaacaatgtataaatcaattatcaccaaagtcaacccatatactgtaatctgccctctctgtcccccaaaattcttttgttgctgctccgtgtgctaattcataagaccagatgtttgtaccacatgtatcaaggtacgtatctgcgcagaacggtaactttggtacaaatgccaattcgccatcgcgagcaacaaggtcaacgtggacggtctcaggccactggtagaatcttggaaggaatatcatattctgcatccagttaaacttggtcttcttcatcatcgttgttagagacccggtgaacactgtctggctatgcaagctatctaccttctcccactccatgctttgctcgttaagcttgacgagatggaccttcttcccacgtcgttcaatcgctacaaccattaattcaccttggttggactcgagcaagtagctgtcttcacatttgaaaccgaagctattaggcttgtcaagaatcttaaatccttcatggtgcctgcaaggatcataaactgctaaccttccatcttgagctagaaggtatagcaagctgttatggagaactggattggtgcccggcgatgcctgaagttgcgaccagtcgggactgttctccgccaaattccagtcctcccactcgtcactgtttgttcggatggcactagcaacctcaattgtgaacatcgcctctataccaaatagcctctcatcacggtcggagacaacaaaattaaacagcgcataaggtttttgtggcaacacttcaacgaggacgccgctgacgaggtcgatatcaaacaccgaggatttatccacgcgcatcttgaggtgtcgtccggtggagcagcagattttcgcgccaggcaccttcagagtgtcgtcgacctcgaagttcttgtcgtagtaggggctatagtatcggatgttggcggtgccaacctcggcggtgttgagcaggagcggcgtgatccacgccgggtaaaagggacacagcgacgcggcgtagcgccagtgccggcacaccaacgcgacgatcgggtggctcgaccaccgcagactccccagaatcaggacgagcacgtccgccgggagagacgaccagccccgagcctgtgacgacgatgcggcggcggcctccatctagctcgatcgcttgctcgatctcgccggtttaaacccagtactgccggcctgatcaggagagacgacgtgcgtgagcgcggtgtgtcttcgtctgccaatggcgttttcttttttaaacattacagtgttatggagtatatcgtggtgtcccgcgcgcgcgcgggagcttatatatgtacgtagggcgtagtggagcgaaaataccaatcggtttacatgtggagttgcaatgcgatacgagttgtccggggaaaaattaacaaacctacacgtaaacgtacgtacatacgtgtgccgctggccggcacggtatagctctgctgcacgtacggtcggcaatttggaaaggtgattttccttagaaagggatcggattttttttaatagattagcaatagtgcacgtgcgttgcaacgggaaaaacactgtttgataatgtgacaccttgaaaacctcaaatctatattaacaaataggtagaaccgagtctaatttaatgaattagcataggatttaggatttagttttagattttatttttcgagcctacttaggagtttatccgacggagtttaatttaaaatatctgagccatattgtttgatcaaatatactttcggcccaggtcttcccaagccggcccaaacttgggctggcccatcttcggcgagccgagtcagttcgacggcccgcaagctgagcagctgaccgcagcacatatgcggggatggtctgatgcacttccgcggcccattgggcgcagcgtaatctgctgcggcggcggtgacccaacgctgggtaaatctgaaccgtccgatctaatatggacggctctgatcgtccccttgccggatgaagtgccgaccaggagagaggagcaaaaccctagctcccaaatccctctttctcgatcacatttctcttcggcgatgagcgagcggaacgacggcgaaggcggtccggcgagctggtgtgcgcgtgtggtgacgcccgtcgagcagctcctgcttcgccggctgggggacgcaaccgagggcggcacaaagccgtgccacggcgtcggtggtccggctaggcgggcgcgcaaacggcgatgagcgccgagcggcatggagctctcggcgggaggggcgacgccaagccgacgcttcccgtcttcggcaagggatggtggaggggtgctccaggacaacgcatgcacaaggaacccaatgtgactgcgaggaggtgaaggtgcggcggtgccacttcccggaaaactccggtgagctttgggacttcaagtgcggtaagtaacccgaacccttagcttaattgatttggatttttgactcttagggttcttacccgaaattaggtttcttcgaatttggggaattttgtcgggaaatttcaatctattttattccctcttttcgagttatgcgagtttcaatatcgtttatccacttttaattttgggaacttcaatctagtttatccctttgctcaatttattttttttttttttgctttggccggcgtttcatcacgcgggcggggacggagggcgccgctcggtcccgtcgaaaagattgagattaagataagatgatattttcacagacgacggaagtaaattcaatttaattttgggaacttcaatctagtttatccctttgctcaatttctttttttttaactttggccggcgtttcatcgcgcgggcggggacggagggcgccgctcggtcccctcgaaaagattgagattaagataagatgatattttcacagacgacggaagtaaattcaatcgtaagatactattttattcttttttgttttaatttttttaccctgttttggtttcgttattacggatgatggaagcgttttcaatatttaagcagtagagatagagatatataggctgtatttagatccaaaatttggatccaaacttccgtccttttccatcacatcaatctgtcatacacatacaacttttcagtctaatttcaaccaaaatccaaactttgcgctgaactaaacacaaccatagtacaatgtcacatataatagtattcgatttttttaccgcgtcacatataattccttttttttaattggacagaattcatttttttattttttttccgccctttttttaccctgtccacgaaatcggattctttttttttccctttttttcacctgatttttttcgcctgattcctttttatcggacagtcggttttttttttcgccttttttacacaggatcggattcatttttttccccggttttttctcactcgatttttttatgcctggtttttttattttttcgccctttttttaccgcgtccacggaatcagattctttatttttacccgattctttttttctatcggacagattcgattttttatttttttttttgtgttttttacacgggatcggatttatttttttcccggttttttctcacctgattttaatcgcacccggacgaaacggggagaagtgacgatctgaaaaatactaatcttttaattagttaagattaagataagaaaagaaaaggccagtgattttccttgtatttatatgggtagcgtttatgtgcaagctagacatttcgcatggatatataatttgtgttgattataacctgtcacactaatcaacgataaaaattaattgtatttaaaacttttatatttatgtgtttttagcgacgtaaaagctaatgttacaaatctctactacttaaaaaaaatttaaatgattttgtcgtccattctatcatggcaaaaaaaatcggacctgaagaaaaaagagcgaaattaaaataatcggtcctattcctaatcacaaaaggacaaaagatctaataaaaaagataaaaatatgtcccaccacaccttgcgcttgcttcgcttctcccccttccgatctcttttttgcccttattgttttaaaaaataaacaaacaatttaaattactaatcacaaaaagacagtgatctatctatctactactttacttaaaaaaagaagaggtgcttccatcgtccgtcaaaaaaaccgggtgaaaaaaaccggacaaacaaaaaccagtttgtccgataaaaaaaccggtaaagaaatttccttcgtccgtacagagaaaggaaaaatacgcgcgaataaaaaagtgcgtgcaaaaatagtttctgtccgattccaaaataaaaaaaattccaagcgaaaaaagagtttccatcttcctacaaaaggaaagaatagtgcgaaaaaaaaagtttctatccgaagggaaacacgcgcgaataaatacctaattaaaaataaatatctatctctaaaaaaccttctgtcgtaaaaaaagaaaaaaaagaccgactcccgtagagaaaaaaaaagtccgactcgtgaaaaagaggttttctcgtccgtaataaaaaaaaggaaaaatacatctaactcaaaatccgtaaaaagaaaaggaggaaaaaacgacccggccaaacttaaagtcgccttgttgtccgtatatatctctttaactctaatctaatctatcaatctaatctaactttttagagagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacaaaagaaaaaaaactgtttataaaaaaaagccgctctgaaaaaactaaccgatgaaacactgtttataaaataacagataaaaaaacaaaacgactcaacacgcgaaaaaaaccgctgttttaaaataaggttcgagaaaaccgtccgacttaatgcgagaaaaaaaccatcatttcaaaaaaaaaatagaggaaaccatccaactcaatgcgagaaaaaaaaaagccgccgtttataaaaagaaccactccgagaaaccgtccgactcaaagcgagataaaattgatggacgcttgggtcggataagatccatcgatttttttccatctcctacacatcatttcctacacatcatttgttttctcatctaatccctgcactttttgtatacaataatcattatcagactttttttaataacatattatatgaaaatagtattaaaaataaacatatttttaattgttatttagagaagagtgcactgtgactattttgtgtagacttgatcctgagtgtaggatttgattaacctattattggttgcaagaataagattgaaagaatattttagattatatgtatattgttatatgaataatccaattattttagttaaagcaagcattggtaaaaagattgccatcatcgagtttggtcattacataaagatgctctaattttctaattgtgttagctacaacgatccatagaaacattatcattgatatgggtacgcttgaaaaatgtcaattgtcattggattatttttttacccgttgcaatgcacggggcatttttactagtatataataaaagaacgaaaatatgtctcaccacatcccgttcatgctttctttcctcgtgatctcatttttttctttatctttatctttacatacatatttaaaatatttgtagtgtttctattattcgtcactgtctagcgtacatcgacggttttcgtgtttctgcattggcgccctagcagcacgtgcgagcttgattgcttccaaaccaaaattcaccgcttccacgtcgacggtcaatcatcccatgtgtcagaatccaataggctccacacgcatcacatccgatttgccttcccatgccaagcaattttgtgaatctaccatttaaacgatgtcaaaggatcgccaactcgtgaattaggaaataacaaagtcactaatataacaaatatacaatagtaacaagcctcataatccatatgacaagtggacccataataattagaaaatctaaattaataattaattaaagtaggtccattatgcacccgtggattttatatatatatatatatatatatatatatatatatatatatatatatatatatatatatatatatatatatatatatatatatatatatatatatatatatatatatatatatatatatatatatatatatatatatatatatatatatatatatatatatatatatatatatata

SEQ ID NO: 22177 - DNA, 15684 bp, Oryza sativa
atatatatatatatatatatatatatatatatatatatatatagacacacacacatggatttgttctacatgaagttatgaacaaacacccaacctaagaatttgaataatacattttcgaggaagtgcagtgcctggtagcttgaagtggccgttgacggtgacccatacgccgacggaggccatgcaggtggtgtcgggtaggcctacgtgacatttaatatggcggtataaagtgtggaggtactcgcaatgggaggcaaagtggtcggtgtagctaggcattggtgaggcccaacagtggaagcggttcgatgaagatggggaagcgatgtagttgaggagacggtgagagtagaacaggagcccacgctttgatcacacaggcacgatcatcatatgctcaatggatttcttaatcattgtgttgtaccgccaccacaagggaccagcgtgtggggttcaagcttttcactccaagttattcctgtaacgtagtaagggcgaaagcagagttttgtatatccgcctactcgtccaaaaaaaaagtttcaaaaaaccggtgaacatacacaaatagagaaaacaaccatggaaaaaaaagttgaaacacactaaaaaactgaaaacatactatagtagagtggaatggaacgtttaacccctcttactagatcccgttgcaaagcacaatatatttgctagtaaactaaaaatatatcaagtttcaaaaaatctaaatgttggcaagaactgataagatgaagcacagaagatggaggcggaattcctccgtctcaaaaacaaattaattacctgctattgaagcggttgcatgacctagtgcggaaatgcaatttgaggactgtcctaaggctgagtttttttcccaactttcctaactcacctctctcgtttttcacacacacgcttttcaaactgctaaactgtgtgtttttttaaaaaaaatatattcaaaagttgcttttaaaaaatcatattaaactattttttaaaaaggtaaatacttaattaatcaaaagaaaatgtgttgctctgttttacgtgcgcaggaggtgagctcccaactcacctcctgaacacagcctaagttcactgtcacaagtcgtatgaacttaagagggggaaaagaatgtgtgcagtgtcctcttccctatcccctcgaaaaatagtcctcttcctagatatcctaacttttccccgacaaaaaaatatatatcctaatttctacaagggattacaaggttttagcttcagctttgcaaccccattttttcacttattcaatgcatcgggagcccagaaaacagaacacaaaacgtagtactacaattcaagatattttcttcaaacttccaactttaccgtcacatcaaatatttggacacatgcatggagcattaaatgtagacaaaaaaaccaactgtacagtttgtatgtaaattgcgagacaaatcttttgagtctaattacgccatgatttaacaatgtggtgctacagtaaacatttgcaaatgatggattaattaggcttaatagattcgtctcgcagtttacaagcggaatctgtaatttgttttgttattagtctacgtttaatacttcaaatgtgtgtccgtatacttgaaaaaattttagcacaccaactacacacacaaatgtacaaagttcagaatttccatcgatccagttcaacaaaaaaagaaaatcagaactcataaacgccgctgaggtagtagtatgtgtataaaaaggaaaataaagcctgtggaagagatatcggatatagaacctataaatttgggccgtgttcgcatatttaactttttcattatattaaaactttcttatatacacaaattttcaacttttccatcacatcgtttcaatttcaacaaaacttctaattttggcatgaaataatcacagccttgttcatgaaaaaaccacgaccttcctgcagaaaaatcggacatgcagacatacagtaagccaacaaaaaatccaggacaacacgtagaaccaatcggagcatcaaaaagtcagagattcgctgccgttcgaagaaggaaaatttagtccaatcaaattaagaatccacaagcgctgacgcactaacagggggtgtttaaatccagggtgaaaagttttggcgtgtcatattgaatttacggatacacatttaaagtattaaatgtagtctaataattccgtatgtaaagtgcaagacgaatttattaagcctaattaatccgtcattagcaaatgtttactatagtaccacattgtcaaatcataaagcaattaggcttaaaaaattcgcctcgcaaattagttgtaatatgtgcaattagttattttttagcctatatttaatacttcatgtatgtgttcaaacattcgacgtgacaaggtgaaaaattttagggagggatctaaacagggctaggtgaaaaaaaataaaagtggattctctgaactcaagaaagattcctgtagagtactccctccatttctaagtgcttgtttaagccgtgtttagttccaaagtttttcttcaaacctttaacttttccatcacattaaaacttttctacacacacaaaactctaattttttcgtcacatcgttccaatttcaaccaaacttccaatttcggtgttaactaaacatagccttagttcccaactttttcttcaaacttccaacttttccatcacatcaaaacttttctatacacataaacttctaacttttttattcaaactttcaattttagcgtggaactaaacacagcctaaatatttgacaccgttgactttttatcacatgtttgatcgttcgttttatttaaaaaattttgtgaaatatacaaaactatatgtatacatataagtatatttaataatgaatcaaatgataggaaaagaattaataatttcttaaatttttttaacaagacgaacgataaaatatatttaaaaaaatcaacggcattaaaaatattaaatttttagaaacggtgggagtattggtgttggtggctgtatggatgaaaacggatcggatacggacggaaactagctttatcatattcgttttcatatttttttcggaatcggaatcggaatcgaaaactcggatacggaaatgaaatcgaatattatcgaatacagatacggagcgaatacgagacggaacgaatacggtagcggatatttatcggtatataaaaaacccctcaaattgagtttcttgatcaaggaagagatatcgcttattattttagttcaacatctccaacatttatatcgtcaattttgtagacggtcccataaccctatgtgaaaatcgattttcatggctattcctcttacagatacatatgcaaatatgattatcattttctattttcaagaccttttactagatgtataacttacttaccattgtataaattggagaagttatttattttacttcacatcttcaaaacttgtaatgtttgttttatactttaaatgctttcaaatacaaatgttataaactacaaagtggtagatcccgttgagctctacaactttgatatggaacacatctccatcagatgtcgtttgaattgtagatctgagattttgtaaaaattaatatggtatattataatgaatatttagactccttaaatgacctcaaataataaaatagtcaataagaaagttgtagatctcatcgagctctacaatgttgatataaagtttgtcgccatctgattccatatgaaaaagttatgtatatatacatgttttttctaaactttgctcaatgtctgcggatatctgaaaaaaaatccggatagtttttccgaccgttttctgattccgacggatagtacccttactgtattcgttttcgtttccgagaaaaaaaaatccgaattcgtttccgaatccgagaatttccggatagttccgacggaaactatccgaatccgaaaaatggtccggacggacggaaactatccgaaccactttcacccctagctggctgtgcttgctccagatctgcaccatgcgacacagctcccagccgcttgatgccctccttcctgcccacgacagcaaactttgcaactgcgctcatcacatgctccgctcatctacagataaaaaactattcagagatcatcagcacaagatggtttcgtggtgtagttggttatcacgtcagtctaacacactgaaggtctccggttcgaacccgggcgaagccaagttaactttttttttccttctttttatcttcagattcaaatcaaccactgaattcaaactttcgttggaattcaaactttcgttgtttttcctccgaactcactgaattcaaagtaactcactatttttattattttttttatcttcagattcaaatcaaccactgaattcaaactttcgttttttcccccgaactcactgaattcaaagtaactcactatttttcttcttttttctcttcttttttttaatcttcggattcaaatcaaccagtgaattcaaattttctttttttccctccgaactcactgaattcaaagtaactcactaattttcttctttggattcagactagctaactgctgaattcaatcttctgttttttccctccgaattcactgaattcaatgtaactcattattttcttcttcgttctttttatcttcagattcaaatcaaccactgaattcaaactttcgttgtttttcctccgaactcactgaattcaaagtaactcactattattattattatttttatcttcagattcaaatcaaccactgaattcaaactttcgttttttccccgaactcactgaattcaaagtaactcacaatttttcttcttttttctcttcttttttttttaatcttgggattcaaatcaaccagtgaatttaaatttttctttttttccctccgaactcactgaattcaaagtaactcactaattttcttcttcggattcagactagctaactgctgaattcaatcttctgtttttttttccctccgaattcactgaattcaatgtaactcactaattttcttcttcgttcgtttatcttcagactcagctaactactgaattcaatcttctgtttttttccctccgaattcactgaattcaatgtaactcattattttcttcttcggattcaggccccgtttagttcacacaaaatttttacaccccctcagactaaatgaacgacttaattttttttcttcagcaccaaactgcatgacatttttcttccccttctttatcaaattaaatgaataagttcatcttgcaaatacactagaaaaacttactctaggatggacccttttctcggtgccaccatcattagcgttgtcatattggacgacggtgccaatgaagtcaaggacctatttggaagaaatatatttgcattttagtccttttgaaaattatttttaattttttatacaaataggtcattgacaccaatgacattggagtcgccatcttgatcatggcaccaatcacactggcgccgtgaaaaggaaccactcctgaaataagtttttctacgggtctatttgtaaaaaaagttttcaagaatgcccccaaaccatccaaccaaaccaatccggcccatcctctcccacgccaacctgttttgtcctcctaccatacatgtcgaagggtgaactcctcaagcgggggaccgtggggaccccctttctagttcagtccaggggcacggttgtaggtctgagagttgatggagagagaggcagagggggttgggcccctcgagagtgatggaaatgcaagaggtttatacaagttctggccgctatggaagcataataccctactcttgtgtgtgattgatttaggtgggagaataaaagtgcctttcttctctaggattcgcccctctctccactggggcatggacctctttttatatcttaaaaggttaccacaaaggcccaaaactagcttcaagggtaaggaaaatattctttacaggcaattaatgcttgtcttgtcttccgacatgtggagccacgcgcgccttaccgcggcatgggcccatcccatcacgccgagagacacgggcggacattccttcttaattatcgacgacttccggccattcattcccaccgttgggtggggatctctcatacggaccggtgcgagaagaactggtccgagctcaaatgcgaggcaaaaagcccctcattaatggcgattagacggggcggtcgcagaccacctcccctgctagcagtaggtgcgtgcgcagggctccctgactgccgtcacatcggtcatttcggccgcaagtttatactggtcagagaaggaggaggctacgcgagcgtttggaccaaacgatctatactggtcaaaccggcggcataggtacggtcaaacttgcggatcaactccggtcagaccgatcttcatcaaattcgagggtaacttttaattccgctaaaagtttcggttttgggtactacaaccattcacccctctctggttggcttagttcttgctattcgatcctacattaacgatgtgaaaaaaaaaagatttttggaacaagttcagctaccaatttacttattgggttgtatatataatgttagagttttgggtctagggggcctgtgcgggcggagcgcacgcccctgggacagccgtgctgcaagcgccgccgcgggtcgacaggtactggcaaagagcgcgcagctgaggaattgggcatgcatgttgacgtatgtcacgccctgaagttttcccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaatcccaggaaaaatcctttcttctttttctttttcctttttcctccttttttttttcctcttcttgggccgtcggcccagtccatccctctcccgcggtccctcctccttgtgggccggcccaagccgcccctccctcctctctctcgggacgccgacaggtgggccccacctgtcggtcgtctcccacctccggccgctggagccgaagctccaaccgcccatgccgccgccgaatccgccgcgccgccgccttctccgctccacgtcgcgcctccactccgcgcccgcacctcgcgcccacgtcgccgccgattcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccggcgtcttcggccacgcgccgccgcctctatagccaccgccgtgccgcgcagtcgccgccgtcgcgctcaccgagcccggccgcacctcggcaccattcggttgccgccaatcgtcgccgaagcgccgtttccctcgcacgccggtgagctctccatttccacccaactccggccggctgctctagccgccgtggtcgctctccctacccctaacccctctttgttttctcctagcgtgccgccgccgcccatccgcacctcggcatcgccggtcgtcgccgccgctttcttccttcgcgccggccgtcgtgctcatcggtgaggaatcccctctcccccttcctttttccccctctcccgtgtgcgccgccggccttcgcgcgtgtgccgtcgccttcagccgctgccgccgcctttcggccgtcgccgccgtttcccgcaccgccggtcaccgccgtcggtggccgtgcctcgccgccgcctcgccttggccgccggtcggctttgaggccgagccgagcccggctggcgcctccctctcccgccctgtgccgctgcccagtggggcccacatgccagccgccccctccctctccccttgtgccgctgccagtggggcccgcctgtcggcgcagccgccccaccccttgctgacgtcagccctgggacttattgcgcaataaatacattaaggcttttcttttatagtaataaacacagtttatcttctaaaattcataagtaattcatccgagctccgtttaagtccattcaagtctcagtaaatcaagaaaaatgcaaagaatccattaaaaatggttttgtttcctgtttcagtagtcttatagcctgttttgcttgtgtgctttgtttgtcgcgtaggtttcggccgtttcgtcgatccacggtttctcgaagacgttgctgaggtctcgtcagtgcgagagcaaggcaagtcatgctttacatttgatcatattgtacccaatttacaaatatcccgcatttctattaaatgttgcattcttttacaatgtaatgtgggatgggtcctattcctcagccacatattggttaccctatgccattgataacctgggtatcaaaatgattagatgttggtttaggaaatgcttagccatgcttagttcaactagtacacaaaaagggatcacattattacttagactttgtctattggcatagctttaggttggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagttgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttatcgaagttggtttcgtcgctgccgtcaaggtttgcctgtggagtggagacacccgctgctgaagtcaagcttcccggtttagctcgcttttatcttttccgctgcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaacctaagagccctctgaacccctttttcatctgcatatgcctttttgcacttggaatttgttttgggaaaatttggagttttgcctctttggtttgcgggaaaaatcttggtcgttcattcggatcggattttttttttttttttaaaaaaaaaaatgagctcagcctagggctttagaaaaattttagttggagtttattcgacagtcagtcgggaatttattgggggttatgcattaggtcgtgtctatattcggtgggggcaatgttatgcgcatcattttccatgcaactagtctatgcattaatttattgtttagttgcattagtgtctttatttgagttcatgaaaaatattctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttccacctatcccctcagatggagataaggaatggttcacgcgactccaacaacgccagtggcagcgaagagccgatcaatggagcacgtgccaacggtgcatctgacaacagtccgtccccaccgcccgagaacccaacaattgctcaggtgttgaacaatcagactcagatgatgacaatgatgatgcaacagatgcagcaacagtaccatcaggtgttgcagcaggtgcagcagcaagcacagccgcagcagcagaacctgcaatttggtcctccgcctcctcagtccaaattgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctgtttggtgggacaactacatggtgacccgtccaactggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaatagtgagcagcacagcctcaaccctactccgagttcactaaagattccagcccaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgggttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttgaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccaatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctacggtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcggctggtacttgaaaagttaaaagagcaccagctatatgccaagatcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccggtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatctttacccaacctgatctgaatctccgacagcgaagatggttggagctaattaaagattatgatatgggaatacactatcatcccggcaaggctaatgtggtagcagatgccttgagcaggaagagttactgcaacgtcgcatgggtagaggaactatgcggtgaggttcaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcgtcaccggtttgcccaggacgtcatcggggcatgattctatttgggtagtcgttgaccgactcaccaaagtggctcacttcattccggtgcacactacctactcaggaaagaaattagcagaactctatctagcaagaatcatgtgtttacatggtgtacctaagaagatcgtgtctgatcgaggaagccaattcacttcaaagttctggcagaaattacaagaagaattgggaacccggttgaatttcagcactgcttaccatccacaaacagacggccagaccgagcgggtcaaccaaatactagaggatatgttgagagcctgtgcgcttgactttggtggagcatgggacaaaagcttgccgtatgctgagttctcgtacaacaacagttaccaagctagtctgcagatggcaccattcgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatatcgggttttggaacgtagaggtgaagttgcttaccagctcgagcttccctccaacatgcttggcatccataatgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaatcccaggaaaaatcctttcttctttttcttttcccttttccctcctttttttttcctcttcttgggccgtcggcccagtccatacctctcccgggtccctcctccttgtgg

SEQ ID NO: 22178 - DNA, 8656 bp, Oryza sativa
cctgtggagtgaagacacccgctgctgaagtcaagcttcccggtttagctcgcttttatcttttccgcggcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaacgtaggaaacaaatggaagtgagggcggtggcctgagctaggaaaggaggaattctatgcagaggccagaggacaatggggaagcgccggagcatttgcgtaggacatggaagcggcgacagacggcggagcgagcgtccatggctgagatcgggacggtgcgcgaagggttgtatgcaggtggccaggctggcgagaagctgaccagcaagacgaccaggttggtggattcaatttctgcacaaccaggttggcactcctgaagtcagagcttggaccggaagtgaggaattcttttggtctaaacaattatgtactccctccgtccaaaaaaaaaaggcaaaccctgggtttgcgtgtccaactttgactgtccgtcttatatgaattttttttaaaatttgtattttcattgttgttagatgataaaacatgattaatattttatgcgtgacttgtctttttaatttttttcataattttttcaaataagacggacggtcaaacgttgggcacggaaaccagggtttgtcttttttggatggacggagtattcgataatgctgttggccagtcgcccggcgcgggcggagctggatcgggcgctcccccgccggaaatgctactgggcgagcgatcactcgcccgcccagagcgatcggttccctccccctccccctccccctccctctctccacctggtttccttttttggcaccgcattactttcctattttagtaaatttatatacctaaagtttatacaccaagtttacacatctaaagtttagagaccaaaagtttataagtcaaaagtttatatatctgattcaaatttgaatttgaattcaaatactttttatatatagtatttctatacatctaaagtttatacacctaaagtttatagacctaaagtttatatatccgattcaaatttgaatttggattatgtccgattcaaatttgaatttgaattcaaatatttttcatatatagtatttctatacatctaaagtttatgcacctaaagtttatagacctaaagtttatatacccgatttcaaatttgaatttgaattatacccgatttaaaatttgaatttgaattatatctgattcaaatttgaatttgaattcaaatttccgatttaaatttgaatttaaatttaaatatttttcatatatagtatttctataggcctaaagtttatagacaagtttatagatccaaagtttataagtcaaaagtttacgtacccgattcaaatttgaatttgaattcaaattttttgtacataaattttttctaacgttttgtttttttaaaatttttgtgtggtgtactgtaataggaaaaaaaaaaggggaggaggaaggggagaaatgaggggcgggaccgatcgctggatcgcgatcgcccatcagacgtccccgcatcaacatgcagaaccactgagccacacatgcacatgcatgggcacgcatacatacatgcatatatactgctcacatgtaaacacacgtatctgcatgctacagtacctcacccatctgtagcaccatatactcttctcgaatttcttccaatctccttcgcagacaccgaaacttgcacacacacctcgtgaaacccgttgcgaagatctctcccacacgatgtccatccatcatgtgtcatgtgccatgtgccatctcgtacctaatttcgtcatctggtatccttgatcgtctagacctcaactcctccctgagtcgactagtcccgatccccaccgttgaccgaagttgacctcgaagaatcctaactctagtcaccttctcacatggtatcctaaccacattagacctctgcttctccctgagcattgtcccgatcctcacaattgaccaaggcggacctcaagccaactgcacataatcagacagaacaatcgtttctgggtacagatatcacaacctaacccacatgaatcacacgcattcacaccaacattcacacatactataaaaccaattctttggttaaataatttgcatagcgaattgttcatcacaaatattaatcataacttacagtaatagaggtattcctcataaaaaacaattatttttttattggaaaacagtatgggaggcccctacaatatattaattttctttaaatttaaatagttcatgtacggctgcaaaagattatgaaagaaaatttttttttactaatagttccaatacttaaaattaattataagaaatttcatacatatattctccaatctattttttccattacttattattattttcttaatttaataaaaaatatgaaaatgaaaaaaaataaagtgatttaaagaacttatcagtccaagatataccgttaaaacattatcttaagaaaaggataacatatgtacaacatgaaggattcaagatggaggcatcacaatctcaagtgcaatgttatctggtagatcttcccctggattgtgtatggtggtagttcctcgttccatgttataaacatataatcccttatctttaggtcttacaaagtaaatgcagttcctcttcaatccaacatcttctgcattgagtgatgctccaaagccagtacagtcaaccaaaaatgccttgttatcaattgtgctaactttcatccaaattctttgagataaattgagtttatgaacttcaatttgcataaccttatcaacacattcaattggatgtttaaatgacaacgtgaacaactctccacctgattctaacaagaaacaagtagaaaacgtgcaccaataacttggatctggtgcatccttaactggcgtagttgtaaatgttggctttggcaggaattcaagtgtcaaaattgccttatcctgatttaaatatgcatggaatctccccccaacagccgtaaggtgtttcacagttgcaataacattttctctgtcctctcctgtactaatcatacttgattggtactcatgcctgaaccatacgtctcctttaggatggcaataccagaacattgtgtccctgcaatttactactagcacgatacagtttggatcagaaggtttatgtgatagaaagcacttgaccacattattattcgcaagaaaattgtcttcatcgaagggtaggttgatcttttgatttgtgatgggactccataggaaaatttcatacaattcaaggtgcaccataagcaaccagccttgtgctgttatccaatataagtggatgccgaattcatccactcttttggatagcaattctcttttagctatactgtagaagaaaagagtgtcatcttcctcctgatcatcgctgtcatcactttcctccgttccagcatcatcgcttccatcataatctctttcgcacgtgtgattgtcatcttcatccccaaggtcacaatcatccttatcgttatcaacgatatcctcatcatgtgaattttcatccccgtgatctaattcttcctcttcatcatctatgggacaatattcatcatcggtgttgcccttgtcgtctgtatcaataatgcggtaagcaaccaacagtagcaccggggcaagcttaggatctagaagagctagatgttcttggtcttccttacaactgtctatactgtgggatagcattttttttccctgtgacagtgctgcagaaatttattgaaaggttagactgctttgtttttctttttttaaaaaaaaaaagaacgagctaccatgagccaagtgtgctaatatcattgaataaataagagggttagacaacatgctcttactaacaaaaaaaaggttgaattgtattttaaaaggaaaataaacaatttaaggattcttattgtttttattttttctttttccgtcaggacagcaaagacacactggccagattttattaaaaacaacacgtaggtacaaacgcaataaacatagaatgaatttactgagtaaaaataacatccaattaaacacataaaagaccaaaccaaactacgggccccttagaaaaagattattcgcctgattactaccgtggattatctatttgattagaaaaaaaatggattatctatttgattagaaaaaataaattaaatattttaagaaataaattaataagtactctgtagcttaataccaatgataaaataatgtagtaaaagaaatctctaataaatatttaatttattggctaactaactgcatattctcttcgttttaaaataaataaatctataattttaatatgagatatgacagcatagtagggatgtcttgtatggtttattttggaaagggatagagtaagggtgtgtttagttcacgttaaaattgaaagtttgattgaaattggaacgatacgatggaaaagttaaaagtttgtgtatagaaaaattttgatgtaatagaaaagtttaaagaaaaaattcgaaactaaactcggcccaagtaacgatattacttagtatgaagtagtcggatgtttgatgccatacctttacgcgtcgacagcagctagccagtggcctagtgcttcgcgctgcctcgccgatacacttcgcgctgccctgtgtctatttattggaactcctcgtcgtcgtgggctgaactggattcaccaagcggatgagaattggatatggaatcggacggatagttggtgtatacacgttttcggctatgatgcgctgatagggcaagctaggtgcgtgtctgtgtctgacacggatccagtgtcccgtacgtatctacgaggatacgttaggtaaaactccaactcttaaatttagcttcacagattagggatcagtttagcacagctccatctctagctccaactctggagcttgagtttaaccaaacagatttaactccacctaaaagaggagtggatgtggtttaatttgcatgtgagacgagaggagccccgtgtcacttaggggcaggggcgacacgggcggcgaccaccaccgcctcctcctcacccccgccttactccctcctccgcttcgttgtcgcccaagcagacgccggaaaacgcacggctacaaggacggggcggggccttccaactccctcgaggtcgcggggtcagtgctcatgaccccggccagatcaaggcagcgacggtgtggctgcgtcgagtcgtcggggtgtcgggcagggcgagcggaggcgggctaggtgcgggggtggcgacggtgccagactttgtgtccctcgccagatccgggccccactcggtctggccaccctctcgcggacaacggcgacaaccaaaggtggaggcaaggaaggtagatggcaggcgccgaggaagagagcagcggcgacgacgaggccagatccacggcgggctctgccagatttggagccggcgaaggtggaggaaggggaggatgaggtggcaggcggcgagggcgcaggagaggtggcggtggggcggcggctactgcaatgggcgcagccagagcctgccagagctagcgcccctcggacgtagtagggggcatgaggtggcgctgaaggcgccgtcgcgacatggcggtcatggcctcaagcgcgcggcgacatccatcacagttggcgacatgcaggggagttttctaggcgctggcgtcggcttgtgctccactggtggcaaggcatcctcttcttcatgcagctcctcctcctatggccagctcagatgtggtcgcggagagatccatggggaggatggaggcggtgccttgcagaggggagtggcttgacggcgttcaaagcgacgttgttactctgccggaactgtgggcgatggcctaggcctaatcgctgaagagactatgtagtagaccggcgacgatccttcttgtgcggattggttgtgtgggtttggacgggtaatcgctggcgaaagcctcgccgggacgttggccagctgacgatggcaatgccttttggcgtcgctcccctcttggaggcgtcgttatggcattgacccctctcatttccttacccaggggcggatctacagtatagtcattggtgtcaggcgacaccgatgactttcggcaaaacctatagcaaaactacttatccatatattatatcatcatattctaagcataattaacatactatgacactgatagacacgttatgataccaattaaacgattttctagatccgccactgtccttaccgctctctgggtgaaaaccttactccagcttccgacgagccgtggcggcaatctatgtcatgtccagcttgggggcatcgctttgtagagacttcttcgtgcaaggatatcgttgatggtctatgcattggcttcgaagcttttaaatcctaggttttgacgaggccttcgctttctggtcccaccttttgttttgcggtgggcgaccttcgctctttgtttgattttgctaggtggagtcagagctggttcgtcggggtgacaaagctgggcaacgatgacatgctacattctctttctaggggtgttgttgttggctgtgaatagaatgtggcgcttacgcggctttggctgaagttcatcgtggaaagtcgaagccacttgatcattttggcagcgagcttggtttggatgatgcatctggtttgaagtcggtgctactctgtcgcttggcagcaagctcggcaacaatgacacggttgcaaagtcagaacccctatgtcttttcggtcaagcttggtaactataccctaagttgggctccgttagtggtttcagttgttagtgagttatggcatgtgctgtgtagttattcagccagccggtggttgttttttttttcttttcttgtaacccatctagggttttactcctgcttattgaaaatataattgacagttctcctgctggtttagtttaaaaaaaaggagtggagctgagtaaagcgctctcacaaaataaactagagaggtagagttgggtttagatagctcaacaactccactccagactcaactcctggagataaatttaggagttagagctttaccaaacagtccctaggtctggagtatagttatggagcagcctaaacccaaaaccacctctctagttcgttttgtgatagcgctcccccagttccactctcattttagatggaactgaaactgtttggtagaatttcaagagctcgagctgtgctaaacatacccttattttcatgattatcacatctatatctactaaagaatccataattttctgatcgtactaatacgcttcgatccgtcatggtgcggcttcacccgtcatgcatgttgcgcccgtcgccccctaataccggtcgttcctttgcgtcatcagaatcagagaaagggaaaaatcataacaacagaatgctcataagaatccaatcttaaaaaagcactttccaaaataggtgttttacagcttttatccaaccaaatcggatacataacaccacaagggaaaaacaagaaccaaagctaaaaagctaaccaaaagttccctaagaaaacccaatctttgttatacctccatccacatgagaggcatcatcgacgtcacatcatctaccagccactgaacccctgttctcatcacccttcctctgctcccatcaccactagatgtagaggtacttgtggaggcagcgacaacgatcatcggacccctggtagggcataggcaagcatagagatgactggcgaggagacgatatcaggatggaggaggaggagggggaggaggtggtggagggcgtaggggcgggacggaaccgtgcaagaggaggcagtggatcaaggtgggtcggcggcgctacacggaacagaggagaaagtgttgcgccgtgtggagtgggggagatgcgtcggcatagatgtagtgggtggaacccttagggttagttttagttgggctgccagagctgctttgttttgttttttttttgttacaaataggtccactttacatcccttaaaattcataattttccaatcgtactaatacgctttcgtccatcacaatgcgccttcacccgtcgcacgtgttgcacccgtcgcccctaatcctggtagttccttcgtatcatcagaatcggataaagggaaaaaatcataacaacagaatcctcataagaacccaatcttacataagcactttccaaaataaatgtttcatagcttccatacaaccaaatcgaatgcataacaccacaaggaaaagacaagaaccgaagctaaaatgcaaatccaaaaattccttaaaaaaaatctttgttatacctcaagccacatgagatgcatcatcgtcatcacatcatcagctaccagccgctgaaaccctggctcccttcctcccgtgccatcaccactagatgtagaggtacttgtggaggcagcgacaatgagcgtcggaacccttgtagggca

SEQ ID NO: 22179 - DNA, 7043 bp, Oryza sativa
ggtgtgggtggaaccctaagtgttggttttagttgagctgattgggcctattgggtaaaatttgctttgttttgtttttttgttacgaatatgtccactttacatcccttatctttctgtcgggtttaaattgtatccctgaactacaacaccaaaaatcttgaaaccccccccagaaaaaaaaaacttagaaaactagtttaaattagatctcctggtagtatgaagttggtttcactaatgtggcatcccggtccggtaaagtatgaagaaaataaaaaaaaacataggaggagtagctaatcaatcatattacctttttttttctaaaagaattatcgaaataaacctattcaactatctaattgttcatgttataagattaagaacctatccctttttcatttgatttttgacctatgtaccttatatttgagctcattgagttgcatatttttaattcattttaagcattttatcatgggatttgagctaatctagttgttgagttagcttcatgattttttttcatgacttttgatgatgcagtcccatccaccacgaaatattttttgcagagcatcctactttgaattgaagcggttatagtaattttctttccttgctttactgttatgtcatgaaaggtagatccgacacctacgtttggattgatttctttgtaagttatgagttgtaactgcagatttttttttccctaagagtaaattttacaaaactaagggtattttgatcataatatcataaaactatatatttaagacattatattacaaaactacagatttagcactaaatttatcacaaaattacagatttaaggttaagtatcataaaactatatgtttaatactaaagttatcacaaaattacatattttaaagtttaaatctctagcactattgttagttttgtgactaaatttgttctaaatcgttttatgataattttgttactaactatgtagttttgtgacaccctattttaaatgtctagttttgtaatacatcgagttaaatatgtagttttacgatagtttgatcatgatatctgtagttttatgaaatttactcttttcttaaagtgaagttaatcatctcataaaatttgagtattcccgttgtaacgcacagcactaatttgctattaaataagacaaacagttttactatatttttgtcgccagatttatggctccatatatagcagtcagttttatggccattggattcgctataagattcgtgtccagttaaatccgttgcctgtgctcataccaccgctgctcgctgcttgctgcttgctgtgtttacacttttacacttcatgtttcacacttgcatgtttgcgtctggcgtctgccgcggtccgcgggctgtatacagtttcgcacggatggaattacagattttacagtatgtacctggtgtttacagtgtagttacattatacatgtagtataattacactgcacttacatatgtaatttttctatatttgaatgtaaattttgtgtttgttagttctctaaaatggatttttttttgtattttgactaaattaagttatgccacaacttattaataattaatattttactactccatgtggttcttgtcttaatcatatagggttttaatctcataggctgaaatccgatggtttttggctaaaaaatgtgttgcatgaagtttaggcacacccaacagattcagactatatatatacatatataaagactcgtaataatgcacgtggaaggcatgttttttacaatttatatttaaaaagtaaaaatatgaaaaaaaaatacagtacttgcaagggcatattcatacattgacttgagaaacatggcaagggtatgtccacacagtaaattcagatacattccatgtaattctgaaaaagaaaaagatatattccatgttcaaccttaaatggtaataggagtatattgtttacacacattgtaagggccaaggtcaaacactaaacccacacaaacctttacatcgacttgtgaatatttcgggatcgtagcgatcgtagaatcaggatactaatatttcgtaggatcatataaaaatgaatagtaagatcatgatactataaaaattaagatattagatgagatcggtatcgttttgatttgataggatcgtaatattataataagatactagagtacaaaccggtacactgataaccttgagcgcgacaagcaaaggaggtgaaagaatgcaccacaactccggcctcctgtcctcccttacccccacggaccacgcatgcagcagcgcgcggcagcgatggtgatactacgtgttgcttagaaagggatcctctgactcaactgcctgacatgtgggccatagaaaagtgagacccacatgtcagtgactcaactgcatgtgcagttaagtcagaggatctgcttccgtgttgcttctatgcttcctcgatcgatctccagctccccctatctggcgccaggtaccgcgcctccatgctgccgaagacgtcgatcgatgcaggggagctgatccgtcgccgaccaccgcggggaggccggatccgtcgcctgccgccgcggggacgacggcggcaggtttcaggcaaggcggcaacgacgacgacaacggtggtgacggcggcgggcttcgggcaaggcggcggcgacgacgacggtggtgatggcgtttttgctttttttttttttattttttttcccgtgcgtatgcgtcactcgcatgcgaaaatcgggatcttcgcagacacctcattccagatgggtgaaagatccgcccgcaaaaaccgattccagccgcacgggaaaatcgctgttgtactcgtgacagtcatgtagtatatggagatcaaagagcactatggctgtgccagattatttgaaaacatggacactcggctcaagctagacatttgcacgatttcccacgatttcattatgtaacacggaaatgaaacgaggattattcttaaccagtcgttatcaccttatttcatatacataatactttgcacctcactttgttttaaaagaaaagttttgttattaatagttccaaagctcaaaattaattgtaaaaaagttatacacgttgtccaatctaatactacctccgttattatcagatgaacccgttaatgtttagcataacatttaatcagccatcttatttaaaaatttagtgtaaatatgtaaaaatgtagatcacgtttagtttcttcaataataatgaaaaaagtttaaaaaaagatgacacttacttttttttaataagacgaattgtcaaacacaattaaacagttaacaatgtcatctgttaaaaagggagtacttttctatcacttattattctcttataatttataataaaagaaaaaaatatattctcttataatttataataaaagaaaaaataacaaagggaaatgtatattcaataatttaaacaaccaacattcaagatgtatcattagaacattattaaacaaaacaaggggaaacatatgtccagcgtgaacgattcaaaatggaggcaccacgatctgaagtgtcatgttatccggtaggtctgcccctggattatgcattacagtagttcctcgttccatgtcataaacatacaaacccttatcattaggtctcacaaaataaatgcagtttctcttcaatccaacatcttctgcagtgagcgatgatccaaagccaatacactcaaccaaaaatgccttgttaccaattgtgttaactttcacccaaattcttctagataaatcgagtttatgaacttcaatctgcacaaccttctgagcacataccactggatgtttaaatgataacatgaacaactctccacaagattctaacaagcaattagtaaaagtggtgtaccaataaattggatctgatgcatccttaactggcgtagttgtaaatgttggatttggcaagaactcaagtgtcacaattgccttctccttacttaaatatgtgcaaaacctccctccaactgcagtgagatctttcattgttagaatgacgtttctacggttttcatgagtagtgatcatacttgactggtactcatgcttgaaccatgtgtgcccttgaggatagcaataccaaaatgatgtgttcctacaatttaccactagcacaacacaatttggataagtgggtttatgtgatagcaaacaaacgacctcattatttgtaaggaaactatcttcatccaagggtagattgatcctttgatctgtgaaaggactccataagaatgtttcatgtgattcaaggtgtaccataagcaaccagccctgtggtgttctccagtatgagtggcaattgaatatatcacctcttttgcataatagttcttttctggctatactgtagaagaatatggtgacatcttcctcttggtcatcggtgtcgtcactttcctctgtcccagcatcctcattgttttcattataatctcctttacaaatgtcatttgccgcctctccaagtttatcatcatccttatcgttgtcactaatatcctcgtcaaatgaattatcatcctcgtgatctaactcttcatcttcatcttctatggagtagtcttcatcctcggagttgacctcatcgtgtgtatcatctaagttgtaatcaacaaatagtagcaccggggcaaacttaggatcaagaagagttgaatattcttggcctttcttattggtctccgtactgtgagctagcatgttttctgtgacaatagcataaaaattgaaaggttagagtgagaaggttgaatttatattccaaaaggtattaagagtattgtgttactgttgtttttcttttctcacaggaccaacaaagaaacagtggccaggttttattagggaagaaacgaagattttacacacaataaacaccaacgatattgctgagcaaattaaaggacaaataaccgaacacggaaaaggccaaacagattacgtgaatatacactagctacatcactgtccgagagaacatcaacaacaaatcacccacgccacgtttctttttttgtttgtttgtttttctgaaagtagaaaagacggacataattatgtttccacaaatatgtcaaaggctctcacgctaaataagtacgaagtagctaatctcctcgaaaaaaactacagtagctaattcattaatactcctatatgatataatacgaaattataaagtatagtaggttatagaggtttggtgccatgtaccttcttcacgcgtgttaactgcagactcgtactttgcttgatcgatcgatcgcgttgcctcgccgccttagtcgcctatatatctattctatttattgggaagacttctggtcgtggtggcgcgctgcgaatcagattagaactcgagtaagcaatatgatatttccttctccgatgccaattagattagaactcaagtaagcaatctgatatttccttcttgaactacatttacgttataacggacagcctagacggaatacgataggaaataatgtgaaagatctgttatagattttgagccgtgtgcgatcttaacaaagatggattagattacacccgtatgaaatacgtacaagaacatataagtcatggcataagtatatatcttgttgaaatacacaaaacaaaattaaattctgtaaaaaaaactagaaaaagaatttacattcaaacatactatgtaagtcacacggtaattacaattacaatgtaattaccatataataactatgtaacttctgtatttgccgccattgttttatgcttctctatcttctcatggaacctaagagcatggccaagagaggcccaaaactctatcccaaaattctggttttgggatttgtaatcgggctttgaggtgttgagtatattgctcgcttcaaaagatgccttaaatttctcaaatgaaaaggtgggggccaccggttaatccatccacataaatctcggttgtttctccccttcccatctgatcgctcctctccacgatcgttcacgccccgcgatgagcgcgcaggaggccaattgggagtgagacttcttccatacctatatatggagagcgataaacccagtgaagggaatcctgattttcggtttcatgtttagggccaccgttcgatctatttttttcaacaaaattcctaaatattttgtgtgtctgtgtgtgaaacaaagacgagagtacttcctccgtttcacaatgtaagtcattctaacatttcccacatttatattggtgttaatgaatctagacatatatatctatctagattcattaacattaatatgaatgtgggaaatgctagaatgacttacattgtgaaacggaggaagtagtagatatttttatttagagggatttattcactaggtaaagtcctaattatacccctgaactattgagtgagtacgaagtaccccgaaaatcagatatcttttaccctcaactatcaataccggattgaaccccctcctcaaagcagctttgcaagtggtttcggtactacgtggcagtctagtcagcaattcttttattaaaaaccaatgaggctcacctatcggatctctctcctccctatctcttaatctctttcccctctcatacatttctttctcgcgcgcgtcagatgccgaagaggaggcgcgccagcaactacaagtgtctcgcggtggaggccgaggacgagccgcgtgccggcggccgcgagcgtcctcgcggcagaggctgaggatgaggccgaatgtcctcgtggcgagcggcggccgacgtcggacttgcacgagaagatgatggtggtgggagggggagcggcggacggcaccggactcatcttggaatgacacccacacgaacaccctgtcaccggcgcgtcccaccactgcgaggctctgctgcactaccgccatctgcccatcgccaccctcagctccccctccatcgccccgag

SEQ ID NO: 22180 - DNA, 11053 bp, Oryza sativa
  unsure (1)..(11053): unsure at all n locations
tagagaggggagaggaaaggacagagagggtgggagactgacaagtggggcccagtgattaaaaaagaattgctgactgaactgccatgtaggatcaaaaccactccgattcgagtcaggggataattcgtccggtattgattgttgagggtgaaagatgtttggtttttgagtcaggagccgattggtcacaatttgagagctctctagagacatcatgaaaggcgactggaaaaaaaaaaaaacaccacctctcctagtaatcctagattagcatagcgtgagtcggtcggtcggttcctcctgttttcaagaaagtgtctttaccatcgctagggctatgtcccgtttagcccgaggtcgctagtgcagtcttcatggcggccagccttacaaataattgatcaggtggtggtgggttttagagtcagttgtccagtggatcagactgcctcaacttcgaggcttggtgttggcggatcaacgaggtgagtggttacgtgtagggtgaaaacagtatgtgtattttctgaccgcccacctgactaaggctcactggaagaatgtgggaaagaaaatggtatacccgatactatctaagtttaaatccaaattcacaaaaaaaaatataggttaggatacgaggagagttgtatccgtccgtttgtcccatattatgaaacatatataaaaatctattataaatcaacctacaaacatgataaaagattggttaatcactattttacgaggtcacatgtaattttgtacaatttttttctcaatatatctcctctagcacttaattatattcttatatttaatatctataaattagagatacaaatacatatatgttacccaatcctatttagaggaaataatatgggctaggattcaagatggttgatatgttatccagcgttacctgtaccggtttcgaatttgaagaaaattatgagttagaatatgagaatgccaccgaacccgtccgttttcaccccttgcaggtgctctcttccgatagatctcgcatcagcgatccctccgctcgttggctttgctggtggggagatgcacatctgctcacacattcggccggcggtccaggagatccaacagggcaggagcttgatagcgacgaatctgctatctcattgacgaacttcgtcgatcggttgtgggcacagaggcagcgatttgtgccttcgtcgtggtgaaatccttctgattcaatacgcaggcaaatgttggtgccttcgtcataatgagatccttcttattcaatgcccgtgttgatctccctggattctttttttgaacttcatctccctggattcatgaagcacctgtttgatccagataatattagatacagtgaatcgtcaccatgctagtgctagcgtgattatgggctgctgttttatgggggtttcttctgttactatcgattgcggtggtcaacaacttaattaacatgtcgattttaccagtgaagtgtcagccacaaatgcgactttggtcagcagggatgaagctagcgctcctcagatttaacgtagagccatggcaattctatattgagaccgatgaagcttataaaaaatcaacaattcaacaataataaatatcaaactaataaatctcaaactgtgctttactctgtgaaggcaatcgaagagatcgccagtttctcaagcggcgtgcacgtttgtaaaggcctctcgatagaatcatcgcggcaacgctggtttcgtctattactactgcacgattgtatttggaagattataaccataacccagctatctttacctggatggctttatttatgtctttatgttgtactccctccagtttataacatttgactattcgtcttataaaaaaatattataaaattattatttattttgtttgtgacttgctttattatcaaaagtattttaactatgacttactccttctatttcacaatgtaagattttataatattcccctcatacatatagatattaataaatttaaacacatgcatatgtctagattcattaacatctaaatgaatgtgggcaatgctagaaagtcttacattgtaaaactgaagcggagaaagtatcttttttatattttccctaatttttttaaataaaacgaagggtcaaactttaccagcaaaacatcaaaacgacatataatttgaggtaacataagttaagacaatgtactgtgcatatttatatttccctaaactcttattaataacgtacaaattaagttattttttttagaaaaaagaaccggcaatggggcaatatcacgcggggagaagcaaggtacgtcccaatccggggcagacttcgcgcgtgcgttccgaattttttttatttttagatttttttaaaaaaaatatttacagaaataatctatcggccaaaaaaattgcaaaaatagaccctgccgcccacctctggggcggcaagctgacgtggcaaacgggggagggacgggcggtgacggagggagggtttttttgcagtaaagcccttgccgctctcttttggggcggcaaggggcccgaatgcaaaaaagctagtcgaggccggtcattttgcaggcggccccttgccgccctctggccgggcggaaggcctcgctgcctataaaaggcctgccgcccagcccccagccctcattcctcccctcaaatccagtgaaaaaaaacaagaagaaaggggaggagaagagaagaaggggtgaagccctgccggattcagacgccgatttcaggtaatattcatagatcctatatgtgactattgagttaaatagtgtattttttaaaactttatttgaataaatacattatatttttagggttttagttgtactaatctagaagtgcgtattgtagatattgttaactatgtagatctgctagtttggaatcaatacttttccgttgcattggcatacacaagaagatattacgttgtagatgtttattgcatgaaagagtaatatgatctagttattttgttgacagatatgtcgaacaaacaaatattccaagtttaccatggcccaggaaacgtctgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacacgggtggcctctagctatggttccgtttgttcacccgaaggatccatgtgtgcagatgaacatggatgatggcgagggaccaagtgctgaagtaaatgagacttctgtggaggaggtcaacgcacgagaggacgggggtgtagtagctccagtgggcattcaaccaggtgtagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggttggtcgtctctgaagaggatagtgtgagatgggagtacaaagaaaatgagattattcaggaagcgatttatagtagagcagaagatatgaaggaggcggtaaaacattttgcagtgtcacttcatagagagttttgggttgccaagtccaaccggtcgcaatatgaagttcggtgtgttaaggaaaaagatggttatccctggagagtgcacgtgtataaggggaaatagaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagagccaaacagaaaataatagagatgagatttggaacttacgaagcctcgtacgacaatttgccacgcctgcttggcgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagcaggtactggttcctgaaattggttaaaacaaaaattgttggtatgaggccaaatgtgtgccagatacatgataggcacgctggcattctgcgagcgatagaagagttgcagtttgggaatatggaacaaggataccctggtgagtgggaagatgtacagagcaggtggtgcatgcgtcatatgggagctaatttcttcaagcaattcaagaacaaggagctcatgaacatgtttaagaggctatgcgatcagaaccaggagaaaaaattcaatgagctttggaagagattagatgagttgacagccaaatgcagtgatcagcgtgcagcggctccatcaaccgccgatgctgaccctccttaagctcttggacctctcccaacggatagtccaacattggttagaagaactggattggagattcggaaattttctcagtggattctgcatgaaccaaaagagaaatgggccaaggaatatgacacaggtggtgctagatatagaataatgacaacaaatttggcagaagtttacaactaggtgatgcgcggtgttcgtggactgccactagttggcatagtggagttcattttacatgggacatgcaggtattttagggatcggttccaggcagttcttccctctatgccgaacaacagcattttgtttggaactttcatgcagaaaaagctagaagagttgcgtaaaaaggccatgaaacatcgagctctagtgcaaggtacccaacagcacaggtttgagatactatgtcaagataaggcaggcaggggtatctaccgcaagagagtgaagcagtagtgtgttctcaaagccgacggcacatgtcattgctcttgtgcaaagccgaagctgctccacagtccatgcacccatgtcattgctgccgcagcggagtgtggcataccagatgcagtatatgtttcacagtacttcagtaagcaagcaatatatcatacatggagcggcgagatttatgggttcggcatagctgggtagttcacagagactaacgatgaagtactcaatattcctgacacatcgaagctccgaggcaaggctggaaggaggaagactcgtcgcatccgcaacgatatggacgagtcggaggctggcagggtgaagcgttgcagcaaatgcgatgaacgtgggcacacctacaagcattgtcctaaagacaaggagaaacctagtgcggcagaggcaggactatcaggatcaacagcagatggagctcgccctacggatgaaggcactacctccactcgaccacgtcctaggcgtcgtcgtgccacgtctggctacatggtgtagttcttatgttctatgttggcatgtggctttgcttgtaatttgtttcgaacttatcgatgtgtttatgtttcgtcgtgaaatgtcagacttcggcatgtcatgtctttaggtctcgtgatgtaacgtcagactaaggcacctagtgtctctctttctttctatctgggcagctgagaggattgcgatcggccgccctgaggtggaccagcacgcgtacaaggagtcactgtacgcggagcgaccagaggtcgactaccctacgataggtactctgtggtgccgtcgtcaggtacgttgcatcgatcttctcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacagtctgcaccagggaccaggcgtactggatgactacggttccgatggtcttcgacatctgcgttgagcctcatgcccctttccgcgtgatgcggcagttcggcttctgtcagccctttccagtaccgtttccgacgaccgtcccagctgctgttcatcggtaagatctttcactacgctttgagttgttgcattaaaatctacatgtccataataatttgcaacatctgtcgattcacactaatatgacacattaattcgcaagtactcgcgcaagggtcagcagtcagctggcgactggcccgccaagttggcgacttttgttgaggactggttgctcacaaccgaggaggtcgtggaccacgagggagagccacacactgaggaggcgtaccaggcctacctacgctggtaccagccacgtacccgtactagggtcaccttcgctcccttggagcagcagccccacgttgcgagcactagagacctctacgccaggcaccgcgaccaggacttcgctcgtgctgtgagtaccatgcatcgcaccattcctttatgttttcatgtctttctcttcatcaaattttacgaatatgtacgaaaaaattaaccaccaatgtttaggcgcggggattccggtacccgtagaggagcacctgacgacatacacgcggatggtggagtcgatacgctcgattctccgagtgctcacatgtcgtgcagatgacgttgctcgggcagacgcagctgtacagcggccacccgtaccgactggtccccgtccagctatgcacgttcctaggccgactccccctccgcacggaggtaagtatttttaaggatttttctgtacatgccttgcacatatatgtgagccgtttcacttgccgattgcttcagggtttcgtgcaccgttcagcaccccgccttcctcggctaggccctctgttgtgcccccacaggtacttaaaaaaacaacattacttcgacaatcaatttacatgcattttatgtcttagcttacaagggtcccgttgtccatgtgtaggtttcacccagttcgctatgacgcaggctgcccacttctcccaggctgcagcgtcagtgtctcaggcagctgcgtcgacctcgcactcagtgcagttctggcagtacaccgggacttcgtcacaggcagccggcacgtcgagtcagggtccaccactggaccatgctgggacctcgtcggaccacttgctgccttccaccttgctcttcgacatcactgacttcgatttcgcttcaggctagacagaggatgtcatcggcccctcacagctgagaggggcaccgccggtgcagacgcaggaccaggcgcaggccactccgccgccagacactcgtgctacccgtgctgtgccaccggatcgtttcacctactcccaggaccacgtgcgagcacaggcccggaggaccaagcgtggtcgcggcgcggggcagggccagtagagcagtcttctctttatttatttgcttcactttccagtactgtatgcttgtgtcatgactacgttgttgttatatgtgcacgatacctttcggcgcatgcacgactactttctgccgcaccgatgcagcctcctttattcgcgtgcgatacgagtatttgcccaccatttgccgcatacgaccaatgtaactttcggcgccgatcaggcatgtaactttcggcgccaatcaggcgtacccaccatgcctcgccacgttcacatgtcagggatatcactcgattttttgcgcctatataagtcgccttaacgagtgaggcctcacaatctttcagaactcagtcacattcagtactctcttcccccacttgcttcattacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatatttgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcctgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggatgcccatccaagatgcaggtgtggtgatcgtggtcaggttcttcgttccataaagcctacaacattgggtcgaaggttttttgtttgtccaaatattcttgacgacgatttcatggtaagaatattttgattacatgaatccttattttctcacaacatttactaactttgctcgctttacatctattctttcctcctaggaaccaccaaggagatatcaatacagaaaacggatagacaccagaagggttctaactccacctagccgtgttgagcagcttgaaactaccagagcaatatagggttactaaagcgcgttttgagagaggagagggatcctcacgtaggggttagctattatcggacaacttggcatattgaaatttctactgtcatgcttccttgtcccattactacatcgtcgttatgttcaactattgcactacctccctcctagttcgaatctaatattatctatgtaaccgcaatggaaatagttgtatcatgttcaaattgtactactatttcttcatgttacataattctccttgtttaaatccatataatgtttatacgaccgaaactgcgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggtcgtactttttgcatctgggtcccttgccgccctctactggggcggcgaggggcccaaatgcaaaaagtacgagggcaacctctttatgggcggcaaaaattgcaattagccccttgccgcccagggtaattgcaattttggccgacggcggcggacggcgcggtcgacccgccatctgccacgtcagcttgccgcccaccactggggcggcagggtctatttttccaatttttttggccgatagattatttccgtaaatattaaaaaaatctaaaaatgaaaaaaattccgtgcgttccaactacttgggccagaaccaaacgctaacccacagtcgaattagcccaactttaataggccaatacgctagctcgggaaggggtcgaaaagtccaatttgatcaaaaagtgtaacgacaccggcccacagtcgaagtggcccagttggccaacgcagcccacattaacaacgccaaccccaccagagcacgcgctgcctagccccaagtcccccaaccctcgccgccgccgccgccgcctcctcgcccccgaagcgtccccgccgccgccgccgcctccccgtcgggaaggatgaccctgtccatgaagccgcggaaggtgctggtgcggaaggcgatgaaagaccgcaagaagaagaagggccccaccaagcccaccccatggaagtgccccctctgccacgagctcttcctcggggtgcgcgagggtaaccgccacttcgaggagtgcgaggcggcgaccaaggccgcgcgcgccgccgaccagaggaagatggacgtggaacgcgctcgccaagaggagctcgtgggatccaaaaaggccgccccaccgaaggaaggtagagtctcgttttcgttcgcgttatttgcatcgcaatgcatggatgaatgaattagactttctggagaacaatcccgcaatggatggatgaatgaatgaattagactttctggagaacaatctgataaattaacgaattgaacccgcgtagttttcaggctatgaaaactttgctgcgaaattcaaacgaatgttccccaacatagataggaattccatgcagacatttttgacaaatattagcatgctgggtgtataaaatatatactgcactgagcaaatcttaaaaatcactcttttcaagaccttacatagttggacgcacctggacctgctgcaaagaattactagtgggttatatctgctgatttgttttagaacccatacatttacctttccgtagtacctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22181 - DNA, 316 bp, Oryza sativa
catcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaacctttctacagtgcttaagatacgtactttctgtttcatccatacagtgagtgcaagccttgtaccccttgttggactgtccggataggttgctaagtgcaggccaa

SEQ ID NO: 22182 - DNA, 761 bp, Oryza sativa
  unsure (1)..(761): unsure at all n locations
cccgcctatatttgaaatttaattatattgcttgcaaaatattatgcattgataggatcacacttaatctgttgtcccgtctgcaaggcagattggcagacctacctaatttgtcgcatttgatccttccattgttaattgctatgccatgtccccttgtaaccacccagttgcgcctcgatactcgtgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttatccaaacataagacaagtacgaccacatagatagatagatcactgtctttttgtgattagtaatttaaattgtttgtttattttttaaaacaataagggcaaaaaagagatcggaagggggagaagcgaagcaagcgcaaggtgtggtgggacatatttttatcttttttattagatcttttgtccttttgtgattaggaataggaccgattattttaatttcgctcttttttcttcaggtccgattttttttgccatgatagaatggacgacaaaatcatttaanatttttttaagtagtagagatttgtacaatagcttttacgtcgcttaaaacacataaatataaaagttttaaatacaat

SEQ ID NO: 22183 - DNA, 1119 bp, Oryza sativa
cttctttctttatgcatgtatacgtgcatatatgatgaaaaagagagcaaaaaaaaaaaaagaaggatcgatcaccggtggggcccacaagtcagcattggtgtggaccccaccagtgacacgtggcaggaggaggggagtatgttagtactgaccgtcggatgaaggaggcgatgaaggcgtcggggttgccggacttgaaggcgcggaggaacgcccacatgctgcccaccatcggccaccccatctcccccggcggaaaccttgacctcctctccgcccccagcgccgccacgcgaacccagtcgtgcgccctccgcaccaccgcgtcgaccagcaccacgccgggcaccaccgccgccgccagcacccacaggtcccccgccgcccacgccgccgccatgcccatgccctccatcaccatcgagaacgatctatcgatgaaccaacgcaacgcaacgaaggaacgaaacgcacgcagagacgagtgtcgccaaatgctaagctcctccctctcaatatataccctggcgactgcccaattccctcctttatttatttatttctctaattttaatttacgcggaaaaaaatgcgtgcttagcttttttttttttcgagaggacaaaaagggctttacataattaatcaagatgttctcgatttaaaaaaagaaaccgataactaggttgatgatgtttgtgatgcattatttggcgattaattaatttgttctcgaaccctcaacacttaattactagtagtgagttttgtatgtatagtagctcgatcgatgggattattcatcgtgagcatgtccagagatcctttgtactttcttctttggactcttgtggtttggtttcgatccatctaatttatcgccggcttttcttgtaccctagcttaataacaacacagtccatcaattccagtgatcgaaatgcaaaactgattaaccatggttttgctctccatatgtatctagctcaattaatttgtatgtagcaacgactccatttacatggccacacatggatatattacgtatctcttctagctagtagttgcacggtctatttcatccaactcgtatcacgttgagtttaataaagcttg

SEQ ID NO: 22184 - DNA, 834 bp, Oryza sativa
  unsure (1)..(834): unsure at all n locations
atttttgttttttaccttgagcagaagcatgtgcatcctttttaccgttttaatatctagcagtatctctatggggcttgcctctatctatcttgtagtagtgaaccaggaaaatgccacctgtttgatcattgccgtattgtgttcaggtaatgctgaaacctcctagtgatgatcccttgtatggaaccagcggtgaagaaggcagacctcttgatttcactgaggttgacatccgtttgccaatgttggtctatgtgtcccgagagaagcgtcctggttatgatcacaacaagaaggctggtgcgatgaatgcgttggtccgctcatctgctgtcatgtcaaatggacctttcatcctcaaccttgattgtgatcactatgtttacaactcacaagctttccgtgaaggcatgtgcttcatgatggatcgtggtggtgaccgtattggctatgtccagttccctcaacggtttgagggcattgatccatcagatcgatatgctaaccacaacactgtcttcttcgatgtcaacatgcgtgcacttgatggtatcatgggaccagtctacgtcggcactggatgtcttttccgtcgcatcgctttgtatggatttgacccaccgcgctccaaggaacatagtggttgctgcagctgttgcttcccccagaggcgcaaggttaaaacttccacagttgcatctgaagagaggcaggctttgagaatggcagattttgatgatgaggaaatgaacatgtcacaatttcccaagnnnnnnnnnnnnnnnnnnnnnnnnnnnnnnnnnnnnnnnnnnnnnnnnnnnnnnnnnnnnn

SEQ ID NO: 22185 - DNA, 22156 bp, Oryza sativa
  unsure (1)..(22156): unsure at all n locations
nnnnnnnnnnnnnnnnnnnnnnnnnnnnnnnnnnnnnnnctactcagctgctctaagctcacaccgatccagtaatcgagctccagacatccatcaatggccatggagctctctaacctgacgaggtgccatctgccactgctcctgctcttcctgctggcaggatcctcctccatggctttgccagtgcatcctgcaatggacagggtgagatggcaggtcgacaaggtcaaccggcggggccattccatcgggctcgtcatgtcgtacatcgatgaggccactgctcttgaatcctccggctacttcagaccttggcatgtcctccccttcgttgacctctacggtaactctgggccttccatttccaacccacatgcttgaatggataagtcttggcgtctttcattggcatttccaacatccaataactactgctaaaactgctaagtgaaccaaaataccaaaaacagaacaaatgcacatatggatacataatgctactattgaagtcagtggtagtttcagcattttttttcccgaaggacagtagtttcaacatttaaggacatcgaatacaagttttagatatacctgaatttgtcatatgtgatgaagccagcttgctctgcaaatttaaatgatctgcgctcaatcaagacctgaagaattcaacatgtgatggtttagcctgtcaattagcaatttcataatgtggtttggcacatcgtcccatttacttattgttggatgaacacatcaaagaacggggtacagctgtacaggaactgtaaagccgtaaaccaagatttcacatcatgttgatagatgcactataaaatagaaaactttgccataaggagaacacaaaaggaaaaaatacaataatataccacattttcattgtatcaaatattcattttacaggtttaatgaaattttatattccgctgatatattatattcccattcaatttcgattcagaacatctcatgtagtccttaattcttttacatcttataatggactctcaagaataaaatgctgaactcttcaaatttcaggacgaaggtatcacatcgggagtattagaggtgtcaatgttatatatgcactgacaggacaacgcagggtattaaattcataagttatttgcgtttacattatctgccttgtgatacatggagaaaaccattttcatatatcacaagtaatgccaaaagaaactgctgtgagatgctatttacatgcaggattttaatacaaactgcgctatgcttatgcattgttactatgcctttgttcttccagttaaatgcggctgtgactgtacagactctcatcgacgtctttactgtgtctggcattgttcattatggcacagcaggaagttctaatgattcaatgtcatttggcgatgtcagtgtccccaaatttgttgcttatacaagtgcttggacatggaaggtaccctccaactgtgatctgattccgtttccaacctcaaagaagtaaagattcaaagcaactggaatctgattattccccttaaaagaatggaatatgattatctgtaaatccagtattatagttgctttgaatcattaaattagttacatcgtgtcaaaatatatacactactgtacttttaaaagaatgctttggtgagtctaccacccagccttctctctactacatcttctactgactgctttgatgtgttcaataaaaaaaaattccatttgctgcataatgttaggacatgagtggctcatttttaatctttagcaaatgaatgaacattcagctaatctattaataaatttagttctgactagagaaaattaaactagcaatgcttatataagcatgttagttttaaatactatggtatactaaaaatcaaaatcacatttagtagtagcctagtaggtaaacacacatcgagcctggagtgaaagtagaggacagtttataagcacaactacaggataattagaacatactccctccttccctaaatgtttgacgccgttgacttttttaaacatgtttgaccgttcgtcttattcaaaaacttttgtgaaatgtgtaaaactatatgtatacataaaagtatatttaacaataaatcaaatgataggaaaagaattaataattacttaatttttttgaataaaacgaacggttaaacatttttaaaaaagtcaacggtgtcaaatattttgggatggagggagtattttagtaccaactgtctcacgtttcaaactaactctttatatgacttcttgtttttgattattttagaagttcaaatcaccaaaagagtcggatacagaacttagctttggagattttactgtcccaaatggaggagagaatcttctaggagctctgaaattcagaaatgaggagctatactcagtgggtaagcctatgaaagaagttttctggttacctgtagattcagcatggttcaaaatcgcagaaggacttaaggtgagatatagcataataaatgccagcttatgcttgaccattaatgcccgaaaaattgtactaattgtgaaatttttataggtttcacttgaaagatgtaacgacactttctgcttgccaacaactccaaaagtagtctgtgggctaaaaggatcgtcagctgatatgtttctagacaatgcagaatataggaagttccttttcagagaatttggtgtatcaacagtagatgaggagagtgcagcagtggtgatggtgagttttgtattttatctctcatggtttccacttaaatatctgccaatatttacacatcatttttcatgcaatcatgaaggttaagatagatttatataattaacagaacatatactaatttcaacagacaacaacatctcctggcatacctgtgattgtattccggggagtttctgatttggctggaggggagccaacatggtcgtcaacaagcctgatgaacctggcatctattaatgcactcaaagtggcagtggagtttattgctacagtcgggaaacagaagtcaacaatgtcagcaggaagtgctaataactgaaggaaaaagatcacatccatgctgatccaataatgccctggaataacattttacagcagtagctgcattcagaataagatgctttcctgagcttcaagtgcatgtcctctcccataaaggatattagtgttgaattattttgttgaaacttgtaagcatgcatgtgcgatcattttattgcaaatggaatagcagatgatgttgctttttacgaaaaaaaacaaattacatcagtacggttttttaatccatgatcaaaaggtaagaagaaaatgataactttcagttattgacagttcgaccgaacatgtgaatctaatctcaggccaaagataagacatgagaaagtcatggttgctatgaagaacaggttccctatgcactagtatcttaatgtaaatagaagcatttcaattttacaatgactgactggaatttgcagtatgtttcctgaaaaggtgaagtggctataacaattttcagatacttcacaagtttagccatttagtgttgatataagaggcagctgcacagccctacaataaaacaaggtaaaactcattggcaagggcgttggcaatagaaaaccatatatgtagaatcctattatcgcatagcatgtaccacgtataaaactaagcaattaccttaagaactttgccaattagtttcacctaattgtcagatctgatactctgatctttctgaagctccctcatctccgggtgcagattcaaactgtctcaacacttcactaccagtagtctccacatgagcatttgccatccttaaaatggtggaatcgctgaatatctctcatgattatttcccgtcctgtcactaaagatattagcttggttgcattatggcagtcattacaaactcggaggttcttctttatctggattgttgtgccaggggctgtgcgaatgagcccaaaagcaatggcaagcttctcgctgtgggtgttgagcagctgtgctttgacatcatcttccacatcatgtattgaatcagtgtctggcacatagcccactgctttgatctcttctatcaacttagccaaccttgaatatatctcctttgcttgctggtgatttgtgcttccagagtagaaggtatggatctcattcttgagttgaatgatactccatccaggagttttttggaggccattcttctccatagcagttctcacccttgcaacatccttccacatggaagcgtttgcataaatgtttgccaagaggacatgatacactccctcctgtggccctagctcaaaaatcttctgagccgattcttctgccaactccacattcttgtgcaacttgcaagcacctaacatcgcaccgtaaacactaaggccagggtccataggcatcttttgaatgaaagcccatgcttcatctagcttcccggctcggccaagaagatccaccatggtaccatagtgctccatcccaggttcaagcccatagtcctccttcatgctggtaaaatattcccgtccttcatcaaccaaaccagcatgactgcatgcagagaggactgaaaggaatgttgtctcattaggcactatgccaatgctcttcatctcttcaaatagctcaactgcagctttgccaaaaccatgtgatccataaccatggatcatagcgttccatgtgataacatgcctctcccttgcagaattgaacagaattctagctatgttaacacggccacattttgcatacatatcaataagggcggtcagaacatatacatcctgatctaggtgtaacctgatagaatatccatggatccatcttgcctgcagaggatctgaaatatccgcaagagctggaataacactgacaagagtgaatgaatcaggtttcacattctccaactgcatcctagtaaaaagcctcaccgcatcctcggagcatccattctgcgcgcatccaaggatcatggcattccacgatacctgcgtccttctgtccaactcatcaaacacatgagatgccaggtcaactctcttgcatttggaatacatggtgatgagtgcattcatcactgacacgttggagtctaagccaatccgcacaagcagttcatggacacgcatcccttcatcaagacagccaagctccccacacgcttgcagtgctgccaggacagagacatccgtcacatcgacaccctcctcgaccatcctattgaaaagagccagagcctcccttgaatccccattctgtgcatatccatcgatcatggcattccaggacacggagttcttggttggcatccagtcgaagaccacccttgctgcccggatgtccccacacttgcagtaggcgtcaaggatggccgtagcgacattaacaagctcttccagcccagaacggatcgcgaacgcgtgcgcctctcggcaggcagcaagcgccctggcgttcgcgcaggccggaagcacggacacgagcgtgatcgagtcaggccgctccccttcctcctcctgcatcctgacgaccatctccatggccatccgggcgaggccgttccgcgcgtagccggccacgagcgcgttccacgcgacgcggtcccggacaggcattcggtcgaacaccctgcgtgcgtcggcggggcggcggcacttggcgtacatgttggccagcgcggtggcggcgagggcctctgagtctatcccccgggcggcgagctgcgcgtggacggcgcggccggtggcgaggtcgccgcgggcggcgcagagcttgaggaggaaggtgaaggtgcggaggacgggtggcgccccggcggaggacatggcgacgaagacggccagcgcggccggcaggtcggagcgcgcggccgccgccctgaggcgggcgtggtggtcgtcggcggcgaggccggtgggtttgggaagaggagaggggaggagcgaggcggtggcagccacggagcacaccatctcgactgcggtctgcggctctacatgcaaccgccactggcactcgctacgcgcgccctttttgtttctttctttgttactatctcttataggagtagtagctatttctcacttggacaaaaattagaaaaaagatttgatttgttgtaaaatgaattgagcaaaacatacttaaaaaaaggcaaaatctaaaccgagaagcctctctatttagtgttaaccagcgacgaaccaattgtgagaagaggtactgttacaggtgctgacgtacatgctatttttactcttagacatgcatgtctttttcttccttctcataaagttttctctcaaattatttatccgatctacaattcgattacaccattgcattcgttataattaaatcttcacaacaagatcttatatgattatatgacgatgaaaaaatatttatatttgtaaattacttttattatatacgtaaattacttttatcatatatataagttacttttagatttgactaagttacttcttagacaataaaagtaaattcaatgaagtctaaaagtaatttacatatattataaaagtatcttaaaacaaaacggaagtaactttgtcacgacattagaagtaaattcatagtagggataaaaatatgactttatctagacattaaatttagtcagcacagatcaacacacgtaagtttaacaatttttaaaagtaacttcaatattaattggaagtaacttttgcatggttcagaagtaactctataaatctgtttaatcaccgattgtttttttccttttatttttgttttttatgtagaatgagaaaagaagataaaacctttgatggattgtaaataacattgatagaataaataataagaattaaccatgtataagatgtaatagttactttctaacatgtaataaattacttttaaattaaataaaatgagaatatattcaatatgaatatcgttttgtcacatattttgagtggagtacaatgatgcaaatatatcttaaaaacaatatgtgatttaaaagacataagttattaaaaagattaaaaaagatacatactattggagtacaaaccagcagtcacgtccaatgaaaaaaggtatgcattaaagttacttttctttttgttataagttacttctataatatatgtaaattacttttaagctttatttaatttacttttacatgtcgaagaagtaatttagtgaaatctaaaagtaatttagatatattataaaagtaatttataatttttcatcaaaatataatcatgtgagatcttgttataaagatttagttgttacgaacacaacggtgtaatcagatcgtagatcggatgagtagtttaagagaaaattttatttgaagtataggtggatagagtctctcatagatggagtggtagctggtttagacaaaccagctatcactagctgtgtagtcacgtccttaaaaaaaagtactccctccgatttatattgtaagtcgtttgacttttattctagtcaaacatctttaaattgactaaatttatagaaaaatacactgatactttcaatataaaacaaatatattatcaaaatatatttaatgttgaatttaataaacttatttagtgttttaaatattgccattgtttctataaacttagtcaaatctaaaaaacattgactaagaaaaaagtcaaacgaaacagaagcaatatatttttgttttctcattttactaaaccatcgttgaagggttcgaggtgtatggtagaacagtttattcttcccttatgcttcactattctctctcaatggggcggagacaggagtaggacggctagggctgcagctctattactgagtctaaatatccattagaattgtactttaaaactttaaaaagtagaatattaaaggaaaagctatgtaaattatattagctgagctctagatttagaagaatcctatttccgctgccgactctcattgatctgcacggtaatatacatgacatggttagaattgaacaaccaaaattgagagcactagctagtactaggagtacacgttttgagtgcgtgttatatcaatgtaaatataacattttagttaaagaaagtgtaaatataacattatgaataattgtttatatatcggatcaaggacgattaattgtaaactggttgagctaggaagaaatgcattaatattgagcaggtttttcaaacaatatatgcattccttgagtgaatatataccctctacagttcagaattaggtagcattatcagcttgtgccgttagtactaagttgttatgtctagatcaggtttaagctgcgatttctcttggtgcaaatacatgtttaatcaggtatatacagaggtttctattagcatatacatgaaatagtatgtcaaatatgatgatggtacggtggcgataacggaaggacatcgatcgacaagtgcagtaatctgatgaacaagatgaatgcatgcattgatcgattaactggaatgtacatcacgggacatcttgtagagaaaggatatgtctgatctttcggctgcgagatgaactgaggtacagcaattggtgttccttaatttcctgatgcctcccattccgatcccttcccctctcctcccatcgatcgatctccacacatttttattcttttttttaattagacggcactataagtataattataatatagaggaattgaaggccatatatacatgcataagagggacaattgatgatactatatagaggccgaggagcattatattggtaggttgtttcattaattatatttgagtaaatttatatttttgacaaagtttcaccaatggacaagggccaaagcaacattttcagagagaaaatggacgtgggccgaacgagcacgtactgttaattgtttgggcctggctcattgtgtacacattagcgaatgaaaataacaaaataacgacgatgtttgtatcttatactgcctctgtatctagattcattgacaacaatataaatgtgaaaaatgctaaaatgacttatattgtgaaacggaaagagtactccgtaataattacttggttgattagaatggatcaatgcacaagtttcaaaaaataaaaagagagaatggatcaatacacatatcgatgcgctgcgcgcgcgctctctctctcttttcttaaaaaaaagaagttaacatattttacactcatgcatggactaattcttaaccaatgccatctgtctctcaaaattacacgctgaaagggaaaaaacaagtcggtctacacgtacaaatccattattaattttgcaaagagggcaagccaaaaggcgtctttgcgctcgaatggcatctcctgcgtcaaccaaggatcttaatttagaggcagagtacatgtcttcagctcatgtgaggacaaagggaaggtagggcatcaaaagattgacaagtttatcatggactcttgacagtagaacctatcaatggctgctacctccacggagcaatgcttgtttctttccccatgtactctgctagctagtagggatgattcaagacactatatgaacttcggttagcttgggtaaatgcatgcatggaataggccatggagcttgcattgcattatattgctgatcactcctctagctggtgaagacgaagagtctcatatgtgatatgtatgggtatgagagaagaggagaagctagctagaagcaagcattgtgtacaacaggagaagattggtgagctacattacttgactgaagacagtattcatttcatcttttaatgatcaactcatcaatagtacatacgtattgtacaaaagattctacgtacgtacatagtgagcagcatgacattcaaagaaaatatgtcggattatctgtaaacatttttttaagataacatagattatttgtaaacatgatgggggcatataaactgacatgggaaatatgacgatgtcgatatataacatgttgaataaggccctatttgtcccacgcaaaaacttttcaccctgtcacatcaaatgtttggatacatgtatggagtattaaatatagacgaaaaaaactaattacacagattgcttgtaaattgcgagacgaaacttttaagtctaattgctccatgatttgacaatgtggtacaacagtaaatatttgctaatgacaaattaattaggcttaataaattcatctcacaatttacaggcgaaatctgtaatttgttttgttcaaatgtgtgtccgtatatccgatgtgacacgccaaaacttttcacacatgttatttaaacacagcctaagctggctcgtatgtaatgtgggacggtgggaggtttcttcatcctgaactcagagtaagatgagcaacacgcgctgtgtttagtttcaaagttattattcaaatttccaacttttccatcacatcaaaacttttctacacacacaaacttctaacttttccgtcacattattctaattttaaacaaacttttaattttggtgtgaattaaacacagccaagatgcaatactagtacaaagggacgagtgccatccttgggggagaagaccgatgcatggagctttggtggtgatatgtgctaaacaaccgttgtgtcctttcctaatgcccccaattcccaccttcttatcgatccccgcactttactttggtttacacttacatgatgataatgttatggtatgaaaagaattgagagtcatatgtaaaaggggcaggggagtagatagagaaagatgtataatgttgtaatgttggtgctttggtactacttggtaggttgatccatttattttccaaggttgatccatttattttcatttgtagcaagggaaggaaaatggtaaaatttgtgggcgagactaaaacccaaataatacgaggaattttacagtatttaagaaaatacattgagatatccaaattttataataaaattttggatactttaagatacttaataactagaggtatcaaattttacaatagagaatatgagaccttcgaagtatctctccaaggataataaaattactcaaataatatgagagtgagatagaacaagatgtttattttgcgcatgtgcaacacaagacacggaggtgtgctagtgcagggctgcacctgcaacagtataattataaggtgcaaaatcgatcggtgcctaacaaaaccaaacaaaaaaaaagaaaaaaaagagtaccaaccaaactccaccgcgttttgttggtcaattgatcgattggttcctgcctgccctgtgtctgcactctgcaacaataacatgaacacaatcatcagctcacatgacatcgatggagcattcatatgatgcttctttactccgtacgctttaaagaaaaaactaaattctaaaaataaatctgaacagataattcgaattgtttctttttaagagagagtacacccacatatatccatcgtattagctagtacaatcatttttatctaatttcttaatgtttgtatataactttaatttataaatgcttacattttcggatggagaaaatatctagcaacgattagcatcaaaacatatgaacatatgtatgcccattaaggctggagattctcacttttggcaagggctgatggaggttagggacattttctataggttttgcaccaaaaaaatagggaatggaaaacaaactcttttttgggaagataattggattggaggtagacctttagccttgcagtaccccaccctgtataacctaacaaacacaaagcagatttctgttcatgaagtgcttctggggggttgggataaaatcaaattcagaagggtccttcatggtgacaaacttgctgattggaattttataaaacaacattgtgaagggtttcaactgcaggtggacaaaaaagacaggctttggtggaacttgacaaaaaaatggcctttttacagtcaaatctctgtacagagctctgaaactgcaacagactgcttgtccttttaaaaaaatttggaatatcaaagtgccgctaaaaatcaggattttcttgtggctgtttctcaaaaataaaattctaaccaaggacaatctttataaaaggggttggcgaaagggagacaaaatttgccagttctgttgcagggaagagtctatccagcacttattttttgattgccccttcgcaaaattaatttggaatgtggttacctgtgctcttgacctgaaacctattttggataaaactcagctgtttagttcctggtcttctggttttaacaaaaacatgaaaaacttgttgctggtgggggtttctgtaactatttgggccatatgcaagactaggaacaaagcttgttttgataatatccttcctaaagaccccattgaggtgatttttatgatctgtcatttgattgaatcctgtgctgttttgcagaatttggaggcaaacggaagaaagttggagctgggagccagagtggtaaagcaggtggcaagtgatgttttcaattcaagatacggttggagaccttgtgttaaaaggctggaatgaagctgctaatggtgtgcttttgtgtgtagacaatgttgtctctcttgctgctccctctctgtcttctcttcctctgtttctctagtcttctgctagaacgatggcaaggccttcagttcagtcttctctccccagcccttctgcgctggcctctgcgaagatgacttggtttcagctttgctggacatttttcccctctcttaacatcttttgtttttctctctccagtttctgcttgtaatgacttggtttatgccgttccagtaatggaaaggggggccctcgtgctctagtttcaaaaaaaaaatatgtatgcccatttcatttctatgaattttacgtggtcaaccatatttagacttggtctccaccgcgttcatcgtttttatatcgtccggcgcgaatagccggaacataagctaatcttattattactagcctaaagtacgtacgtacacgtatcgtgtccaacaattgaattaatcatcaccacctttcgctagtactgcacttaattttagtcttgagactaattccaacacaacccatcccatacataagtatatacgaagtacatagaccgtttctctatattatgctactacttgctgttgctgcttcaattttcgtgatatacagtacgtacgtatagctctgtgatttcaattacacaacaatttctaaacaaaacacaacaattaatcaatgacttatatatatactaccttcatgttttaatggataacaccattaattttataataatgtttggccattcattttattaaaaaatttaatataaatatgttaaagtataagtcatacctgaagttatttaataataaaataaattacaacaagataaatgatatttatataattttctataataagataaatggttaacattgtgttaaaagttaactgtgttattatgaattaaaaatcagaagaagtatttcgtacgtttacgtgtcatctcgatcctctgaattgtgataggctgcatgcaatcagctggctggttaattaaacatggagtatatatgctcctataacttggccttgttgagatcaattgatcataaataaaatggcaaattcttggtagctgccgtgtttgctctgctctgctctcttcttcgccgatccattcaacaaagtaattaagcatccaaataatagtagtactccataatccatggcccggatgacgcatatgtgcacatggcggatcatattcatatgtgccatatggacaccagtgatttcattaaactgctcaccaatctgaattcattccagctcaacactagctagttaatctccacataattaatgcatgtgattgcgaccctaccacgaaccaatcttcggatcaattcaaaatgttcatatctacaaacagacaacctgcagtatactcacttcacagagcattattcagcatcagaagtgccctgaactgatgttgttgaaggccagtatagttctcaacgccggccggcctctctctaccaaattcaggcccgttgttttcttcttattgtgaattagagagttgtgaattcaggccagtatagttcttatgaattagagataattatctatttgccactcttataattaatgattaaggttttccactgaacccacgtgtaatagacacatgaggacccacgtgccatagactgtaggtgacaaattcttaattgccacatattaaacgtggcaaatagttaaatgccctttttttaggctgtgtttagttcatcgctaaaattggaagtttgaagaaattgaaacgatgtgacggaaaaattggaagtttgtgtgtaggaaagtttaatgtgacgggaaagttggaagtttgaagaaaaaagttagaatctaaacagggccttatatagtaatttttaaaacatattttcaactatgtaagacataaatattatcacaaaatgagataagccatcgtccatctatccattcagctgaaactgaaagaaccggccggtgatgaggataacactagccgttgtacatgtactagtacacctttggaagcaaacaacaagagcacttggtgtctgcatgattaattaattaattagttgaaccgttccaaactccaaagacaagaacaagtcggtgcatccccacaataacttgggacacatggaaaccccaaacccaacacaaccgttggtgctgatttttgtaggccaagaaagaagaagaagaagctgtggggttgacacacagcccggccatagcttagcagatgcaatgcaaggaatggatatgcaactagtctacaatgcaaaacttgtggtccatgaagcaatatcttgaacaccagtattaatttggccatttcaataggagtactagtatgctgccagcttggggccagggaacaccgaacaccaacatacttacacaactcctcaaaccaaacgaaattaagggtgtgtttagatgcatgggtgtaaagttttggtgtgtcatatcggatatactgacacacatttgaagtattaaacgtatgctaataacaaaataaattacataattcatatgtaaactgcgagattaatttattaaacctaattaatccgttattagcaaatatttactgtagcccaacattgtcagatcatggcgcaattaggcttaaaagattcgtctcgcaatttacacgcaaactgtataattagtttttttatcaatatttaatactccgtacatgttttcaaacgttcgaatagacggggaaaaaaatttgccagtgatctcaatcaccccaaattgtttatgtcacccttatgtgccgtccaagttaaacacatgtcgtattatttgttaactcatactcccttcaatcaacttctgaagttaatacagataaatgttttgaaacagaagttgattcttgtttagacagatggtacggtgtactcttcatatacagcggtgtggctgatatgaatgatgatgatgatgatggcggtggtggtgtttatgaatgcggtttggcaattttgtttttcagatggacccaggtgcatccgtgcatgtgcgaaatgagaaatgtgcattctgaaatctgaaccctccgctcccgttcacaccatcatctcctgacactatcttgagtattaaactttcaatccatttgtaaataaataaagtgaaacttaaaaatgacctgcatgcagattgttacggcaaagtgggtttggtgtgtttgattgatctaataaccgtgcgtgctcagtcagacacgctccgctcgttgttaagcttaaacctgtgcttttgatagtgagattttcatatcaccctaatatagtgggacccgggtttaccaaactattttaaataaaattatcgccattccaagatatgatgtttattgtgataaccatgaaaaccgtatagttatcacggttttaataaataagaagatttactacacgtgttagctgcgtgattttgcaaaaccctggtggggactcacggcagatttggtagtaattgatgcctagagcctggcattaaaattttaaaaaacgcgtgaatcattcagatattcaaaaaaaataaatttgtgcagaattcaccgtcactggcaggtgtttgttggtcacctggccagctgcatcctaccctgtaatacgcgcttccttcctggtacagctcttcccctcctgcatatgcacgcagcagcaggccagcagccgccaattaaaaagaagctttaagattaagaaaaaaccacaacaataaataaataaacaaagaaagaaacaaacgaagaatttctctcataagggttcgactctttataggagcgattttttcagaatttaacggctttgtcctttcaatggtatgcaacgtatccgtcgacagcgaaacgcatgtggtgatttcgtcaatcttcagatttgccggcccagtctttaaagatactcatagggatagggtttacatgtctatgttcaaaaaaaaaaaagaaaaggaaatctctccgtttgtttgaaatattttggctccccattcccaagtctcccccatccccatgtgagcacgcgtctttgtgctgtgctgcctttttccatttcctctgcctacaactcctcctcctactcatttcttcctcgctgcagcagccgcttgcttcctgtgagacttcgtcgtcgtcttctccgagcttagctttcaccaaaccactagtacttgtactcactcttcgcttcccaaatcttcctcatcaattgctaacacgagtagtctatcatcattaactcgcatcccttccccttccattgctcattgtctttccattcatacggtgttgtgttgttgtggcccaagaagaagaacaagtacaccacacgccattactcccatctctcttactcctcctcgagtttgattgattcgagtggtcgcatcgcatggtaagaaaaccatttccatccatctgatctgatgaatctgtgggctgttctctggtttttgaatcggtcagtctgcgtttgccggcggtgttggatttagggttgagtgaacactgaatttatctcttcggattccattcgattttttttatgcttcttgcttcgtgttctgtgggcgacggcgacaaggttttgctgctcagatttgttcttcccttttgctttccaaagtttgaatcttgggtttgggtcccgggatttcagcctattctctcgctgcctgtctgattctgatttctttccaaagacgggaatcttcgagcacaaatctgccatttttatcctcgtacgcgataaagactagctctttaattttccgatccccacctcgcgatgctgatttggttccttcgattcgcagatcagaaagtgaggcgatcgatccatggcttccagcggcggcggcggcctgcgtcacagcaacagcagccgcctctcgcgcatgtcctactccggcgaggacggccgcgctcaggcccccggcggcggcggcgaccggccgatggtgacgttcgcccgccgcacccactcggggcgctacgtgagctactcccgcgacgacctcgacagcgagctcggcaacagcggcgacatgtcgccggagtctgggcaggagttcctcaactaccacgtgacgatcccggcgacgccggacaaccagtcgatggacccggccatctcggcgcgcgtggaggagcagtacgtcttcaactcgctcttcaccggggggtttaacagcgtcacgcgggcgcacctcatggacaaggtgatcgagtcggaggccagccacccgcagatggccggcgccaagggctcctcctgcgccatcaacggctgcgacgccaaggtcatgagcgacgagcgcggcgacgacatcctcccctgcgagtgcgacttcaagatctgcgccgactgcttcgccgacgccgtcaagaacggcggcgcctgccccggctgcaaggacccctacaaggccaccgagctcgacgacgtggtcggtgcgaggccgacgctgtcgctgcctccgccgcccggtggcttgccggcgtcgaggatggagaggcggctgtcgataatgcggtcgcagaaggccatgaccaggagccagaccggcgattgggatcacaatcggtggctgttcgagaccaaggggacatacgggtatggcaatgccatttggcccaaggagaacgaggtcgacaatggcggtggcggtggcggaggcggcgggctgggtggaggcgacggccagccggcagagttcacgagcaagccatggaggccgctcactcgcaagctcaagattcctgcgggtgtccttagcccatacaggtgaatggctcacatgtccatccatgtgctcacatttgactgattggatccgttgatctggtagaaagtactatattgttttgagatgcatttgatttgtttagtgttggaaatgaaactaaaaaacaaacctggatttgtagatatatactcccagctgttagatctctgctcaatagataaatatgttagctgacttgttagatctgttctatttcctctgatctctccagcttccaaacaaatacacaatattatagctaatcttataattcagtttatagatgctaaccttagtttggttgttccatgcaggcttcttattcttattcgtatggctgttcttggtctattccttgcatggagaattaagcacaagaatgaggatgcaatgtggctatggggcatgtctgttgtttgcgaactctggtttggcctctcttggctcttggatcagctgccaaagttgtgccctgttaaccgagcaactgaccttgctgtcctgaaagataagtttgagaccccgacgccatcaaatcctaacggaagatctgacctgccggggctcgatatatttgtgtctactgctgatccagaaaaagaacccccattggtcacagcaaatactattctgtccatccttgctgctgattatcctgttgagaagctttcttgctatgtttctgatgatggaggcgctctcctgacatttgaagcaatggctgaagccgctagctttgcaaacatgtgggttcctttctgtcgcaaacatgacattgagcctcgcaacccagagagctactttaatctgaagagggacccatacaagaacaaggtccgttctgattttgtcaaggacagaagaagggtgaagagggagtacgacgagttcaaggtcaggatcaatagcttgcctgattcaatccgtcgccgctccgatgcatatcatgccagggaggaaatcaaggccatgaagcggcaacgagaggctgctctcgatgacgtggtggaggctgttaaaatccctaaagctacctggatggctgatggcacgcattggcctggtacctggattcagccctctgctgagcatgctcggggtgaccatgctggaataattcaggtagacattcttacatcacctttctccttgcttttcatatatggcttttcacattcttacatcacctttctccttgcttttcatatatggcttgcaatcgaaatatattagctagctgcatataaacagtattgcacgtttgcacaaatgattactgttcatttttgttttttcccttgagcagaagcatgtgcatcctttttaccgttttaatatctagcagtatctctatggggcttgcctctatctatcttgtagtagtgaaccaggaaaatgccacctgtttgatcattgccgtattgtgttcaggtaatgctgaaacctcctagtgatgatcccttgtatggaaccagcggtgaagaaggcagacctcttgatttcactgaggttgacatccgtttgccaatgttggtctatgtgtcccgagagaagcgtcctggttatgatcacaacaagaaggctggtgcgatgaatgcgttggtccgctcatctgctgtcatgtcaaatggacctttcatcctcaaccttgattgtgatcactatgtttacaactcacaagctttccgtgaaggcatgtgcttcatgatggatcgtggtggtgaccgtattggctatgtccagttccctcaacggtttgagggcattgatccatcagatcgatatgctaaccacaacactgtcttcttcgatgtcaacatgcgtgcacttgatggtatcatgggaccagtctacgtcggcactggatgtcttttccgtcgcatcgctttgtatggatttgacccaccgcgctccaaggaacatagtggttgctgcagctgttgcttcccccagaggcgcaaggttaaaacttccacagttgcatctgaagagaggcaggctttgagaatggcagattttgatgatgaggaaatgaacatgtcacaatttcccaagaagttcggtaattcaaacttcctcatcaactctatcccaattgctgaattccaagggcgacctcttgctgaccatcctggagtcaaaaatggacgtcctcctggtgctctcaccgtccctcgcgaccttctcgatgcttccacagttgctgaggctatcagtgtcatctcatgctggtatgaagataagactgagtggggtcagcgtgttggatggatctatggttcagtcacagaggatgtggtcactggttacaggatgcacaaccgtggatggaaatcagtttactgtgtcaccaaacgtgatgctttccgtggcactgcaccaatcaaccttactgaccgtcttcatcaggtgctccggtgggctactggttcagtggaaatcttcttctcccgcaacaatgcactacttgcaagccgaaagatgaagtttcttcagaggattgcatacctgaacgttggcatttaccccttcacatcaatcttcctcattgtctactgcttcctgccagccctgtccctcttctcgggacagttcattgtgcggacgctaaatgtgaccttcctgacctatctgctcgttatcactctgacaatgtgcatgcttgcggtgctcgagatcaagtggtcaggcatcagcttggaggaatggtggaggaatgagcagttctggctaatcggaggaactagcgcccaccttgctgctgttcttcagggtcttctcaaggtgattgctggtatcgagatctccttcacgctgacatccaaatctggaggagatgaagcagacgacgagtttgctgatctctacatcgtcaagtggacatcactcatgatcccaccgatcgtcatcatgatggttaacctgatcgccatcgctgtcgggttcagcaggacaatatacagtgaaatccctcagtggagcaagctcctcggcggcgtgttcttcagcttctgggtgctggctcacctttaccccttcgccaaggggctaatgggaaggagaggacgaacaccgaccatcgtcttcgtctggtctggcctccttgccatcaccatctcattgctgtgggttgccatcaatccgccgtcacagaactcgcagataggcggctccttcacattcccctgagcttcctcatgaacatgaaccttttgtatgatgaattataagagtggtcccagtagcagttgtccttgctgttggacaagtaaattctttacctatgtttacttaggtttttcttttttttttgggtcgaagatgatactattatgaatcatgcatgatactagttcttttgttcgtttttgtgccaaaatgagaagaggttctgtttggacctgaacatcaatcaattgcaaaaattcggagactaggaagttcagagttgcactcctgcacttctttggagctcttccattctgcataactgcgctgtctacttgtattgcatttgcctactcttaatccttaactttgcagtagtactatcattcttgatgctttccttttcattacacttggtcgttacgagcaggtaagaatggcttagtatttttcaacacggaaa

SEQ ID NO: 22186 - DNA, 2058 bp, Oryza sativa
aagtgttgcatgacacggtcagagcttgttctgcctgcaaggcaaagaccaattcttgctgtgtttgttcgagtgttgcttttagctagcattgctttcagttgtgacttctgacgtggatatttttggagaatcattattgtctgaaggagtattcgcctctttttctgggtgtgactacttgtaattgactgacgccatactggctgggtcaactataccgtacagcggtgtgagctttcaaaaacacgtcacaactgaaagaaaacgatactgaagaaaagaggaaaaatcatgtcatctactagtacaaagtactcccaactactactactactgatcagcacaacattttatccatcgttgtcgttctactttcactttccaaactggcttttgcagtttctactgccttctctcagcaaaacttgcacaatactaccatagagcaaccaccattgcttttgcagttttgcttcttctcgatgaaaattaccccacgcttgcacctttcagaagaagaaaaactctggtttggttaaaatgctacctaaaacatggatattacagagtaatttcctcaaatatcattcatgtgataagagtagtgtctaccatcaataccaaaagataatttatttcatgaagtgcaatttgtggatggtggaattgaacaaagcatcacttaaaagtatgctactattgaccggcacacaacatttcatccatcgtggttgtactttcactgtccaaactggactacgccaagcagtttctactgccttcccggcaccacttgctagatgcaaccaccattgctttttgcttcttccagataaaaatttacacccttttatatgcacaaaactcaccacgatagacactagtttggttgaaatgcaacagatagtatggacattgcagagtaatttcctcaatatcattcatataagttataacagagaagtgtctaccatcaataccaaaagatgattcatttcatgcactgaaagttgttgatggtggaattgaacacagcatcaggtacaagtatcccgctatctaaatctctaccttgacgaggagccataagcatggaggaacatacatccaaagcaggtgaagcaaatgcatcaccggatcatttcactaggcagaccaccacagacctatgacctccgacaaattctacagtatgaacaatcctatcagctaagatactttctcgaagttaccacatcggctatttctgctgattgtcatgcagcaactcagaaggcaatgatgcagggtcaagctcccagcaatcagtaggaggcagggttgagccttcacccttgggcgctctcctcgccggaatctgatgcgagagtttccccatatctcccttgtgaagggtctggacagcatcgcgaccgacatcctggcgggtaaagatgctcctgaaaccttccaccttctccaggtagccgaagctggcaccataaaggtcactgtacccactgaggaacaccacaaactcatactttggcctccccgaatcggcatcctttccgccatggagcgcccaaaccgagcccttcttggggtaaatccggtacacctccctcgccaccctctcataggcgacctgatgcgagaagatgttcactgaatgcacggtaaccgttctcccgaccttgaactccccacatggcgtcccctcccctccatctggctggagatcaagccaccttatctgtgcacggaatcggccccctggtgtaatcatctccaccagcgcatagtgacgaggcataccgtcatcatcaccgtacaatgcccacacctggcctctcttgaagcacttctcgcagcggtcggcgtcgaagttgtagaagtctgagtcctccacatccatcatctcagagtcgttgttctgctgctgctcctctccctcatcatcgtcatcgtcatcgtcattgtcatcgtcgtcatcctcgtcgagtctggatgagttgttggttgctcttttcttggagagctggagctgcatctcggcgagcgtcatctcacgct

SEQ ID NO: 22187 - DNA, 10318 bp, Oryza sativa
ctactctctctttgtgctaccctttagcactttgtgaattgcgaacgagttggttagcaagttactagtgtatactatactactacataaacatttagatttcgggtgcaacttaacttttcctttttgtcgtaaatggtactcacattgagtatcattcggaccctacccttggatttttgggagcaacttaacgaactcacagcgcgttgtcgcaaatggtactcggatttgagtagagacttcccaaaatgctgttgaaacagaggcccacgagaagaccatttgaactggagagcttacggttaatctgaatcacaaggacgaattggcatactgcacaacatctcagtcaccaccaatacagcagaggttcggtgacttcggtcccgtgcagcaaggattcccccgataagggctccttcgaaaagcagaaatttttacatgatttacacagcaaacaattcaattccttcaaaattcccgcgaaattcctctaaacccaacaggccttaattaatacgggccatttgcatccctaaaccaagctgcccgggtaaggcaaagctgaacaagaccccagttgagtgtgtagtttgtttggtcaaatcacagccttaagaatgcataactgaagtaagcagcggctgcttgatagccctgcagagtaacggaagtggttttacatatggggaaaacactcatgttgtgaaattgaatttttgacgttcaaaaccttgtgcctagttaccggagtccatacgtcgtcctgtttcattttgcacttcttcactgttgctaatttgcaggaagaccagcagcttctgcaattcttccattgttggctagttcagaagactacttcaaaagtaaacattgcactcagaacagtaaatgatgtgcgtcttaccaggagggaaaatgttctcgttgtataatcatagcaggatggatatgatgctgactagctgagctctcggtacagcaatgcgaagcaaactatctgccctccaattattcggcttgaagctatgagctgattgtgagacagtgtagttgatcatctctgcatccaacaaagatgcgtccaccaaccatcaagggcgatgagaagatgtccccaggaagatctattgcagcaaatccttgcaccaagtcattacaaatacttccattaactttctcttccttagcatcagctctaatcctaatgacatggacctgtcccgaactcgtgcagatacaagcgaatctatatataagaaaaggtgtggtcattttcttgatacatgatcactgcgtaactatgttatcaatatatgaaatacctttcagatgctccaggtgaggttgctgttaacacttcatcgacaaaagcagatgcggtaatagggtctccaacttcatatttccaaagaagagcaccagatgtctgtaagaaaaaaaaatcactccactacctgtattctacactactttaaaaggtagtagtggtggcggaagtgaatctgccaccaccacctatatcgctgacatatggggcctcctcctcggtgaaacatacgtgctcactaaattcaaacggcccccacaagaagcatgtctaagcaaaatgatgttaatatttgtttggtaagacctgataagtatgtagggaagtaatccgtatagttaaaaggaattggaaagggccagtttgcagattcttcaaagaatgagtgtgcacaacatgacttattttttgctgttgcagtgcacatgcaatttgctagtctttgctaaaagatgggaatcagaattgtaataaattgctaggtaccaatcaattgtgaagatacccttttgtttttctggttatttagaaacacattatgacacagttcaacgattgaagagttctgttttaattaacagataatccctttctaaaattagtttcattgaccacccttacgttgaggactccctgaaatggctaaattagcatcaggaaacaagtacaggagcatggcagtgagaggtgtccaatgatcagtaattgtaattcgggtgtgttgtgtttgaaaacacgagcaccaaatatattttgaaactgttgtttaaatacagagttattgtatggtgcagcattcatgcaataccatgcataattcattactctatgctaaagttctgctcacataagaggttcaaaattcaggagatcaaaacttacagtatcaaaagagtataatcttccgtcacgggaaggtatcaacacctgcaaatgacatatatgtaaaagattttcactacacttcacatggaactccataagctacagatgtaacttttgatcattagtcaatgaaaagacacataaattgataccatacctgagtaggaaggccagatgacaaacatgcaccagcaaaaataggaccaccaacagatgcctgtggttttaaaaattagttactacattgttgaaagcaacatcaatgtgtttagaaagcaccagggcacaccacaataaaactggatttactttggtaatctaagcttgattttttttataagcctaaccaaccaaactatcatctggcattacaccaattcctgctcacatggcactagacccaagcccaaccccatttgcctaacatgggagccattttctaacccatttatccaacccaccacttgctggcaccagcagaattaatagtggcatactgccatagctatcataagaggtactcagtttatatgtgctctaatgacacctgcttataagtttgaccaaatacgaataatgaatttccactagtattttacagatgatcaacaactacatccatgatgtgtcattcaattgcaaaactgtactgtataaagctgttgcaccttccaaacgacagagccatgtgagttcaatgcaatcaccagaccattcaccaggcagcagataactgtaaattgcaactacaatcatcagcaaaaactgcatgccataaaagtatatatttgatcgaatcataaaagtatgtttgatccgtgtacacacatatactaccaaactatacatatgatatagttttcactgatcctgtggtacgctgtacatattgcatttctttaaatctttttttgtgaggaaatataataaaaacacaagtaagtgcatattgaaggatatcaatgcacattgcaacatgtttgaggactaccttttccaccatgatgatgtatagcaagagaaccgaaaattggtgccccggcttcatattgccaaattatcttaaatgacgatacctgttaccacaaagaaaccacaaaccagtgaatacttcaaacattaagctgctaatgatgttttcgttgatatcaccaagttcacaaagacatctcccatggaacccaaagaaggaaagaaataccgatgagaaggaaaaggctgtattttttccctaaattaaagttatcacactaaaactcacctcaagtgatattgcagtcacaaggccactcgtagatgcaacatatatcatgttgtgtgtctgcaaggagcaatatagatgacaaagtatttgtggatagcctagatgaaataaataaccatactgtgaggaagaataccatgtctatagcaggagaaccataaatgcttccaccacaagaaattttgtaagtgcagcaacgatctttgtaatttaacgcatataaatggtggtcataagagccacacctgcagattataaaccacatagaattaataaaaaactacaagctgaatctcatcttttgtgtaagggtatgcatctgtatgatcgaataggacataggatgagagactattggtattggttcctctcatcatcctgtaaagttagtcgagacaccaccaattggatgtatggtaagaggtcaaagacaaacatatgtattgccatgacaaaacactagactaagactagaatgccataagcccccttacatgactaccacattctagttgaaagtagagaggctattattggaacaaacatgctttgatcagaccagagaaaaagtataaagtgcaaaggataacgagtactaatgtactatggatgaaacagtaaaatggtaccatattaagttccttatcatgtccacagccggttgcatttttacctgcaagaagatagatacctcaatctgagattgtgagacatgaacagtgacaacattctgtgaggtgatagtgaccaggagaataatagcatattgtttttcgaaagttcagcatcaaagccatactgaacttgttggaacaaaatccaacagaactaataactagtcatggcataacttcgagactgctttgcctacttccatccccaacttgcatggctagatatgcgtagacatgtgtgtcactcttctaatgcatttactattttacttgcattcgttgtaacacccaatagcatgttgctagttaatagtaggaaaaaactgaaataaactcaataaaaaggactcataagcctcaatatagcaagacattaagacttattaggcagtacaaacccttgatttcacgaaaaataaagtactgtccgtaataaatcaattaaatgaaggcacctttttggatgctctttctttaagaagagatagacacctgccactatatatctttccagctgatgcttaatgggaggaacttctacaatctacataaatgtccccttatcttattatttaccattagcaattagggagttacagtatagccacttcaataatatgaaaatataacagggattatagccgaaaccctaaatttactaggagtatatctataatttataataatcagttcagcgtcatttcggtattattctgaaatgaaagtacaacttctatgtcactataaggcttaaaagatgtcttgaatgagaaaattgcagcagctgtacctctccatcagtctgaatggtccaagcttgttttccagttaacagatcaaggaagtagattttccctttataacatccaactacaacctgcccaaaagatgtactaccatgaactggctgcaagaatgctaagtgaattcgtgctggtgtttattgttgagttacctctgaaaagtcacctgttatagcagcagaacactctacacgtccttccaatttgacactccacctcacagaaccacttcatattatgttgggagcaagttcaaacaacagttagtatgcaaaggtcagaacctaaatacttcattgaatcaaattaaaatgaaacaaatcaataataaattactttatattaaatacacaacatgccatttcataagaacattagagcgtatgtggcacattagattgttctagattcaacttcaaagtaaatcaggaaaagcaaaagaaacaatgactagttaagataaaaaaaaaactccttgcaacaaggaaaactcacctacagccatcaatgcagagaaatctgtgtgaatgggacccgataaatatactcagcatgccattgttggagacaagcaaaggtgacgcgtcaacacatgaaccgagaggaatgttccaaagggcctgaagataacctcttttgttgtagggaacatatgagcaaacatcttcaatttgcagcttatcttcgtatccatgcataaatctattgcaacgtccaatagaccatttctttactaaacaaaaattcaagatccatggactgacatcgacactgtttctgtcatttgagcatgtatccaacaagagggattttgtctggtatctatcattagataaaggcacatttctgttaagctggccatctacttcatttgcataattccctgaaatggcatcatgtgcacactctccatctccatttatatgtgcttttacttcaggaaagttatcatctacacttgtagcgatcggattaaatgagctatgtatgctggaagatatgtccaatcccttcttagggtgaggctcatgactagaagaaagtaaacaaccgtgctttgtaaataaagcatccaagagcttagaaggggtggaatatatataaagcatcctcatgtcaatctccagcttgtgggctacgtgcgcagcagaaattgaattaccacccaaggtgaagaaatcatcaaactcggaaacttcatcaacaagtaaggcatcagaaaatgcctacagtagataagagatgacatcagtaaaaaatgatcattataataatgaatactcaaagaatacaatagctccaaagagaaacaaacagaaacaaaattaacagtagagtagacggtaaaaacaagagagtgcttgaacagacctttttgataacttgcaaatgtggattaactgtaattctttcagtttcagtttcacaggactccaaggcacacttcaagcttgatagcttcatataatcaatctttcctgaagaagtcagaggtaatgattccatgggaaggaaaaaccttggaatcatggctggtggaagcttcattatgagccaacttcgaattgatggcatgataacttcaaaagatttgtatcttttacgccgctgacagtcttccacagatgcggcgctactcttaagcaccaggtatgccctaaaatccagaaattcattattttgaaaagtaacagcagcagcactgacatctggatgttcatttaaggtagattccacttcctgcagtgaaaaacgctgcccataaatttttacagtacggtcctttctcccaaggaaaataaattcaccactctttaagcgtcgagcaaagtcaccggttctgtagtatgttgaacttccattgtcttcagtgtgattactcgccatggactcttctaaatatccagcaaataaacatgctccagtgacatgcatttctccttcatctgctacctcggcgtcggttgcaatacaaacttcacaatttgaaataggaaatccaattggtacactagttaattcttctcgctttaaaagtataggcagatctgtgcaatcaaaaaatgtacagtcaccagaaacctgaatcacaagcgcaacattttattagctaaagaagaaatatcaccactgccatttcagctccttgcatgaggagaacaggaccaatatagcataaatgaaacatgctagtttcaagatcacagttcgatggccttcatataccaagtaatgataagtacgctatattgctacacgagttacctaacaccgtaacacgtgtttcagaatggaacactaactgtaccttttcaattttcatatcataattcaagaccaatttaaattatcatgaagcaaatatcaagtttgattcatgctgaataaaaaggtgtaagagaatttaactactcaacccttatggcacatgtgctcttcatcataactcccttaaagttttagtataacaggaatcagtaaaatgatggttaggaaatgatgtgcaaccaaaccatgaattaccactcatggtcacaagcttaatattgcaagaatattttactgtaatttatgctaacaatagtaaagatgacacaagtcatgctctcaattctgtgtacatggaaaagatgtggtacaaatcagttttcaccaatatttattttaggagaagtcaagccagatggccggccaatgtactgttgattttgatcgccagaagccagtaagataaatggtgtaaaccatatgattataagaatacattattaaaacaaagataacataatatgaaatgcaagtggttaattttctcacctctgtcgttccatacagatttacaatagtagtctctggcagaatttcatgcactctcttccacaacaatatggatagattctcgccactaaatattagcatcttaagcgggttatgtccccatgaaagatttttctccagggaaggtagtattatctccatcaatgatggaaccaaattcatccttgatataccatatgcctaagaaaaaattagaaaaaaaaaatcaggcccaccaagaagaacatggcgtaatagctataatcgtaatatgtattgatttaccatgaaaatcccattatatgagttgctacttttttatcaaagcaattgaatctaaaatagacaagagccagaaactatagtaccaattctgacaacattggtagcatcctaaaattactgttttgcttcggaagaagaataatgtagaactatatctcttagcagtagctctttccaatgatatttgaaagaggacaaaaatgtactaatatacattaaattttacccacttttggacacaattaagcaaatataacttgtattagaaaaaaaaaattcctacctgcgaaaatgtaaggaaaatgaaaaggtaagcctatttatcgcaaattagtgtacaaccgtgccaacatgtgcacagtccactttcatcctagtttgccccattaaattgtaattcaaaatttcaaaatgactgctacaaaaaggactatatttgcaaaattcatcagagatgctgttcccgaacgctactgcaatttatttcaacaagcagaagccttggatataatgttttatggagaagacaaattggacaatgaaagcataactctctctcccctactatttcattaaaaaagaatagcaatatttccaccaaaacaatgattaaactaggtaaccttaatcaagttggccaaggatgctggattagctctccaatcattaggaggaggaatgacaagtgttgtgcaagtcaacacagcagaaaggaactcctgcagatggtctacaaagctgacagatgtcttaaacaataacaggtcatctgaacatagaggtttccatctttgcatccacaaaaagcggttcagaagacctaaggaataatagcaaaataagagatcttaatgagctgtccgcccaatccaaacctagaaagacaatctaacagaccttaaataagaaattacaaagcaaaagataaaaaaacatgagccatttaatgtttcgctggtaacatatatttttgctaccatgtaatttcagatactctatgcctgcagtttggcatagtaaacatttgggcttaggctagcattttggatattgtaaacattggcataagatagccatgacggcagtatactaaactactctttctcaagaagagcatctagagacatgtcaaccaattcctttgccatgtcagaagcaaaatttctaaatgatagcatagaagaaacagtgaaccagaagcaaggtgcagtgacgttacctttctctgttccacaaacacccttgggttttccagtggaaccagatgtgaacatcacgtagcagaactccctcggcttcttgtacttgcacggccaagcaagctcatctcgaccaatcccacccttttcatcctcaaacacttgccataagtcgtcgtccatgtgaataacagagcaagagctgctcgcaaacacatgagctgctcccaaaccccctgatgatacaacgagcaccgcattcgacgacgaggtggcccatcgaatcctctcctctggccacgatgggtccagcggcaggaacgcctccccgcatctgagcacggcgaggacggcggcgatgtactccaccgaaggcgaggcgtaaacccccacaaccctaggcgccgcggcggcttccacggggcgacccgaacagcctagggttccaaattcccccttcgatcagaggacgaaactacgagttaattaaaaaaaacacgaaccaagtcaccgctcactcaccaggcgattcatcacggtggcgggaggtagacgagctgagctccgcggcgatgtggcgggagagggtggagacgccggcgaggaggtcggcgcaagtaaattggcgctcgctgtcggagccggaggaggaggaggaggccgcatggatgacggcgagcccggtagggttccggcgggcggcgcggtcgaatgcgtgggagatgcagcacggttcttcctccttcgccgccgccgcctcggccgacattccgccgctgcaagcgaggtttccctcgccttccaagaccagaagagggaactagctttggttcgaaaggggagagcacgcgtggacgacaaaaccgctttcgctgctgcttctaaaatacgccttcgaacttggcttacgcacttgggcgatatctgaataatgctgtaattttgctttctcttcagctattcctctcgaaattgtatgcaacttttaagttgcaagtttatagtttaaataaatcaagtgcaaaatcttcttttcgaatcagaatgagaatcttctt

SEQ ID NO: 22188 - DNA, 21618 bp, Oryza sativa
  unsure (1)..(21618): unsure at all n locations
nnnnnnnnnnnnnnnnnnnnnnnnnnnnnnnnnnnnnnnnnnnnnnnnnnnnnnntatctatttagttttttttataaaactttggtaaatatataagaaatcctgtcaaaacttggtaatattgtcaaattgtaaaaattttgacaatgccaaaatttggtaatgtttgttttagttataatctgaacagccccttaatatggatccatactccatttgatttcaataagattgtggatggatggacggatcatggatgggttgctttttaatttatgtaaacatcaaaagatgctccccttttgaatggtactactgctagtatgatatagcgttgttgcaatgcatgatccatctatcagaccctagcatcaaggcatggtacttctttttctttttcttttcttttctttttgcactaggatgctcttcttctaccttttcatcatcatacctgatatgctgccctgccctggcctgttgtcaaaacccataccgatgtgtttttctcgcagcaataaaaatatattatgccttttattttatttatttttcacctttatgaacttgcatgcatatcttcatatccttcaaaacggtcctgttaaatattcatgttgatatgtctgaatcattgaccaaacacactcctgaaaagaaatcactagctaataagtatagctattactcctagaaaaccccatcctgttgtaaaaacagcaaaccatgggatatttgatggctttatgccatgtactattctgctgagtgatgtctaagcatttttggctcagattaggaattgtcggcacagctttatttgtacaagaattgacagcaattgatgctaatgtggtaggctcacgagaattcacagccagataaacgtacgagctagttttagccagtcattaggttgctgacaccgaaatgaaaattttgtggcacccactgtccatcatcagatttccaccactccagatatgcaacaacatattccaattttgccgaacaaagtttcaggacaaaaatctctttcggtgctttgctaaatagttaatacactgcttgctgatctcttgttgcatatatttactgttaagacaaattcggtgggcataactaggcatgcattagcttttgtttaatctgctatatatgccatgggaatcaatatcatatagctaggtgaaaacaaagcacccagtgctttccaaattagtatatgtgcgcttcaccctgattgtcgtttagtcaaacgtaatctcccacactcggattgatttggtgtccttttattgcttgtcttatgcactgattatcttaatcgctgttaaaaagatggttacacgtgttgttcatagattaatgccttctgttctgaaagatgcaacaatgtgttgcctttttgtcaagaaagataacacaaatgaggcacaagtagaaagattgttgcaagatcagttcttcagatttgcataggaaaaatgtttgtcatgtctgtaccattgtctgcatcacagcaaaatgacttttgtctcttcattcacttatctcagtatatttcttctgcatatatactagagtactagtttcagtaacaaagaactcatctgttaaaaaaaatcacttctttttgtgtgtgtgtgttcaagttgctctaatttatggcaactgaaacaagagactgatatcactggaacatcagcagcttaattcagaagttataacaaataaagttgtaatagtacattcatagcgaatgaagtgatggaatgaaacagaaatgctattaatcacaatcaaatcggaactaaaaatatgcaaacttatggtgatttggaagcatgggaatgcaaagaatggcaggtttgctctaatttctgacaactgaaacaagagttgacactgaaaacaagatcactgatcgttgtgatcacaaagtagtactccctccgtttcaaaatatttgacactgttgactttttagcatatgtttgaccgttcgtcttattcaaaaacttttgtgagatatgtaaaattatatgtccacataaaaatatatttaacaatgaatcaaatgataggaaaagaattaataattacttaaattttttaaataagacgaacggtcaaacatgtgtaaaaagtcaacgacgtcaaatatttcgaaacggagggagtagcaaatattgtagcacattgatagtaatcaaaagagaaacaaaaagaagaatgggaatttgatggtaagcatggaagaatggcacaggtttgggcggacaggggtgtacaggacgttcatgttcagcagcccgacgatcctggcggtgacgccggaggcgtgcaagcaggtgctcatggacgacgagggcttcgtcaccggctgtgccaagggcaccgtcaccctcatcgggcccaaatccttcgtcaacatgtcctacgacgaccaccgccgcatccgcaagctcaccgccggccccatcaacggcttcgacgccctcaccacctacctctccttcatcgaccagaccgtcgtcgcctccctccgccgctggtcctcgccggagtccggccaggtcgagttcctcaccgagctcaggcgcatgaccttcaagatcatcgtccagatcttcatgagcggcgccgacgacgccaccatggaggccctggagcggagctacaccgacctcaactacggcatgcgcgccatggccatcaacctccccggcttcgcctactaccgcgcgctcagggctcgccggaagctcgtgtccgtgctgcagggtgtgctcgacggccggagggccgccgccgccaagggcttcaaacgctccggggccatggacatgatggaccgcctcatcgaggccgaggacgaacgcggccgccgcctcgccgacgacgagatcgtcgacgtcctcatcatgtacctcaacgccggccacgagtcctccggccacatcaccatgtgggccaccgtcttcctccaggagaaccccgacatcttcgcaagagcaaaggtcactcctcactctgcttctttttttttcctggcactccaaatttggtttcaatcatctgaacttttgcattatttgaaattttgcatgatttgattttgagttcaggctgagcaagaggagatcatgagaagcattccagcaacgcagaacggattaaccctcagggacttcaagaagatgcacttcctctcacaggtataatataataatatatatagggaaactctattcatttcttaaagcgatatctccttgtttttttatgaaatttaaaaagtcattaacttttttaaaaaaattagtatgatatatcaacatatgatatgttacttcataaacatacatattcaaattcaacttatacaagtagaaacaaaaataacaaatttgatggatagaacgcgtaattcattgtcaaatttgttatttttgtttcgaattgtatatgtcgaattttaacttgcatgtttgtaaaaagatatatcatatattcatctaccttgacaaagttttttaaattttttgataacttttttgaacgccatgcacaaaacgagaggatgtccactcgagggacaaaaatccacttccatatatgcaaatgatttttaacacagtggaatatactactgctccagccgaattaccacagtaattactgcataactaatttgcacgctaatgatgatgaaatctgaaggttgtcgacgagacacttcgctgcgtcaacatctccttcgtgtccttccgtcaggccacaagagacatctttgtgaacggtgcgttttcacatagctgaaaatccatcccttaaagacatatcagaatcatcatcatctgaattctgattgatgttgtttttctctagtgaaccacatcgactgattactactagtgcttgaaatgaaatgaaaatgaatgaatgaatgttatactaaccaagaagaacccagcaggttatcttatccccaaggggtggaaggttcagctgtggtacagaagtgtgcacatggatgaccaagtttatcctgaccccaaaatgttcaacccttcaagatgggaggtaaattaaattcaatccattcttctgcagtttttgtttcttcatcaaactagattaagctccatcgattctctgcctttttcagtgtgtttcaatggtcgatgtaattttttttgttctttcagggaccccctccgaaagccggaacattccttccatttggactgggagcaagactgtgccctggaaatgatcttgcaaagctggagatctctgtcttcctccatcattttctcctgggttacaagtaaacctcctctcaacatatttatgacaaaaaaaactactgttaactgaacatgattaattgtgaacagataaaagactaactgctgcacctctcttcttcttttcagtctttatttcttctactcttttcatttcattatcagtttacttgtagcttccaggatcaaaactgaaagttatgcctttcagaataccaactccaaaaaggataaaattgctttgttcaaagttcaaaactgaaagttgtctgctgtgtgcaggctgaagagggcaaatccaaagtgcagggtgagatatctgcctcatccccggcctgtggacaactgcttggcgacgatcaccaaagtttccgatgaacactaaaagttcagggattctttagctggaaccgaaaacagccaggctaggctacttgttcctctgggacaagtaaataaacatgattataaagtatatcacgtactctggaagaaaaaaaagagagagaagtgatgtgtattcgtcttgatatgctcgctttggtttcgcattgttcttgtttgtcctagcttaggacaaagattaaagtaaagcagttcgagttatactaacaagcttcctgaatatgggaaacacgcaagcattccccttcttttctatctatccacctcactgaatttggattgttctttatcagttaataaagatggcacgaaaagttgcagtttaagctggtttttgtcttctttttattcttttttcaaaaatattgcttctttttctgtgagggcaatttagtccccaagctacatacctatctgcagaagtttagtcatatttttttttatcccgaataatttcaaccacagctatttattgttcaaccctactaataatacttgccccaaatgatccggcaatgcagctggatgaacacaagcgtcgatgataaatatggttcatatggatttagccgtccttcagttaaacctgatgttgagggttttaaagaagccactgagcaacttgcaacagagaagatttttcgaggttctgatcgagggcagaattggtggactgcatttttcaagattgaatcaacgatacataataaatctttgtatgtctctcataaaattgaccaaagatagttttgctacaaatataaaactaatgtatttaaggttctcaatatcttttttatacaaatacttaaattaggttgttgagtcaaaaggaaaaaaaagtctaatataaggttgttgctatgaaggtttacttgaaatatttgttctaaatcattcaacgtataataacattttgggtgccgagaggggggtgggaagtgaccgcaataacaaatatagtgcttacccaaggtttagcccctcacaaaaagtgaaagttttgttttttcgaaacatacatagaggcacaagtaaccgataattaatgagttcacgtgcatcaacaatgctctacgcaaacatgtgttaagacttaacaggtggaagtaaccgacaataatgaattcaacatgtctcgacagtgcgttacgcggaacgtgtgttaagggtgtgtgtagtatatgcacgtgatgtacgtacgtcttctacatgatcgcaacaaaaaaaagaaggaaaaatagattctcctattccttctatacaaggaaatactttaggaaagcccccattttccgacaaacggttatgatgggtcaaactcagccttatcatatagcaaatttctcacaaaaaaaattgtacattcaataccctactactatttatctgctgttctagacacaaaacaaaagcttatttcaaatggcacaaatcaatatatttttttgttcaagatcacagcctaccagtaggtaaattcagtttcacaagaaaagggtaagagaaattggagaatgaccaaaatacccccttcccctccatctatttctgtgtttgtgctcctctactgtctccatctcccttctcttctgcttccgatctgcagcgccttccgcctcgccggcgagcaagccggcgccgtcgacggcctcctctccctcccggacccgccctctgccctcctcccctgcgcgacctcctcgctcgctcgcccgcccgcccgacctccgtctccggttcgcgtccaattttgaggtatccactcaattcttctccccttggattgagcccgcgtggcatggattggggatccattccggactagggtttggtttctttgcctagagctgacccatccagcgtcttcctgatctctttcgggcgtcgtgctgtgcttgtagcagttcatagcagctttgttaggtctgcccccttaccgtaggcgctttaggtactagtttatcgatgaaattgggttgataacagtgatgatgcaatcctgctgttgttgttgatgagagcaggagtgaaatggatggggttgtcgccgcttcggctgatgccaccagggacgagattaagattatgaatgtgtacatatgggacatggatgaaaccctcattctgctcaagtcgctgctggatggctcgtatgctggtgcctttgatggcctcaaggaccatgataagagtgttgatatagggaagaggtgggagaatctcattctggaactctgtgacgagcatttcttctatgaggaggtcagctccactccactactatctgctggctacttgccatgttactatatatttgtaggcacattcttgggtagatgtgattgatttcctttttagtaatagaaacaagttgaaattcccgcgcaaagttgcgcgggtctacttgaaatagaatcgtatctgttaaatgtttgtagccattaatctaggccgttataatttggtcccaccatgatggatggtggagatctttctcttttccgccggccaacgtggtgctttatatgcctttagagcaaacgtggtagctccttttagtgagctctcaataatataacggatagatagatacgacaactgtaccagaaatagatagaacgtatgataaagtgtttctacaaattggactgtccatgccagtatcttctttttgtcactgtacttgtcgtgtagttatctttttggaatccatttgtacgtgaaatcttgcttcatataattcatctagctgggctctgcacttaagtgtctgatgtttcatttaatgcatgggtaaaccactcttttttatgtcatatttgttaactgatcatttttgttctcacacaaaatgcagattgagaattacaatgaaccctttctcagtgctgtcaaagaatatgatgatgggaaagacttgacaacatatgattttgaagctgactgctttagttcgccttatgatgatctgaataaaaggaagcttgcttacaggcaccgtgctattggagagaagtatacaaaggtatcacaggaattaccttctcttacatccaccccatattgctttctctaggccttttttcaggggctaggatggtgagggatcctggccatccacctgattagaataactttcattcacttccatattggcccatccaaacaggccctaaggttcatgccctctgtcaggcatattttgaatgtaccttttaagaatgaaccttctaaatatggatgtggtgcagtgctcaggtcacttctctagcgaaactgtgatgcttcattccatttagtaagaatattgttactgttcaagatttgataccatggagtgtctgtgtctggtatggatcagcacacttttctggtgtttgatcaatcattgttagttgctataatgcttggactttatattaagaaatagaatagattctttatgacgtctaggaataaatcgtagcagggtgctaactgaagtatgttgcttttatcttcttcttttttttgcgggatgttccattgtgagctttacgctgagcactggtctgtacttgtaatagagttgccacacacagcaagaaagaggtttgttcttgggaagtatgtaggttaatttgtatcaaggcgacaggggtggggagttatgtggggattatagtggatattcagttctttgaaatgacttgtcctcctcagtgattctctgggacttcatgttttggttcaggctattttgttcagaggttttgatcttagcgaaactttatttaggaacaataataagaaatagggccttagaagtcataagtgctgtgctgggactttatatagagcatcatcattagatattcacttttcagctatctattttgtagagctcttctgttttcatttcgttgttattatttagaactttttcatgccagtactaatttctaatattttgtcaatttcatgtttgtaatgagtaattgaacttctttggtgtttcttctcagggtttggaaaaaattctggaccaccacatgatcaaagtctggaatgatctgtatagcgcgaccgacaaatacaccgatggttggctttcttcaggtattctaactcgtacttattttcctttaatatttagaaaaaaaggactagttatctgatttttgttggcagaaaaaaatactttggccttcagttctgttgatgaactaagtatgacaacaaagttgtaagggttttacaaccacaaagaatcttctagagccttatgttgcataattgatggtactccaaattgtcaatgccgaaagaacatgcttctgatatttctactttcaaccagtgggattaaatttgggctggcatttttgtttatggactatataattgttatcaccaaagctataagagtttacaactaagaggacctgcaacaacttaacaatgcatgtaccaaaataatgtcccttctgcttgatacaatgtttcaaaaagcgatatgtggttttgtgtggttttgtagcacttatgtggcataatcagatgcttatgtggtataatcgggtgcttatgcggcttaagctgtacaaggttggggcatccgttccttgtatgcggccttgtacgtggccttgtagacctttttttcaaaacactggcttgatgtatgcttttaatcactgtaggttgccacctcagaatacatgttcactgaaagaaaagtcaggagtttttaagtttttctctgtgtactatgcgttagaacttttgagaacaagattatattgtcttaactgttctttctttagccaaattcaacaatcagttttgttgcttcagtgctcaattgccttttctcttgttatgcagctcataagttgttggaagaagcaatgggtaaatcaacagctgagtccactgccaaacattcaagcatcaattgcatagttacatcagggtccctgattccaagtcttgccaaatgtttgctctatcgtctggatgatgtggttgcattcgagaatggtatgtctaaaagttcctttgagcattttgtttctgttgcgtgtttatggaaaatatgcaatgggataattggccgtgctgatagttcttgaatgattgatggcctttgtataccatgtccagaaaatcccgtagcagttggctactgttgtcatactaggaagtagatgaattctacacataaacaaatgtagattaatttacttaaaatctgcttctgctttgcagtttacagctcctgggaagtcgggaaactgcagtgcttcaaatggatcaaggagcgctatgatggcccaaacgtccgtttctgtgcaatcggagacggacacgaagaatgcaccgctgcgcagataatgaagtggccatttgtcaagatcgagttccaccctgatgcccctcataggttccctggcctgaaccttccaaccattcatcgcatcatggataccgtttatgattcatcgagcaacgatggttaaccaacatcctgttggtcctcctgtttacctcagtcctccgatgccggcatttgccaattgccgtggagaccttgttaaaggaaattgtaagcagagagatgcgatgggaaggcatattgctgaccctctgcctggagaattaggaggctggtgtgtgataaataaagcgtccgactagttccggcatgtgtttctagaaagattctgtgctgttcgtgttgccattttactctgaccaggcaaatcgttcgtctgttggttgttgtatgtatcccggccattgtggtcgccggcggtgtgcattggcatttcaggtgattttgtacatatgcttcttcttccttagagttggttgatgatgattctcgtctgaacaatgaataggaagtgtagcaagatccttgcgatgcatggggggtgctagcttatgattcttgttgggtacatttcatatgtagaaaatttcacaaattcaataggaacattgtgatatactagtgaagagccttttcactggttgagtaaatttttaacctactgatatatgtatatgaaacatactactagtttttatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtacccttccacaactgtataatctagattaaattttacaaaaactacatgtattttacattatttataacaaaactataaatttaaaagcttgtttttttcgctgggatggtgaagaatgccgcccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcgaggatgcaggcggtgaaggagaaggtgaaggacaaggtgagcgcggtgaaggcgaaggggaaggtgagcaaggccaaggccgacgagaagaaggaggtggcgacggcgaggtcccacgccgagagggagctggcgcacgagcgcgctaaggccagggtcgccgccgccaagatggagctgcaccaggacaaggccctccaccgcgaggaggccatccagcacaggctccataagcatggcgccggaaccaccgccggcgttcgtccgaccgccgcggcgccggcgccgcacctcccacctgctagctactactagtagctagtatgcacgcatgtctctctgtgctgctaattatcgtaacagtttccactaatcaatctacttacaataaataataagccagccagtgtgcatgtaatctgtactgtgtgccagacaagatatcagtgatatatctatcgaggttgttaattagtcggattgtgatctctttagagtactggaggaagttttataatggatattgttgttacgtctaattttagagtaaattttataaaactaccgatactttcatcaaattatcgatcacagcgattcaacgctaagtttcttaaatttctgactaaacgtattatatacgttactggtggaaaaatcatctttggtcggtcggccaaattacacaatagtccattttctaataaaaaccgggactaaaaagcatctttagtcccggttaaaaagttgagaggtattttttgatctttagtcctaaaaagcatctttagtcccggttaaaaagttgagaggtattttttgatctttagtcctggttggtaatatcaattggtcgggcgggactaaaaagcatctttagtcccggttaaaaagttgagaggtattttttgatctttagtcctggttggtaatatcaattggtcgggcggggtcgggcgggcgcggcggaggccggaaggacggggccgggaggccggtggcgccctaccctctacaatcttatgctggattttttttgaatttataattcattggatttgatctgtgatgtatgtgatattggatctgatctatgatgtatttgagttgtgatgtatttcttttaggatttgtgatgtattttttgtttgagattttgtgatgtgatgtattcgttatctgtgatgcatttcttagcaatttgtgatgctactttgatttgtggatgatttggggatatgattgggaatatttaggaagcagatcaatttgagaaaaaaaaagatcaaccgggactgctcccaccatctttagttccggttagtaacaccaaccgggactaaagatgaatttttagtcccggttatttcacccgggaataaagatgagactataagaggtttccaaccgggagtaaagcctctttctccaccagtgtgtgcaagttttatgattaaattatcactaaactttagttttttgagttctataactaaattgtcactaaatttatatttttgtgaaaactttgctattaaatctgtaatgccaccctaaatataaagttttgggatatagatttaatgttaaaactatagttttataatactacttcacattaaatatataaaatatatagttttgtgataataccatagttttagcctcctgaagcttaaggattgcactgcgagtgtatcgacgcaacgacggccagggcagatcagattgtagcctgggtactatgggaatgggaggctggctagagccataggagttttttataactaccaacactatatgtgtcattattcattgaatagagtggaaaagaattacaaggctaacacactgaaaagcagtagtcaggaaagaaaaaaaatcgatcaccacgcacggacaaacacctaaataaaacccaagagaaggctagtaccggaccggacgcatgtaagcgtgatcggccgcctctagactaacaaagatccgaactgcccaaaaacaaaccttatcagccgagcactatactcaattatatccagtattggagggggagagggtgagagaaaaatggaacaccccacacatgccccccccctaacatggccagcttgcattagctagggcgttgtcacgagaggacagacatataaaaagagcacacacaagctatttggaagaattttggcaaggtggcctcctagacgacgtttgtagggagaaaatcgatgatgagcatcgatgccgccgtccatcaaggtcctgaagacagggtttcacttggcaaccctactagagaaagaaggatggctcgacatagcctccaagaagaaaaatgatacccgaaacgtcgttacttgtcgcctgctccttgtcgatccatagctaaatgctccattgctccactaccagccaacctccgtcagtgcatgaacaccattttaccaacgccccatgccagccagcctccacgtggaacatggcacacatgccgtcaccagcctcccctacatgttgacagaaaacacgaggcctgggagatctgcttaactccagtgcaggtccaaaactcgccttcgggtatgctagcgtgccggttgatttgatcctacaatcaacaagaaataactacgtccactgtgttggcttccctgtcattactacgtcggcctcacacgccgtcactcgggccagcctccatgccattgcccgtactgacctctcgctccatcacccactcgtagcaccagcctcccatggtcccatctccaccaaccacgccggtctccgcaaacgccagctacgcctcctcgtgtcgcgctagcctaccgccgccagccgcaggcctccacgctaagccagccttccgccaggagcatgagaggacgccttctgctcccagccgacaccgccagcttccttctatccccgccgccacctccaccacctttctctcgacgtcggcgaccggacatagcccgcttacccggttggcttcgcaatcacctctctgcatggtcgtgcccacaatcgaagccacgccgtcttcacatagctgcaccccgctgcctcattgtcgctgtcagctcgggtgcgcgcaggggatgagtcggtcgcccgcgccgaaaaggctagatcctaacaaaaggaggctggatctcgcagtggacaccggattcaacgacaccaccttgtcatcgtcgcctcggtcgatgctgcctcatcagaccttgccgccagcagccagcccctcgaggcaccggctccggcctagcactgtcacggctatcggtgccttgatcattgtcatcccatatctagtactccgaccccgtgacctcagggaaaaagaaagccctgccgtcattgtccttgtggccacacggttttcgacgacccgctcggacggcggtgaggccaatgatttctattggattgatctaagtaatatatatgtcttacaataacttgtgtgcaaggtaggtgaattgggattcgtacgtacataccacgtacatccccgtttggtacacgtctttacagtagcgatcgaagtccaaaagggagaccgactatccgtccatgtccgcaaagatgttgtgtgtctatatacaagtgctctgccgcgtgcctgccgtataatattcgtggcgatcgacgaggtacgtacgacgatggcgaggaggaaaggcaaggacctaatcagccagctgcccgacgacatcctgctgcacatcctgtcgatggtccgctacaaggaagccgtgcgaaccgccgcggtgtcgcggcggtggaagcacctccacaccaagctccccgccttgtcgttcatcatgtcggtgctcggggcccaggggtcgtccttgtccacgcagagcaggcagcgcgtcgacagcatggcgcgcacgcttcgccggcgctgcgcggggccagaccgcgacaccgtgaagcggctctgtctggcctaccgcaaggacgtgcccatggagtgccggtacgccgacgagttcatcgcgctcgccgccgcctcctcgctggggctgttcctcaactgcccaaagaacctacgcaacgacgacgccgggccgtggtccctgcatctgccggctgccaccgcctgcttgtccatggaatcgtgctggtactcggtgaggccgccccacgaccatggccccggcgccagcgcgctcaagtcgctcaccttcaaggacagcttcatggtgctccacccaggctatctccagaacaccgccttcccgtcgctggagnagctgcacatctcaggctgcaccctctccggcagcatcgagatcacgtccgccaccatgccgcgcctcaagcacctccgcatccacgacgtcagcgtcgtgtcgctcggcacgccgcccgccatcgccgtccctcagccgacgagctgaccacgctgcgcgtgtcctgccacgacgccggcaagcccgacccgccgtccagccacgagatgctctgcgtgaagacgctcttccgcgccagcttcaccgagtactcgtacttccgcctgcgcgcgcccaagctgcgggtcttcgactggcgctgctgctacgccaagaaggtgcgcgtcgacgccgtcggccgccacctctccgacgtcgtcatcgagctgttcgccggcaggctgcctcgctgctacaacgaggccaagaggttcctgcaaatggaggattgcgacaagttgatgaacgacatcctgcaagggatcatgcctggccgctggaagtacgtccaaaggtacatatatactgatcgataattaatctcatattcatatatataatccttcttgcttgtgttttttttatatatcatatcttgcatgccacacgcacatattcacggaatctcttaatattaaattcttaataaatgcctcatagagaaagttcaaccataaatacgtgaattcaaaattatattatagtgtgtatatatcaatcgattttgctatatatttgtcgataaattttctcctaaaatttgacatatgtaattacagtacaattgtagtgtaattacactgtaactatagtgtaacttgtatgtaactttcaaaaatctcttcgtaatatgttatttcggtacaatagaggttgtggaaacaaatccttacacatgtatgtgctgtgattttatttttcttcctcaccaaaacaaatcttgtaatagatctaaagattcaaaattacatcaaacttatatacaagttacactgtagttacatgcaaacttatatacaagttacactgtagttacatgcaagttacagtgtaattacatataagttacagtgtaattacactacgattgtactataactacatctgtcaaatttttagtacaaaatttgtcgacaaatgtataggtggtccccatatcaataggctatctagcgataaccaatcacgcagtacgtggataggctacgtcggtacggggtggtggattggtggtatttttgtttttttcctggctataacctcctagggttttactcccttcatattttaatgtatgacaccgttgacttttcaatcaccgtttgaccattcgttttattcaaaatttctgtgcaaatataaaaatatttatgtcatgcttaaagaacatttgatgacgaataaacttataataaagtaaatgataattacataaattttttttgaataagacgaatggtcaaacgttagataaaaagtcaacaacgtcatacattaaaatatagaggtagtatatcttttttaatctttccatgctatatattcaattaaactttgcactttccaagggccgattcgtaaaataaaagctatctagcaaacttttcgcatgcaaattcctttttgacaatgtgtcttttttaaaaaaagtctatacatgtctaaagcttatataataaaagtttatatatgtcacttcggatttaaatatttttatacagaaagacatatgtaaatgagctaggctaaactcatctgcatgcgcagaccgctcacctattagagcatctccaaatatctatttagccagtttgccaactaaacggtgtcaattttgttttcctgtcggtctctaaatacttcttcttcctccctccaatcttctcctctccaccgttggttgtccacgagtaatacaacgttattctctccgcgtccccgctttctgtgcccaaactacaggtgcagccgactgttccaccgtggcccaagccgtcgtcgccgcccaaatcgccacaaccgccgcagcctaccatataggagggcgagaaacaaggtgagatggggggagcaggatgacagggaggaggaggaggtggggcaatggcaccctaggatggatatgctgacgacgatggcagcgtcagcagggccaggtggcgactgcactgctgcatcggatggggtggtgatggcggcgactgctcgaggtgatgggattcacggaggcattgctattcacttgtgggcatgatggcagcaacgatattgccgccatgcgctatgttattcgacaacgctggaggactccttcactggcaatgataacaggggatgcaagggaggtcggtggcggtgatggcaatgacatctccactcaattccggcaatggggatgggggatgatgctggagatggtggtggtgaagctgggatgaggtggcgcaggagtgcaggaggagactctagcttgccatcctcccacctcattgtcctgtgttcgagtcgacaaccagggtgatgatgggaccttcttcctcgagctggggaagacggtggcaactccgataggcttggatccggagtgatggaggaccttggcatcggtgcggcgaggtggtggcggtaaggtagctcttgtcgttggccctactcagggcagtgttacttgatgttggtgtttggccatccctcctgcatatttggccagtgagaggcttagccattcaaatggcggagagtctattgcagtctattttcttgtcatgtttgctattttttttatagagtgggatgaccaacctgttagagttgctgttagacctccgtgtattatatccgttcatacataaattttccactcattgattaaacgtttttgttggcctttttgcaggaatttcatagaacgtgatgaattgcgcctgcgctgcgagataaccgaagatgacatgtgatcagacgatcagtgatcttaatcagcgctctcttatatgcttgtagaatcgaggttaaatcagttgcatgcatgtaattagcaccatcttaattacaagagaaaatgacaccgttgtcccctaccgtacctccatgcaaaaagaaagtataaaaaaaagagtaatccatccttgtgccgtacggcatgaccaacaccgttaagcaagcgttaacttgggacatatttgaccctaagcacgaagcctgcgcaaatcaagatgggccggggattcaggacgggccggagcgacgtctcggttagaggaaaaagtacatcaatggtccctcaacttgtcatcgagttacaaaatcatcccctaaccgcaaaaccagatatataatatcctcaacttacaataccgtttactttagatctttggtggttttgacccggttttatctgatgtggcagctgagtcaacgtgagacccacgtgagacccatatgtcaggatgccacgtcatcactccccctatctccctttctctccctctcacatttctggtctgggcaggccagccgacagggcgaggcgggagaggatgaggcctggcggccagcgacgtgggagacggggcaacgaggcggtgacgggttgggcgcgacggcgacgggcggagcgatactccattgtcaccgccggcggtagcacgtcggcgcggctccgtcggccagacgctgcaagaactagcgggagtgcgcacgaggatgagccagacgatgaaggtggcggcgccggcgccgaggaggaggaaggggctggttccttttcatataaattcaaacaaaattaaaccaacactttagataattatataaatttatacgctttaaaaaaaagcctcaatgaatatgtacaggatataaactagatgaactggcgcgcctatttgctagttttgatatacgacgggctaattaaatttcagcgaggactattgccttgcttcgttacacacgaaagtacgaaaccgattgtggctttgttctctaccgttgattagacatacacatcacatgcaattgttttaaagccgtactatagacttaaaaaagttcacagtatctgtagaaaaaaaaagatttgcaccttcaagccagtgctgaaatgcaagtttctaagcagtttctgagctagtcatccttggacaacccctttccaacctaaatttgtgtggaattcaggttaattggtccaaaataaatgggaccaagagctagatattgaccaagatgcaataaacaatttaggtgtgaaaccatgaaatgctcaccttggtttctcgtgttcttgctctcgcccatttggacagtgcggattcttgcttctcgaagccaaagaaggacacggagctcctcctcagcagtacaaatctaggagctttcatctgcatatttcatattccagcacaaggcttatcaatggccgcggtgaggttttttggttgttttgggagagatgaccgtgacggtgacgaactcaccagctctgctcgaagaggactgtgcaagggtttagggtctaaattcttgtaatgcatggtaacagtaggtgcaaacatgccactttatctggcacccctggaaccatcactcgccgccaagacaagagggaaaggtggtggtgtcgttggagctcgtcgtcgacggcgaactgctacccaactcccgcgcgatgtcacgagttttttaccccattgacgaagagtgcggcgtgccagcatgtgggaggagagggcctctccggcagctgagagggatagaggagaacaccagttagttggatctgtaccacggcgagttggaagcggatggtggtggataaaaggcccgcagtcgagcccgtcctcgcacgccgcccggcgagccgttgtcgtcgtctcgaccggcgctatgctgagcagttgctgccgccagagaggaaaggaggagctccagccggggaaggagaggaaggtgtaagagagagggcgagcagcggtgccggagacggcgcgagccacatccgctgcccctgctcctcgccgccgaccttgctcggcaaatccggcaccccaccgagcggggtgagagggcgggagagagaaagcggaggcattggggagatgaagagtat

SEQ ID NO: 22189 - DNA, 2811 bp, Oryza sativa
accgccattactacccctgttggctccgtcgatccagagaagggaagaggtgagggaagggaccagtagcatggtgtagatgaatagtacggcgccggccagcgtcctattacttcggtcggccggatccgacggcgagaaggccggggtcgctggatccggtggccttggcctcctcacgggccacgacgacggctaagaaagggcaaaaaggtggcggcggcgcgtgaagagcagcggcggaggcggaggtgcaagagcagagagctgcggaaaccccgttgccggcgagcgaggtgagggagaacaagagctccgacgcacgtggcgctcacggccggctccgccgacggggacgggggcagggccgtgttccccgtgccggtgaacaccgcaccatggccgtcaccgttgagggacactagctccttcgcgccgaaaccacccgctatggtcgacgctctcgagttccgcaagtgttaacaaccaaatttagtaagatatgaaccaggttcaacattggaatcgaagcggattcgacaaagagttagattcgaagaacagagtatgcatcggctgtggtggcatcggttggagtctgcatcggctgagatgaatcggacagaggacagctgatacagccgatggagttggtatagccgattctgatgaaaatggcttcggggctgtttctagaatcgattgacgtgcttcacaaggattgccacgataaagataaagctctaaataagacaactgtatctattaattaggatattatgtaatttccttagagatatgtttgggcaaaagtccgccgcaaagacttagggtatattagagtttgttagagataagagtcgtgtccggcaaggacatattttgtatctcgggtataaatatgacccgaatccatgtaatcaattaacatcatttcaatatactctttgcgcatcgccaccctttttactttcgttctatttcgacgagttcttgctttcgtgttgagctacatcgattcgatcttcaactagaggtaaacttgtcatggcggcttgcgatctcgggattagtgcttccatctttatgacactctaatcctgtttatgtaatttgacaagttatcatatacacattgcaatctttgttagttgtgttatataacttgttatgggctggttcttactgttaggaagtgatcgatagtgttatgtttcgttattaagttagattatattgtgtatctttcatctcttagaggttttcatcatctttcctagatcttatacttgtttttatgcttaatgtttaatcggttgagttcgatctattaagtaatatctataattatgatatctagcttgttttatgatcatcaagggagatagcatcggggtttcagcccatcttatctggtttagctactttatatgttatatgctcgattgatatgctaaatatgtcctttatattaagatcttattacatcagagtatattaggcttcccgtttgatatattctgcttgttttgatatcttaatatagagtggtatcggagtattagccggtacatgctagatatatttgatcagctatgctataaacatctatataatcagtactttactatatatttcgacttaagtgatttatacgagacatggtgaccgatctatcccaatcacttagtttaaatatgtattgaagtagggattatatgttgttaatatctatagctgatcaagtagatttagtcttatctcattcattaatgactgttgatcgattcagatatgacatcggctcgaagataaatgatatgtcattgactcatcggcgactggccgatcggctatcgtttatggatttaaccgcggttttttcttgtctttattcttgttgattgcaggatcaaatcaactggacgctcacgaacctaaaagcaagattttagacctgcactgaagttaagcagatcttccaggccagtgtgtgttttttgcatcaacacgcttttggcacgcccagtgggacaacttttctcatggcagaaaaacaatcaccggcatcgacaggcaagcctccaaaccctccgggggccaagcatccaaaacctccggggaccaatcaatcatcatctgaggttgagactgggaacatcgtcccagtcaccatagacaagttatcaccagaacagaaggagtttaagcaagtgatgaagagtgctcagcagcaattcatgaactcgttcaaggaaacctgctagggaacattcattcagaagtaaaaggtgaaggtggttgctgccgatgaacctgaaacaagttcatcctaaggggactaaaggtgttgcgaatggctcggatgataaaggtgagggtcctcaagatggtacggtcgaggagcctttgagatgcaacaattttcaagaccaggttgactatgctgttcaacatgccttgatcaactaatcgggggtgattatcaatactttatcaaatatgattaagtctgtggttgatagcacgatagctgagcatcaaaacacggggccagtctttctaccaggtggcgtctttccacagtacaggaatttggtgacaggcaaccagcaacataccaccaatgcaccaccggttcagccgacggcaatggtttcagttccagcaccagctgcaccgtcatcagcacaaaggcaggtgattaatcctcatgtcttgaccagagagcaaccacagcatgttggacagaacattaatcgactgacccaggagcaggtagtacaatgttcgcgccaactcagccgactg

SEQ ID NO: 22190 - DNA, 2509 bp, Oryza sativa
agataccaacaggatagagaacgcctattgctcagcaaaatccacctgttggagcccagtttgtacctgaacagcatatgtataatgtgcaacagcctccgcagaactatcttagcggtaatttcaatctccagtatccacctcggtcacctcagatccaatatcaagcaggaggatcacctcagccctagtttgttccccagctcaatcagtttgatccgatacagcagcagatgcaaggagtgccccatcaaaagccttaggccgacatgattgcagatgtgatgagggagtagtttgggcttaagccaaaggactctggaaatttgtatcggcacccttatcctgagtggtttgaaagagttccactgcctaaccgatacaaggttccagatttttcaaagttttcaagacaagacaatgtttcgacatatgagcatgtcagccgattcttggctcagtgtggagaggcatcggctgttgatgctttgagggttcgattgtttcctttgtctttgtccggatcagcattacatggttttcttcattgccttacacttctgttcaaggttgggccgatttggagaagcaattccatagctcttctatagtgggacccacgagatgaagctctctgacttgataggagttaggcagaggcatgatgaaaccgtgcaagattatatttagagattcagagatatgaggaacaagtgttatagttttgccttgacagattctcagttagccgatctcgcattccagggtttgatagctcagatcaaggagaaattttcatctcaggaatttgaaagcttgtctcatcttgcacagaaggtgaccctacatgagcaaaggtttgtagaggctaagaagaatttcaagaagatcaatcatgtatatccttatatgtatgattccgaagtggcagcagctgaatgggtgaggagcaaaaaggttgtgccatgtcaatgggtgaagagttttggaaaagaggaaaggtatgactttgatatcaccaaggctgataagatttttgatttgctacttcgggagaaacagatacaacttcatgctggtcacataatcccatcggctggggagctagggaagagaaaatattgtaagtggcataactctggttcccatgctactaatgattgcaaagtctttaggcagcagatccaagcagctattgagggagggaagataaaatttaatgattcaaagaagccgatgaaggtagatggacatcctttccccgtcaatatggtgcatacagctgggagagcagccgatgggggaaagaattcggagttctcaattgaattcagcaaggatgtcacgcccagaaattcatgaaccagaatttctaagctgaatgtgtattaaacccctgtccaggaccagccagggtacacaaacgacaattgttgacatacagatccacgtcttacaacaatataaaagattacaaatgcagcggaaaaagataaaggcgagctaagcctgaagacttgactcctacagcggacaactccattccacaggcatccttgacggcagcgacgaaaccaacctcttcgagacgtcttcaactgagaaggacttcaactctggtgcggggaaaagagagcaagactgagtactacccactgtactcagcaagtcataccggaagaggaggtatgatgcatggtatatccaagggaggctaaaggttcttttgcataaagctagcatttaaaagcagttgttgaaagcggtaaaacagttgcagtaattaaacaatattaaccaatcactgtccaacgctacaccacgttgcaacaggcccaaccaactacttgaactacaccagttcattagctaactaggggtgagactaatcacagtgaatctggttgaccgcccataaccgcgggcacggctattcgaatagttttactctgatcagaggtgtacaactgtacccacaagacacagccccacgacacattcccgtgcaccgacatgccaccatgacataccggaaagaggccgtgacaggaccctttgcataacccctgtaaccgatcgcaccacaccttagggttcgcccccgtccccagcaggcaacgggcagccccccctttcgtgccgcgatgaatccggaagccgatcaaccggacagcccggccgacccaactccatcacgcccacccttgcctgggtacgtcggctagagaaaagctacactacaagcccagccgttgcccacgctggcttgtggtaagcacgataaattcttccagggtttcccgcgaaccggtccttaatcgccatgggcacaactagcaaaaccatgcacccacagcccaccatgtagtgtattttaattagccaacaccattacggtggcactaatccaaaactattgccaataatcaaagtctatgctttaatgtgattccccttttgtgtactagtagaactaagcatggctaagcatttcctaacccaacatcta

SEQ ID NO: 22191 - DNA, 1128 bp, Oryza sativa
  unsure (1)..(1128): unsure at all n locations
nnnnnnnnnnnnnnnnnnnnnnnnnnnnnnnnnnnnnnnnnnnnnnnnnnnnnnnnnnnatagatagaaaagaaggggaatgcttgcgtgtttcccatattcaggaagcttgttagtataactcgaactgctttactttaatctttgtcctaagctaggacaaacaagaacaatgcgaaaccaaagcgagcatatcaagacgaatacacatcacttctctctcttttttttcttccagagtacgtgatatactttataatcatgtttatttacttgtcccagaggaacaagtagcctagcctggctgttttcggttccagctaaagaatccctgaacttttagtgttcatcggaaactttggtgatcgtcgccaagcagttgtccacaggccggggatgaggcagatatctcaccctgcactttggatttgccctcttcagcctgcacacagcagacaactttcagttttgaactttgaacaaagcaattttatcctttttggagttggtattctgaaaggcataactttcagttttgatcctggaagctacaagtaaactgataatgaaatgaaaagagtagaagaaataaagactgaaaagaagaagagaggtgcagcagttagtcttttatctgttcacaattaatcatgttcagttaacagtagttttttttgtcataaatatgttgagaggaggtttacttgtaacccaggagaaaatgatggaggaagacagagatctccagctttgcaagatcatttccagggcacagtcttgctcccagtccaaatggaaggaatgttccggctttcggagggggtccctgaaagaacaaaaaaaattacatcgaccattgaaacacactgaaaaaggcagagaatcgatggagcttaatctagtttgatgaagaaacaaaaactgcagaagaatggattgaatttaatttacctcccatcttgaagggttgaacattttggggtcaggataaacttggtcatccatgtgcacacttctgtaccacagctgaaccttccaccccttggggataagataacctgctgggnnnnnnnnnnnnnnnnnnnnnnnnnnnnnnnnnnnnnnnnnnnnnnnnnnnnnnnnnnnnnn

SEQ ID NO: 22192 - DNA, 564 bp, Oryza sativa
  unsure (1)..(564): unsure at all n locations
aaaaggtagtcctcaaacatgttcaattgtgcattgatatccttcaatatgcactacactgtgtttttataatatttcctcacaaaaaaagatttaaagaaatccaatatgtacagcgtaccacaggatcagtgaaacctatatcatatgtatagtttggtagtatatgtgtgtacacggatcaaacatacttttatgattcgatcaaatatatacttttatggcatgcagtttttgctgatgattgtagttgcaatttacagttatctgctgcctggtgaatggtctggtgattgcattgaactcacatggctctgtcgtttggaaggtgcaacagctttatacagtacagttttgcaattgaatgacacatcatggatgtagttgttgatcatctgtaaaatactagtggaaattcattattcgtatttggtcaaacttataagcaggtgtcattagagcacatataaactgagtacctcttatgatagctatggcagtatnnnnnnnnnnnnnnnnnnnnnnnnnnnnnnnnnnnnnnnnnnnnnnnnnnnnnnnnnnnnn

SEQ ID NO: 22193 - DNA, 306 bp, Oryza sativa
  unsure (1)..(306): unsure at all n locations
nnnnnnnnnnnnnnnnnnnnnnnnnnnnnnnnnnnnnnnnnnnnnnnnnnnnnnnnnagatcattgtctgtaatgttagtacgcgtagcagtggtcaagaattttctttcctgataatggcgagggggttagatatttgtgagaatgataggataggatacgggtgcaaagcgaaaccgctctagcaactgaaagtctgaaacggtcgtctcctcgagtctgaactctcgagtctcaaccctcgtcgtcgtcgtctccacccaatctctcccattttcatttccatttccatttcctcccaaaaaa

SEQ ID NO: 22194 - DNA, 668 bp, Oryza sativa
  unsure (1)..(668): unsure at all n locations
cacaaagcaaggttgtgaataataatgcaagttttcaatgataaattcactctttgtttaatatataagctgagttaaataccctgctcaagaaatattcggcaacatcaggaagaaaatgcaattcgtcttttcttttatatgttgcttgtatggcaggatccttccacatttcctcaacaattggagcatattcacgcgtagctgcagggaagaatgcatcgaggtctcccattgctattatatccaaaagccaatccgagaacttcttcagctttgcatttatcgagtatatgcaagaatctgaaccattcgatttatttccatctgcatcaataagaaaaacttaaagatattgcatatagccctgaaaaatagaagtgaagaatatgtgttagctgtggttctaccatgctgcgtattctcatcctctgagcttgggttattcgatccagccaaagcctcttcctcaaaacgctcacggccctcaagaaggatcccaaggtacttgaacatattactttggatcataagtttgatactatcaagttcttcttgggtaaacctagtgtcgtataataactttgcctgttttgagaaaaaaaaacatcatgcaaatgtatacaannnnnnnnnnnnnnnnnnnnnnnnnnnnnnnnnnnnnnnnn

SEQ ID NO: 22195 - DNA, 834 bp, Oryza sativa
  unsure (1)..(834): unsure at all n locations
ataacttttttgaacgccatgcacaaaacgagaggatgtccactcgagggacaaaaatccacttccatatatgcaaatgatttttaacacagtggaatatactactgctccagccgaattaccacagtaattactgcataactaatttgcacgctaatgatgatgaaatctgaaggttgtcgacgagacacttcgctgcgtcaacatctccttcgtgtccttccgtcaggccacaagagacatctttgtgaacggtgcgttttcacatagctgaaaatccatcccttaaagacatatcagaatcatcatcatctgaattctgattgatgttgttgtttctctagtgaaccacatcgactgattactactagtgcttgaaatgaaatgaaaatgaatgaatgaatgttatactaaccaagaagaacccagcaggttatcttatccccaaggggtggaaggttcagctgtggtacagaagtgtgcacatggatgaccaagtttatcctgaccccaaaatgttcaacccttcaagatgggaggtaaattaaattcaatccattcttctgcagtttttggttcttcatcaaactagattaagctccatcgattctctgcctttttcagtgtgtttcaatggtcgatgtaatttttttggtctttcagggacccccttcgaaaagcggaacattcctttcatttggactgggagcaagactgtgccctggaaatgatcttgcaaagctggagatctctgtcttncttcatcattttctcctgggtacaagtaaaccctctctcacatatttatgacaaaaaaaactacttgtaaactga

SEQ ID NO: 22196 - DNA, 734 bp, Oryza sativa
  unsure (1)..(734): unsure at all n locations
nnnnnnnnnnnnnnnnnnnnnnnnnnnnnnnnnnnnnnnnnnnnnnnnnnnnnnncactccaggctcgatgtgtgtttacctactaggctactactaaatgtgattttgatttttagtataccatagtatttaaaactaacatgcttatataagcattgctagtttaattttctctagtcagaactaaatttattaatagattagctgaatgttcattcatttgctaaagattaaaaatgagccactcatgtcctaacattatgcagcaaatggaatttttttttattgaacacatcaaagcagtcagtagaagatgtagtagagagaaggctgggtggtagactcaccaaagcattcttttaaaagtacagtagtgtatatattttgacacgatgtaactaatttaatgattcaaagcaactataatactggatttacagataatcatattccattcttttaaggggaataatcagattccagttgctttgaatctttacttctttgaggttggaaacggaatcagatcacagttggagggtacctttcatgtccaagcacttgtataagcaacaaatttggggacactgacatcgccaaatgacattgaatcattaaaacctcctgctgtgccataatgaacaatgccagacacaataaaaacggcgatgagagtctgtacagtcacaggcgcatttactggaagaccaaagcctagtacaatgcataagca

SEQ ID NO: 22197 - DNA, 7043 bp, Oryza sativa
aaaggaaaaaggagggaaaagaaaagataaaagggaaaaaggattttcccagggatttaatattgcactttgcttattttaattggttaaaattatttatagagctctgaaaattccactaaaaatcttgttagcatatttcgacatgtagaactcaagaaaaaattccacatgccaaatccgattattatttgcattaatttattaaggtttactcttgctttacactggtattttcttgagaccatttataacttcaatttaggcttgggaaataacttcagggtgtgacaaaggattatcaataaataccaaaggaagcatgataagcagtaggaaagatatcacgaagaagatgatggtggttttgatcctcattgggatcatgagtttttaggttctgttggaacgaagggatgagactaccgtcgattgaggattgccctggatgcagtgacaatgcagggagttcaagccgatcttgcactaaaggaaatcggctgagtcagaagaggttgtctgttcatcagaggttgggctcacttaatcaggatcgtcatcaagatgaaaacgaggacagaaaaacacaatggtgtccttcttgtattttttataaagaatcagaagagaagggttcaaaggatttcaggaggtccagcagtcgatcaaccatcggctgaaaaagaccaagcaagaatggcgcgttaagagtaaggttacaacaaccgatgaggtggaagctgacaaggcgaagaagctggctaaaggaaagagtgttgcatctacatcggtaaacatggtgtttatattgttgttgctgtaaaaacacgaggcctgggagacctgcttaactccagtgcaggtccaaaactcgccttcggatatgctagcgtgccagttgatttgatcctgccatcaaaaagaaacaaagacaaagaaaccggggttaaatccataaacgatagccgatcggttgggtgccgatggcatatcattaatcttggagccgatgtcatatatgcatcgatcggcagtcattaataagcgagaaagaactaaatctactcgatcgtctgtagacattaacaatatgtagtctttatgtcaatgtatacttaaatcaagtgattgagatagatcggtcgccaagacgagacagtataaatcacttaggtcgaagtatatattaacaacgagactatatgtgttcatatcataaccatagtgaaaaaaacggaacttaacaacgagactatatgtgttcatatcataaccatagtgaaaaaaatggaaccggaaaaaaccaaaaccagaggtctccacggttcggttgagctgaaagaccggacatgcattcaatccggattgaactgggcgggttttgaataaaccgggcattaaaccgccctggtcagaccgggccaaggggataatgggctacatgaaggccagtccaggcccacgcgactgtttatgtacaaaaaacagagaaatgagtggcgtgtggagactcgaacctgggtctttgcactggaagctcttagctctagccatcctaccgatttttcacttgttaaacagaagaaatacatactgcatatattagttattgaaccgcggttcaaccggcggttctccggtcagaccgtcagaccggtgaaccgaggggtcgtccgagtccctcaccggttcggttttttccactatgatcatagccgatcaaatagatctagcatgtatcggctaatactccgataccactctatattaagatatcaaaacaagtaaaatatactaaaccaaagcctaatatacttaaaagcaacaagttcttaatataaaggacagatttaacatatcaatcaagtatatagaatagatgtagttaaaccaggtaagatcagctgaaactccgatgctaccctaatcggcaaccagaaacaggctagagactgagattctaaacacgacttaatagatcaaactcaactgatgcaacactaagtatgaaaagaagaacaatatctagacaatcaatccgctggatgtttcatagagtggtagatatcttatataatctaagccaacgttgttatttaatctaatcagctgccttctactagcagatgttagccgattgtaggttagataacgatattatcgaagattatgtaagatatatgataactcgacgaattacataaacaagattagagtatcataaagatggaagcactaatcccgagaacgcaagcagccataacaagttttacctcttgttgaagatcgaaaccgatgcagctcaacccgagagtaagaactcgtcgaaacaaaacgaaagtaaaaagggtggcgatgcgccgagattgtattgaacgtgtgttaattcgattacatggggttcgggtctatttatacccgagaattacaagatatgtccatatcggacgcgactcttgtctctaacaaactctaagatattataagtctttgcggcagacttttacccaaacatatctctaaggaaattacataaaacatcctaattaatagatataattgacttctcaggactcaatccgtgtgcggcaatcaccatgaagtacatcaatctaaaccgacaacatatgctgtgtcacattgtcggattctgctctatcggctaaccccgtccgactcaaactctgccgatcttatttgtagccgattcagactccagtcgatcctcactctgtttcctagacgatttccgtctcgaattctatcttggtttcttcttcaccttcgatccttggattaccaaatttggttgttaacaattgcctacagaatttgaagctaggcaagccgatgttgatgatgtagaggaggcctctgctaggttgattttgtcaccagaacaagcattttttgagaagccagaggggacagaaaatcggcatctcaaaccattgttttgtcaatgggaagccgatgtctaaaatgatggttgatggtggggctgcagtaaatttgatgccatatgctaccattcaggaagctaggtaggaatgcagatgatctcatcaagacaaacatggttctcaaaaattttggtggcaatccatcggataccaagggagttttgaatgtggaactgacagtcggcagtaaaactgttcctacaacgttttttatcatcgatgggaagggttcttatagcttgttgctcggaagggattggattcatgcagattgagccgactatgcaccagtgcttggttcaatggcaaggtgacaagattgagattgtgccagccaacaggtcagttaatgttgctagtgccgatttagctctttgggagatggatggtattgattgcctgtctggaaaagtttgggatcaagattttctaaaagtgtccgattgtgatatacaaccaatggaagacggagaccccaaattattactttgagggtgttgtgaagggttcaaatttctacaccaagggcacggtggatgatctcgatggcaagttgggacatggtttcatgtcggccgatgatttggaagaagttgatatagatctaggagataggccaaggccgacattcatcagcaaaaaattatcggcaaaactattttaaactgatttttctcctaaattacttatccaaatcatgatccgattgcaccattaaattcgttgcaattaaatcttcaaaataagaccacacatggatatattacaacgaaaaaaatttagcttattattgaattatttttaaatgttgcacgatgttacaccaggtatatcagaattgtttcactaagtagatcgaaaaatgtttcagttttgaaaaaaaaataaaacgaattcccttaataggggtttctgaaatatgtgagttttttttacaatggaatatttcaattcactgcaacattagatctatatatagtgaaacattgtgagtacactaggtgaaacatttttgataaaaaaaataaaccaaatttttttaacagggggtttttaaaatatataggttttttttaatggagttgtgtgtgtaaataagtggcaggtgagaacaagagatatatggtgagggccagagggactgacacgcacgtgaagagaggaggggaggggagcgatccggaaccggatcggtcgaccaatcttgagcaattcgggtctttctattctatcactaacaggcagcaacagtagcagttcgtcgtcaccttgattttgaatctgcccgcaggccgcagtcctgctcccgccgccgtctcggcacggcggcacctacccggcgtcccgacatcccgctcccgtccccgcccgagtcccgacggccgacgctgccagcagccagcgcagcagcacccagccggcagccgcccaggccggccagcggccagcgccactccatctccggctcgggctcggctcttcgcctctccggactgcggtgagcaattccacagtccactcactgtctcactccctctcggcctctctcccttctagaatctagagactagagttctagtagtagaccaataggcagcactagttgttaacagtgaaatttggtaagccctaaagtcatcatcggctgaagatcagtatcggcttcggagttctagaatcagccgatgagagttatcaagtgtcagttgtcggattctttctatatttggttaaggaaattgatctagtaaaggaagcttatccagaagagactgagttcaaggaggatgtggcatgacaagttatctattaattaggaatagtttgttagtttccttttatctttaggaaagtgtgtccgataaggactttattttttccttttatctttagtttctttcctgtccgacaaggacttgtatcaacccatgggtataaatatgtacacccggggtctatgtaatctatcaatctcgatcaatacaactactctcggtgcatcgccaccctctttaccgaggtttttacttatcttccggcggaatttgggcacctgacgcggggcagcatcggttcagttcgatctccggcgaaggggtaagtcctacgttccgtcgggccctgatgaatttgtcatctacatcggcgtcgttcaaggctgcatcagtatattcgacctctttatcgtatgtctctgttaatctagtcttagcatatcaatttagctctatcggctacttctcgctttagggtttctgccggtatcggctaaatcgtgttgctagattggattagcttaggcatctaccaccctgaaaatcagtcaagggctttgatgtctagatattgtgtttcttttcatactagtgctgcatcacttaagtttgatctactaagttgtgcttagaaccataatctctagcctgcttgttgactgccaataagggtttcatcggggtttcagccgatgaattatctggacgttacatcagctcataaggattgtatatataagttggatttagccgatgacaacaaaggtttcactgtttaatctaatcttgtggattttatgacatcggacctccagccgatgtatgctttaaccttcggatcagtgcttattctatcatatcattgctagccgattggtttctactagattatattgttattttattacatcatcatcagccgattgcctttatatcattatctacattggacatatagccgatagctcaaaaccctatcagcatcggctattatcggcatcggctgagattactccatcggcttgtcagcagatcggctatttgatctacggtttacatatcttgtcagttgcaggatcaaactgactagcacgcccgcatctcatcaaactttggacctgcactggagctaagcagatctcccaggccagtgtgtgttttttgcatcaacactagtgtactacccctttatataacaattttgcattgtttgatggttgttaggaggttgaggcatggagaagtcaagcattgcgttgctttttcagaagcatgaagcaaaaaaaaatgcttgtgatctaccaatcccacatgtggatgaagggtcgtctattcctgctgtaaatgatgctccaattgatgaagacatagttgttgatgaaggggtatgtgaagaaactgaagaagatactgttgtagatgacgctccacctccagatgttgttgttgatgaggtttcaattgaaactaaagaagaatctctgccgatttatgatgttgatgatcttgaacatgatccaggcttaagggttcctatttcaagttttgatgccaacgatcaagatgcggctagaagagggtacattctaaaaggtccatgccatctttgggccttcaattttccatccagaaaaatatatggtaaagatcgccgctttagtgttatttggtttcataagtacccttggattgaatatagtgttgacaaggatgcaacattttgcttcgtttgttatttgtttggcaaagaaagtggaaaatttgttacgggtggttggcataattggaatgtaggagctaaagcccttgataaacatgttggaggaacatctagtgatcacaattttgctcaagagaaatacaacttatttgtgaaaaaagggtacacaaattgatactgttattgtgaaggtgtcagaacaggatcaagttaattacaaggctagattgacttattcacttagatgtttgaggtatcttttgcgtcaaggattggcctttcgtggacatgatgaaactgaagaatctaacaacagaggaaacttccttgaacttttgaagtggcttgcaggaaataatgaaaatgctaataaggtggttctgaataatgctccaggtaattgcattttgacttcccctcgcatacaaaagcaagttattagatgttgctctatggaaaccactagttgcatacttaaagaacttggagatgagcactatgcaattctagctgatgaatctagtgatatatcacataaagaacagttggttgtttgcttacgttatgttgataaacttggagggg

SEQ ID NO: 22198 - DNA, 8818 bp, Oryza sativa
agaggattggccaatcatacatgctatggttcttgcttttgagtcatttgagtttgttttcaatgcacacttaatgcttgtcattttgggttacacaaatgagttttctaattcattgcaaaagagggaccaagatattgttaatgcgatgtcacttgtgggtttggcaaagaaaaaaatgcaacaaatgaggttcaatggttgggaaggtttcttaggaaaggttacatcattttgcatcaaatattccattgatattcctgcaatggatgctaaatatgtgcctcatggaagatcccaccgtttttacccatatcaaacaattgatgaccactataggagagaagtgtatattggtgtcattgagagaattcatcaagagctggagaatcggtttgatgaagttagtatggagttgcttctttgtatgtcggcattcaatccaacagattcatttgcctcatttgatgcacaaaaaatacttagacttgcaagcttttatcctaaggacattgaaggctccaatttgatgaaacttgagctccaacttgatacatatattaatgatatgagagaggatcatagattcaaaggcctaaacaaaattggtcagctttctattaagcttgttgaaacaaagaagcatgatctgtatgatttggtgtatttgcttcttaaattggtgttgatcctaccggtggcgacggcaagtgtggaaagagtattttctgcaatgaatttagtgaagactaaagtgagaaatagtatgagtgacaagttattgaataattgtttggtcaccttcattgagcgtgatatgtacatgagaaagacataattcactctttcatgactatgaagaagcgtaaagcaaaagctcttgagtcttgattagtattgtaatatcctatgtatctaaagaccttgtattatgtttgaacaatttacatttttatttaggtaagattcaaacttatttgttatttttctacttgtattgaaccatttagagttatataccatatcgtactatcgtttaccacattatatatcgaatcatattgtattgcattcgaattttttttggctaggcctaccctaggttcaaatcctgggtccgccactggtggctactattgcactgggccatgaatttgttgttggaaatctcagttggatttgactataatccatgtttatgcttcattgtatgtgatttgggatccacaaaatatgacaatatgttgtcacaattttttaaaaaaattctgccaaaattatgtcaaattttgttttctttattttgtcaaaaaaaagtttcaaactaaagtcaaatttgttaaattgattcaaaattttaaaattaaaaaatcaaagacaaatatatcaaacttgtcttaaatgtcaaagatatatcaaatttgtcacaaatatgtcagaagatccaaatatatgcatgttttgacgtaacggagtcaaataagcaagggcaaaggggactatttgccccttagttaacactatagttggccaaaagacccacagcccgacgaaacaacccatggcacggagatttggctagatccagacacgtcatggctcgactgttgtcggacccatgccagctaggcctaattgttgggtcgtgcctaggcctcttcctcggcacgacatggcacaacgatcagcaggcccaaatagatgagggaggcaagatagacatttttttctagccatatatccacgaccctgttaacgacaaaatttggtaagcccaaagtcatcatcggctgaaaatcactatcggctgcaacatcttggaatcagccgatgggagttatcaagttgccaatagtcagattcctgctatattcggttaaggaaatcaatctactaaaggaagtttatccataagcaaccgagttcaaagaggatgcggcatggcagtttatctattaattaggaatagtttgttagtttccttttatctttaggaaagtgtgtttagtgtccgataaggactttatgtttccttttatctttagtttctttcttgtccgacaaggacttgtattaacccatgggtataaatatgtacacccggggtctatataatctatcactctcgatcaataatactctcagcgcatcgctaccctctttaccgaggtttttacttatcttccggcgggatttgggcacctgacgcggggctgcatcggcttttgatctccggcgaaggggtaagtcctacgttccgtcgggccctggtgaatctgtcatctacctcggtgttgttcaaggctgcatcgctccgatctcttggatcgctctggtttggttgatacatttgcctacctgatatctcgattctatctctaattgcattgtatttagagacgcatcggtttagttggaactgtctcggttaggtccgatcttctgtcttagccgatatatctctacaatcacaatgatgttctaaatagatttgttatatctatcacattagacagatctatcggctcatcgagtattagattatcatatacaatctcgtgatgcatcggttaggttcgacctactagattattgttgatcatataagtcttgttaagccgataggttcatactaatgttttatcggggtgctagccgataagttatctggacattgcatcggcttataaggattgcatatacatataagttagatttagctgatgacaacaaaggtttcattaatttatctaatcctgtggattttatgacatcggacctccagccgatgtattatttacccttcggatcagtgcttattctatcatatcaatgctagccgattggtttatactggattatattgttgttatattttattatcatcagccaagtgcctttatatcatcatctacattggacatatagccaattgcttaaaccctatcgttatcaggtagtattagcatcagctattatcagcatcggctggaactactccatcggcttgttagccaatcggttgtgggatctactgtttacatatcttgccagttgcaggatcaaactgactagcacgcacgcatctcatcaacctttggacctgcactggagctaagcagatctcccaggccagtgtgtgtttttcacgtcaacagacccaaagagatgagggaagcaaatagacttattccaaggacgagcatgatggactagtggcctggtcgtgccttcaggccggcacagcacgacccgagttttattgggccgtgcctaggctgaaggtgcaacccatgggcgggcacggcacggtttgttagtcgggccgtgctggcctggctactcactaacactattaactcgttttaatggaatagtgtcagccttcatcttcgattttgaaaaggaggatcaaataagcaaactaaaaaaagtaggatcaggttggtagttactagttaggctgtgaaacaaggtcaaatgagcaattacccctaatttatttactgatataaggtgtcgtacctatttgatttcgtgttgtatgtttgcttataatgtactccatatcttatatagtgaaagcaacaagctttcttgcatgaggatgtgccacatcatcaaaaatatattagccatcagatgaagagttcaaataaacaatggtcattggatcgaaagagtgcatgtattaaaaaaaaccatagatgagctaaacatatggaaatttctggaggtttcatctcctcataaacatatgattcaaagagagggaacaaaggaggcttctgatttctcttataacatactcatataatacaacttagctatatctatagttggctaggacaatcgatactttataaacaaattaacttatatcaaaacatttttaaaagctaaggtaaactaatagaccatacacagaagttttaaatagaatcaaaagtcgcgcaaagcgctagtatatatgaaaaatgcaaggataacttcaggaatatgtaacgagaccaccactaggacttcaataaactcctaagcatgggcaccaagatttgtaattggttctctaccaagttgtatctgtttcccccaaaatacattaattcatatgcatttatgcaattcataaagttcaagcgtggattgtgttcaccggtaaaaatcgtaatcagccgccagctgatttgaattaagcttcgtgtctcattcttaggttttatctcggcaaatcatggtttttgaagttatcttttcctgtgatcacgttcatgcatgttgtgatcacgtataccgactgtatataaattcgcagaagagatgtgagagacggatcgatgccattaaatagccgtgatgagcacgtaggcgagacatgacaggatcatatatatccaatgtgaataaaagaacaatattcaaaacagattgacagaatttaagatggttccatcggtagcttggaattaaacatgctgtgcatcgatgcatataggcaaggggctgtcgatcatgcaagttggacaaattaattttggtattttcgcacacgtcatcttatgtggtccgcgtgtgaaaatatgtcttcgcagacggattgtcatatcgtcctctccctccccctcctccttgctatttttttagacagtcgtttggcttcgagagttctacgcgcctagaaaaacattttgccattgtctaggaaaatggttttactagtttaatatgaatgtgactaatttatttatcaagagaaataaccgtccaaatagtaatttattaactatgaaaatctttgtggtaatctaaacatatgttgtatagattcattaacatctatatacatgtaggcaatactagaatgacttacattataaaacagaggaagtatatttataatgagagaagggctaagaaccaattgggagtaattcatttaccgagggaagaataccaattgatagtaaatcaattaccgagagaaggaagtgggaagaaaaatcaagagtaaatcaattactgatagaaggatgtgagaagaaaaatcaggagtgagaaaatgtgcaaacaagagtggtgggaaaggtgtgggagggaggggcagaggagttaagggggagggagggggtgtacctgtgagagtgcgttttagctagcacacaccccaggggcgctttagcgcgtccctaataaaatgtgaatatatgtgttattatgtgagaaaaatacaataatgttagccacgcaatctacacggccatcattctagttatacatatactattaactgagcaaaggacatgaacaagtaatcatcatatttgggaaagtagtgtgagcttataaagaatttgccttcctgaccagtatggaaatgcagataaattgtcaaggagaattgctagctaaatcattcatgaaacaaatatcaatgatattcatataatccaacttaaaggtaaattgtgcaagtcgcaactcgcaagcgataatatgacattcagtaagcagtcttcgaaaaaagaagagaaaatcgtaagcctgcattcacaaggtcacagaacacaagccaactatgcgtacaagcgaagcaagaactaagcatggaaactgcacgacaatacaacttcgatgtacaagaatccatatatgccaggtcaagaagccattacaggtacataacctattaaatctaacaagcagtaaggaaagggctttgcaatgatggctaaaacatgatgacaaaacaaagatgatagatcactggtcaacaccattaataaaactggggagcacccagaggtactctagttgactgcaatggccttcagttcgcaggagtggatgactgtatggaacacaatgtgttgcaccaggaattggctgaccaagctcgactgcagtccaaggttcatcagaatcttcagatggtttcgcaacataaatgcagttactctttccgccccatctttcagggttcgtgcaagagaacgtaggattcctcctatcaaggctgacaaatagagcactattttccaacttttccatcttcatccacttggctgtttgagcagaaaagtcaagacgaaagacttgaaaggtgccagggaaaccatacgaatggtgaatgcctactgagaggtcaagcatgagaagcatgtcaccgctgatcaccagccacggcttaaaatgtacacccacaaacatttcttctccccacacaacccctacttcctgcatgctgagctgaggtgcaaagcgcatggtatggagcctgtgatgaaagtccatcgcaaaaaactcacctttaacgagcacaatctgaagaatgcgctcaccgccaaaagggtgctctgaccaagaattcgttccaacctgccaatagaatatggacgatctcgaacaaagtaggagatgcgatattggcaaattaagtggagcagtaaggatgccatagtatgtttccttgttgcctgcggattgtagtttgggaggcttcaccttagcgccagtgtacatatcaacaaggaggcaattctcataatatgagaagatgagatacccatatgaacaacccaaatagcgcatgcgatttggagtattttgtggagctgaacagcgaagggataaagttctcttggatggatcaccaagctgccatctgcatttatataaaagagtgtacctaaaactgctgcaatggggatgggaattaggtatatctggtttcaggtgaagaggtgggaaggtgaaagtatatatggatgggaaggaagataatgcagctcgccaagagcggcaagtgccactaaaagcaagcaagtcctggaatgagctaagcaaagcaatgatttggtgaagcatgctgtccatgagacctggccaaacatggggttcacacatggtagaggatgtagacactgatgagtggcaggttttcttaaagggcctttctgcaacagaaacttccctgtcaaacaaatgaaaaaaattcaggacgactggatcagagaaagcactcaaagataacattattagtaaagatttagaaatggaatgatattgatcacaatgtcggttcatttaaagaagcaacatgaattggtaacttcacctacagcttgggcatatcgagcaataggctcttgtaacatgctgaggcaaataattatgcccgtttcattgaactgtaacaattccaagaaccacttacagctttgataccttgaacaatagcacagttgtaatctgtctagtgttccaaacccttttttggcccctcaaaacaatgacagaggggtacgttgtagagcaccctcagaacaaatatcaccaaaagtgatgaaaatatttattccgacaacatgaatatgcgggcaatgcatccaatttaacaggaaaaaaaattgtaagcgcatttgattaattcattaatcgatcttgctcctctcgcggcccaatttaaaccactactggcagtgctaccatacaagaatgtcaggtaccataaacgtcctggaactatgtaatcgactagaatcgtgtcgagaccgcattaaattgtacctaaatttgaacaccaaatatccatcatctcccactataccaaattaccaatagtttcacacctcatcactgaacaacagaacaagttatgcactggtgagctagctcaccctacctagttcatgacatcatgagacgaaatcgctatcggcgcgtggtatacgatgaatgagggttctttgtcgcctcacgatgatttgacgcacatccatccactcaggaacatcgaattaacaaaggtgaaacagagaaggataaataaaacaaaccaaatcatggttagggttgcggtgcggacctttggccgagagcggtgagctccgttggcgagggctcggcctgcggcgacggcggccgtggtcttcgccgctgccgcttacggcggctcccgtccatgagcgcttgctaacccgtagcttccccggatgcgccggtgaggagaccaacccggcggtggcgacggcggcggcggcggcggcgcgtccgatgggagtggaggcgaggcgaggaggcggatgcgtcagcgaggtgatgatccatgggaggcccaaccaatccagcccaacttttgatttgggcccacattgctaggcccagttaagaaagcccaaattgggcccacgattggaggccataaaaggagcaggagaaggggagtgagagaggggctaaccgcaccgcacgccgacatcgccggagagggcgccgctcgccggcatagtcgtcgccggagactcgtccgtccatccgcaaggcctgcaaactctctaccttctcccccaaccttgtcgcaaccaacacctcatctcgttttttttttttaatttttatttgatacatttctcagtttctcctcgtgtgtgtgtctgtgtcactcgtgtctccgaatccgatcctaaccgagaagcgcgtcccgtcctgtggtggtgagatctaccccgcgttggtaggggtggatcttgcactggattttgttgttggatgtgctagcgaagaaccctagattgacatggttgatcacgtaggtttatgagaacggcctgatcgtttgcaatgtttaaccaaactctactatcttcttctaatatattgacgcgcaatccttttgcgcattcgtgaaaaaaaaaacgtaggtttatgagagcgtataggtgcgcgtgcctctactagtgtgaaaacaaaatgcgcgaaattggatgcaatgtggtgattcctgaacagaaattttgatgccatgcatgaatggggatcc

SEQ ID NO: 22199 - DNA, 13129 bp, Oryza sativa
  unsure (1)..(13129): unsure at all n locations
gcatcaaaacagaaaatatttcaggcctttttttttacattatttgaatacaatgatgggcttcacatagaaagttttaaactttaagcaggcatgcatgcattttcaagaaaaacgagctactgtttttcctgtatgctattgtttctccctgaacataaaaaatgtacctgctggaatcaagatctttgccttttattttcagtgtataatgacgattgaggtatcttccgcatatatttggtagctgaaattctagcaggctttcaccattctaatttgtttttgaattcattatgtgttgcagggagtccagcaatactccatcatgcaaagccccagcaaggtttctgaagcctctggctcagcaccccctgccacgtctgtgatcgaaggttgggcagaactcccagagggcctgcttcactccattgttgctctattgggctctttccttgacctccttgccttcactggcacctgccattcttggcgtgctgccttctcatcctacccatcaaaatctaactttcgcaccatactcccacccctcctcgtccgacccaatgtccgcgtcaaagccccttatagcagcaatggtcatcgcaagctacgctcgtgtgaggtcattgatctagccaaccgaaacaccccactccgctgccagattcctcaagaaactctgcagaggatgcattttgcaggttcttcccatggtcagctcatctgctgccgccgtggttattgtcttgttgttgatgtgttcaccggtgctgaggtttcacctccacgccttccattcagtgagaactgtgatgagttctactactgtggcattctgacggctcctatcacgtcacctaactcacatctcattatcagcactcagtcctccctgtttgattggccagttggaagtgactcttggtctgagctcaagctgcccgttaatcgggtcgatcagattgtggaattcaatggtcagctcatcgctgtgattgaatacagtctgtacactttgcagttggcccccattcttcgcttggaaaagataaaaactctctggtgggataacatgaatgaatgtccgtatatgagaccatggtttgtggtttgtggtgacatgcttctcattgttgaccactacataagtttttcatttggagcaccggtcctctacaggccataccgtctggacatgtcgaccaagcctgcaaaatgggtggaggtaaagaagctggagaactgggcactcttcattgggggtgatgcaaggagccctccattttctttcaagaacccggagcgctggggagggaggagcaactgcttgtactatgctcactactctcagccattgagcctgcatgggttgggtgatgatgcagatgctgtgtgggatcctaacactgatgacaacctcgtgttcaaaagaaactggtaccgccagctgcaggccttgtgggtgtacccaagcatgttctattcagcgggagacggccagtgattgctgcacaagagctctgctcttatcatctgattctgagactctcttctgaattctgatgtagggcagagcatcttaatgcttagcttaataatacttgcagtcgttttgtagctcagttgttagctgcattctctagtctaatattttcgaggtgcactggatgcttttgtacctaaactattagtagctgttgcttttatgctggaagtctggattctggaactcgctaccgttgaggatttccactggtgatggagataatgtttcgttttacgagtgtttgagcttagctgctatattttggaacattaatatatattcttgtgtgcacttggcttgtgatttggttctgaatgtaacctatatgttgttcgagcttcccaatataaatggacattcaggcagggagtctaaagctgagtctgaagctggggatgtcgtagatgccatcaatacgagtggtgcgtctttcttgaggaatcttaaggttggatcaaagttgggagcaagtgaatcttgaaacaagctgtgaatgtcacgtccgatgaaaccgctgttaaaaccgctcggtggaagtcatataaaccagtattaggctgtgttcttcaccccttatttcccaactcacctactttttttcacgcgcatatttttcaaactattaaatggtgcgtgttttacaaaagttttctataaaaaagtttctttaaaaaatcatattaatccattttttaagttttggggttaatatttaattaatcacacgttgatgagtcatatcttttttacaaaagttttctataaaaaaagttgctttaaaaaatcatattaatccatttttttaagctttgaggttaatatttagttaatcacacgttgatgagtcatatcgctgaacgtgatcgtggacagccgcatccctggagccaaatcgctgtgctgcatcgacctctccctcacgcgctacaacttgttcaacactacaacaccatgggctcctctgtttatatttcagaggaactccgtgggctttctgagggaacaatgggccgcttttcacaatggaccaccatttgggctgtatctgtaaatgggctgtatatgtataaacagtctattgtacctccccaactatgttcgagtccaactttccctcctgaacaaagacttgtagcttcgatttgattcttacagaattttcaaccaatggatatagtccgttttttaaaaaaaataacaaaaagatagaaccatataaaaaatcgtaaatcgagaaaaaagttataaaatttaattctggtgcatttgtaatcgagtgtaaaagttcgatatacaataatacgaatcttgatgcaagatcctacatatgaaaaagtgaaagatactagcccaaaaatatgtcgcaagtaaaatagcaaaccaaaaaaaaaaaaaactagactcggttattaatactggtttatattgcctccctcgagcggttttaacagcggtttcatccgacatgatactcacagcttgttcaagatgcatgtgtatcatttctcacttgctccaactttgatccaacctttagattacgcaagaaagaggcaccactcatattgatggcatctaggacatccccagcttcagactccctgcctgaatgttcatagagatgaaatgcagcactcaggatgaagctatccggtttcagaagtcgacatgccgtttcgaagaacaagatgccatcatcgacgtaaccgtgatccagatgcatcctcatcatcgtccgacaacatgccaagtcagcaggtatgcctgcctcctccatttggttgtacatcctctgggcttcatcaatctgaccttccttcagaaaggcggaaatgagatggttgaaatgagtgcatgaaggggtcatgttgcttctcagcatcatctggatggcttcctcagctttggagtagcatttaccctcagtgtatgctctgatcaaagcaagatatgtgtgcgaatcaggcacatgattgtttttctgcatttcttggaatataatctctgcctcattgtgcaatcctgaagtggcataggcattgatcatggtgttgaagctgatctgcacattataagttaaggtccaaattacatattctggttaacctcaaggctaagtataccatttcttgctttgccactaacaaaaaggaatacctttccaggcctgataccatcttccttcattctactgaacagtaaggatgcctcatgatgcttccctgcagaaataacaatttagcactgaatagaatgaagagcaaaaaaataactaaaatgtaggatctctctttgatgcttttatcaaagttccttagatctgtgcacaatgcagggaaaatttaaattacctgcttttccatagaaactaagcatgtttgtgtatgttttctcatcaatcggtaagcctagttcctgtgcagcactaaacatttcaacagctttctccagctttcctccttggccataaacactgaatgagaaaaactgaaactaatgacataacgttctcagcaaaaaaacatcaaagggaaaaataaagcccagtttcctggcttgtttttctgaatattatctaccttatcattatattgaatgtctgcatggaccgaggaatgccagaagatatcatgcgatcatatatgctgacagctgagtacagtttgcctgcttggaagctaaagctgttacagttagctctaacaccatgtgatctgaaatgttttcttctctacctaataaaaagacattatccagacctgattcaagcattgacttgataaaagtattatatacaacagtgtcgagctcagcttcatcgtgtaaacagcgatatatgatgttttctgcctcctgaaatttctctggaagtaacatcattacgtcagtgcaaatagaagtaaagtaaaatatatcggtaaaattacagtgcaatattgatgcatagtttttggcctctaaacagccagtcaatcagtcacaaattcatctggagcaatataagttatatagcagccaaagaaagcaaccgtcaaaaaaactcaccttgcttagtcaggtgtgtgacaagtatgcttattgtcacggcatctccattatgaccttgatcgatcaattccatgaaaagacgatatgcctcctcagttttgccacatctgcacaatgcatcaaccattgcattgtagacagatcctcctactggaaacgatgttgatgctgtctcaaacagtttttgtgcttgttccaactgctgggcctggccatattgtacaattaaagtagctattgcagtatcatcaggcttggctcccaattcagtaaggtgttcatagaggaatttggcctcatctgtactccctgcagaagaatccatgtagagccagcagtaagaagcagtatgttcaagcatgaatacaatgttatgtgcggcatctagcctcctcaccttccctagcaaatttcatgatcaattgggacacactggacaagcccccaggtttgtccaacaaggatttcaacatcatactaagtgttgaactatctgttggatttagcacctttgatgagctaccttcattctgaatcacttcagttaaattatccgtatccttatttatactggttttgcaacaaacttccaacacagtcacacatagatcctcatcaaactggagagcttccttcctcattttcagaatgagtgccctggccttgtctagatggccaagcctcatatataacctgagaagatcattacagcaaaacacatcgggcgggccataattggagagagctctgaaagtatcttcagcagcatccacatcttcctttgccacatgacatcggagaagagcactgtaggagaattgtgatggctttacatttctcgccctcatagcatccaaaacttgcaatgctctatcatagttttggacattcatatgaacttgagccattgccacataagtttgctcatcgctcaaaagacctgccttgtcaatctcctcgaacatacgctgcgcgtcctcataaagcccaagcttaccatatatcctaacaagaattccatagataacttcatcaggaacaatcttattctgctccatctcagagaacagcgaaagcgccttcgagtaatcctcattcttgtaatagagtgtcaggacagatgcacatgtgtagttgcttgggacaatactcttaaccttcatctcatcataaagccccaatgcctcttcccctttgccatgcttggcacacaagctgatcagaaggctgtatgtcgcctcctccggcacaaatctgcggcgcttcatctcaccaaatgcatccatggcctcctccaacataccttccttggcatatgacccgatcacaactgtatatgtgaactgatttggggcaacattggcttccagcatctgctcccacaggtggattaccttgccatgtaatttctgcttctgcagagatgagaccatgaaattgaagaccgagatggagggcacaatgtcgcggcggcgcaccgcggcgtagaacatcaacatgtcattgagcttcccccatcttgcgtacgcgcacaggagggttccacatgccactgcgtctggctcgcacccggcctgaagcatctcaagaaatgtcacctcggcgagcttgaccttcccaacctgaccgtacaatctgagaaggattgtgtaggcgacaacgctcggttcgtagcacagctggatggatcaagaaacaaattcatggtgatcagctcataaatcgaggtgaaatcgttaggaattcagaaaaaaaaagaggaaaagattcagtctctttgcttacctgaagcttcatccaggcgaagaaatcgcgggcctggcgccagccgcggagctcgtggagcacgaagcacatctcgcggaaggtgagcttcgcgacgaacgacgccatggcctcgcgcatgtcgccgaaggaggggctggagcaggacgccgtggcgcgccccgcgcggacgccggcgaccacgtggcgaccgtacacgtggccggcgcggtcgtcctcgacgtagcgggccatctggtccggggtgcggcggacccaccggggcgtgtgcgcgccgctcccttgcccccggcgctcgcggcggaggcgctgcgcctcgtcgtggaggaggcgccggtacgggcgctggcgctgggaggaggaggacgacgacgacgtgccggatgagagcgaccatgaggtggcggctccgtcgtcttcgtaggagtaggaggagcaggtgatggatacggcggtggatgcggcggcgccggcgatcgcccccgccattggagggtgaggagcgcgggaaggtgagaggagataaggttagattattagtatttttttttcctttttatcttggctttgggtaactaacagtggggcccacatgtcagaccaatggccagaagaacagatttattatttcatcttagggcgtgttgtaaagtgtttaggggtaatgagtttttgacaatttttcaagggcacaaaggaatgagttaaatattttaaagttaaaaagtcgattgaaaatgttttctaagaaatgctcatcaaggtttttgcaaaacttataccatttaatagctcgggaggaatgtgttcatggtaatcatcatccattaactgaagaaaaaacctttgaatcttatagattttttttgcagtaattaataactggtaaaatgaccaaagaacaatatttatccacaacattgggggtcggagaattaaacaccgaccccccggttgtgtccagaactccaggaaatgattttataagctcacacaacacaacttacacaagtcacaaaacacgcatgataatgattttacaagctaaccatttctcgtcctccactatatttgactggcaaattagtatgaaagtgtattaattaatgatctataaagaacacacaataatcatcatctccatctgacaaactaatacagcaatactactatacaatacaatcagtaacgagatctctgcctgcacagaacgaaatcggttgcaaatcacccaggggaaaaaatactactgaaaaaagaagagcaacaatctccagtttctttctgggcaaaatgtgcatcattcttgtctgatcagacgtgaggagctgagctctgtggtgctgtagaaggactcatctgggtagtacccacccccatccttctcatcctcccatttgagcacctccctgatgaacttgaaggcctcgtcgacggtcagcctgtcgcgggctcgcgcctgccacacgaacagcttgcgatccgtgcaggcggcgtacaactccttgaacttcatcgcgacatagtagaacgcctggtgagccagcgactgattgttgtggtgagtccggagagggcagaagtcgctgaaccactcgcaggtggagagcgggacgcgcccgattttctcctcgaagaggtcgaacttgttgagcacaagaacaaatggcatgtcgcggaaacatggttgcctgggacaagtataggttagtaactttggtcctggaatgagattttactaatttcaggaaagctgtaacattgttcgcattatatataggcaatatggtattcgcaaatatgaaatgtgcaatcttcccaaactattagattcaattgaaacaagctgtaacattgtccattttgtacacaagcaatacggtattcgcaaatatgaagtatgcaatcctcccaaactattactagattcaattggaacaagaccaacctcccttgatctatcacttgtcactttaaatatcttttttctgattatgcgcaattatggaactgttaaagttacaaaactatctggctaatgccaatagtacctgattgtagcctcaaacaagtccctgctttggatcatcttattcacaaggggactgttgccaccacttgaaggggcccccagctggtcatagtcactgagtgctaccgagaatattaccatgctgacatcctcaaacatttccacccacttgcatccctcattcattcccttggcacttactctaatcagctgatatctgaaaaggaataaaagctgatgagacaatagctttccggtacttgcttcgcagggcaaataaataatcaccccaagcaaagagcaggtagcctacctatttcactgaccagtagaaatgcattttaccacaatcgaaagatacattgccaacaatttaatatctaaggctattttatttatagagagctagtaacaaaaaaaatgacggatggaaaaggaaaataaaaggcactgtttagggtatatggatatgtagagatgtgtactattaaaggatttatatgcacttcaggcatgagtcatgaagaaagagtttacttgtttagtgtctgagagtgaggctcatgattgtcagtgtacatttctgacatagggctacggtcatccagagtaaactcaatgaaggctaatccattcccttgtgttactccttcagcatatattatatctttctctgaaggttcatactcattacttgatacttcaatggcctgcaaggatgtcataaaaagacaagtcaatgagggattcaaacacctatagtgtacacaaaaaaaaaaagtaagtgcaggggcacattatgttatgcttggtgccggagtaaggcaaatgattagtggttcaagctgttgtagaatttttaggaacagatatgatataggaatctagagggattcactgacacttataaagttataaccataataggtactggtgtagcacaatgcacaaaggcaggttgtgaataataatgcaagttttcaatgataaattcactctttgtttaatatataagctgagttaaataccctgctcaagaaatattcggcaacatcagggagaaaatgcaattcgtcttttcttttatatgttgcttgtatggcaggatccttccacatttcctcaacaattggagcatattcacgcgtagctgcagggaagaatgcatcgaggtctcccattgctattatatccaaaagccaatccgagaacttcttcagctttgcatttatcgagtatatgcaagaatctgaaccattcgatttatttccatctgcatcaataagaaaaacttaaagatattgcatatagccctgaaaaatagaagtgaagaatatgtgttagctgtggttctaccatgctgcgtattctcatcctctgagcttgggttattcgatccagccaaagcctcttcctcaaaacgctcacggccctcaagaaggatcccaaggtacttgaacatattactttggatcataagtttgatactatcaagttcttcttgggtaaacctagtgtcgtataataactttgcctgttttgagaaaaaaaaacatcatgcaaatgtatacaagataaataatagggctgactcctcaattgtccactggaaactgtgcatccacatatcagaatgaataacttgtgtggtgctccataaaaatttgcaggcatttattggaaaagaaacacaccagagataactaaactacacatgaaaattgatcagtgatagtttgcagaatgtcatgtcacgttgcatatgtgattgtcacctataacagttaacctgcagtcctgtgcttccgaacggcgagaaggtttctatgtcactaaacggagactataaatcaaattcaagctgtatatcatacagggccagtaggtaaaggtagagtccaccctaagagatgtataacaaagtaaaagtttactgcagttttaaatgtcaaatttggtcgtacctgcttgaatatggtgcttgtaccagctccaggcgatccaagaataagaagcttttggattcttttctgatctaagtaatcaggaacagttcttgctgaataaggagcttcgtcctttggttcgtcagagtttgctggaggaaccggtagtgaaaacaaggcacatgcaaaacgtgtcacaggctgcaaataaggacatgcaaaatcatgttaagaaaacaacaagacatgcagtagttttaggaagtacaatgaatgggttagaactcctttttctttacgtgaaacagtaggagaggctcctactgcattaaatattaaaaataagataaattacaaagagggaagggagaatgcactggattatgtacggggagaggggcagcagaggaaaagaaggaaaatagaacacgattataaaagtgagctaatccatgattgccaaagtggttagaactcctttgagcaagatacataccgattcccatatcttccctttgatattgttttgggcttctttcctcatagccaccatcatggtaaacccaaaagtgagtgtcacgggggcactgaacttgtgcaatctacaagaatgattcagatattgaggcaaattcagtgatagtgatagcacaattatagtaccagcaaaaaaaatcgccttattcgtttcctaaaaaccacgcacatagtccttacactctttcttaatctggtgaaattatagtcagactacatgctacattcatcttcatgtgttttgctattaatagaatacaacattgggtataccactcaagtctttcctcttaagatagataacaccaaaattgctgggttcactttaagaccatccaaacttcacaaatctcatcaactactattcccgttacctcacgtccaatctcctaagagagactcaactagatggctgatctggcttggtttgacttcttccaaaccaggacagtagacagaaccgcagaaggaaagtgaggcactagacagaggccaatccttcttacccaaagccaagccacaccagatcagccatctagttcaatagctattagttggtccaacaggtggtaatgatagtggtcaatttacaagagttatgaagtttggacggtattaaagtaaactttattttttgtggtatgtggtatatttctaaagaagaaaatttggatggtatacagtatacacctagtttctcccgtaatattgtcttcttggtttgaacaatcatatgaaattctatgaaaggctgtatgcctataagaaagtgtgtctatgatataacttagacatagtcttaaaaaaatgtgtcatatatattaatattgtttcataatggatatttctgcaattgtacccgctttcaaagatagatgtacaatgatagaacactgataccttcagaactctcagttcaatcttggtaatttcccttccattcatataaacctgagtgttgccattactggcattgggctgaagctttccattaaaggttaggttagtgctgacaaccctgtctggcttttctccttcctatcagcaggaacaaaatgtcattagcaaaagctcagactgcataagaaggtatgctcttctcctaccaacactaacaggcttacctttccccacaagcctgactccttgtcgtaccaatatcttccaggcttgagcttttgaggaggccgttggcaactaagcaagctggccatctcatctggattaagaggaaaaccatttatgatgagttgctcaggccggagctggtttgcttggcattccttctcagctttcagtatttgccttacttccaacgggctgagcagacgtgatagtatcctcgaacccttcccgagcttcgaccgcttgctctcatcgattggctggccaatgcaagtgatgcacttgcgcccttctggcatcgagcccatggccctgagcacgcagtagctgcaaaacctcgcgtcgcaaacaatgcatgattccttgctctcccacttccttttaccgcaacggctgcaggtcctccctctcttctccttcttggtcaccgccacgtactgttccgacacatcatcaaactctttgctctcatacctgctgtcctcagtgaccccaaatgtgacaacctgagctcttcttccctcctgagcagctgtcctaccacctctctgcccatggaaattgtgcgcggattcttgcgacaccgagcatgagtcatcatcatcagagaacccctcattctgcggcgccgaatcgaccgattccgagcttctcctcctcctaccctgtgccgcaaccggcggtggctcggcacggtgagcatcctgcttccggtgcaccggcggcataaacaccggcctgacgaccggagccaccacgccgttgctcctcccgggcaccagcgggccggagacgggctgcgcggtgggaatcgccggcaggtcgacgggatcgatcctggggagctcgtaggaacaccggagggccgtcgtactcgagcgcaatcgaatagtcgaggttggccggcgcctccgggatggtggtccccggtgggagcatcctcctcaccatctcctcccagttgctcccccccacggctcccgctccggccatctccccctccaaaaacctaggtaacctaacctcctcctcctcacctcccaaatcgagtaaacatggagtagtacaatnnnnnnnnnnnnnnnnnnnnnnnnnnnnnnnnnnnga

SEQ ID NO: 22200 - DNA, 6161 bp, Oryza sativa
  unsure (1)..(6161): unsure at all n locations
acgaccgtttcagactttcagttgctagagcggtttcgctttgcacccgtatcctatcctatcattctcacaaatatctaaccccctcgccattatcaggaaagaaaattcttgaccactgctacgcgtactaacattacagacaatgatctgatgttaatcgtttgatttaattagatgtaagttaaaagaaaatctgaatatactaagccttttcagaaaatctcaactgtaccgtattctttcccctttttttcttttatttgttcttttgtttttctccaattcgatggaggcacatctggattgcacgaaggaaatgggaaatgtttcaagctggaaaggaagcagagagaactgaaagccctctgaaacttgatggattctatgctgctttgctccttcatcagtgtgtcatcaactcatcattgtcagtatgtgtatgtgtgctgtgtgggtcaagtgaatcttcagcagtgagcactccatggcgtatctgcaaaagccaaatatatttttgcgctttgtactccattgctttctttttccttgcttgcaaaaatgacacttttaggacatggttatatccattttaaatagcaaatggcagatagcaaaagttttagtggtaaaagttttagcatttcaaaagtactaattggtgtttagatcatcctaaacttttatcattctagcattttttggtggagagagagtggtcgcaaagtttgccattttggaggattggccttacgctcaactttttgttttgcattcctctgtcctggcagagaggtactgtttgatagataatgtgatttatgataactgttcgaggatagatacaaaagaattatgacaactacaaggttcaaaagttgctttaaaaaattatataagaatttatactaaacacaaagcttgggaagaacttcagcgaaaaaacaaaatccaagataagaaaagaaaagaaaagaaaataacatggccaaatggagattcaatgtgacagtagaaattaaaagcagggggtagtaatagtaacagtcatgtgcagacagtaaaacggcaacagcaacagtactgcagaacaaaaaggacactgcctaaatttttctcattacctttccctctctctctctctccagtgacaataatgtcagaggattcaaggtagtgtgtcctttttgcagcttgcatttgaagtcgatctgtgtgaaaatctaaagttttactgcgagtgaaatgaaggtcctcctcttggctcttgctctgaatatactggccattctgttggccaagcaataatgcaggtaagcaagcgtcttatggatggaaagactataacgatagagacatgtggttgctgaaattttgtatggaattgcgcccaagttgacgatgtagaagtagaacgccatcatttgtgcagtgagcactgagcaacgaggaaaatgccgtcctaagcatggcatttgcaagaggagacagtagtgcgacagctttgtattgccaagctaccaaggggatcgttttgtcctgtctccacctgcagctttaacaaatgaaacttggttagttttcaatacttcttttttgttaggttagagggcaaacacattgctaatcacacaagggaacatgaagaatggagtgaaccatgtgtgctgcatattcaaggactaaggagtgcattggtatgtaacaataattaatatatgtacagttagaataattaaggacttgctatttattttctttatgagtatttttttattattatatatgaaagacagctacgtgcacacactacacttatgcattggtgagtactccctaaaaaaaaccaacttttggcaatgcgtctagttcattgctagaagttggttttttatgggaataagggagtacatgagtgtggatggaagtgctcttgccatatcaatttaagatgaaaaacattgatcttgatcggtggcgtttaagaaaaaaaaagtaatttgtagtattaaattaaactgcaattttcaatataaaagtaagttgatagagtatttgcagcaaactaaagttgaaacaaaagcatcacattgtttggtttgaagaatgcaaggacattttagtatcatgtactccctctaaccacaaatgtaaacatttcaagcgtttaaatttttatccaccaatataagtattcatagagtactacttgatccatcaatcattttttatttcaataatttgtttttcatctcacccctaaccattattcattatataaacacaaaaatcttgggaagcttctagcagttacagcttttacagcttgtcctataatcaaaagttcctccaaacagtttaactttttttatattatgagaagctatagttgtaagataaagaaaatgaattagaagacataaactaaggaaccaagcttttctaaattatcagaagttgactaccaactagctgcttctataatattaagttatcccaaacatatcatatccttaggtttagtttggcactacacttccgaattgctaaatgatgtgtgttctggaaaaaaaatctatatgaaagctgtttaaaaaatatattagtcaatcaaattttaagtattttagctaatacttaattaatcacgtgctaataacttgttccatttcgtgtagagattcccaactagatatgccgaacatgaccaatatagaaaaggtcatatttgtgaatagagagaagtaataatatgaatagcaaatacggagtacgtatatagcatcatataacacatggaagtctctttcagttagttaatctatcacatgcgggatttgcggttaaaagctctgttccccaaaacgataaactaatctaaaatcctcgcaaaaaaatttaaaaaatctgtaatcttaaattcgaggaaactcatgtgaagaatgaggtggtggtgacgtcaccaacaaacagatgcgaaatggagaagatgccctggcctgcaactgggccgagccgccgttggtccggtccacgttctgattgccagtttgccaccaactccaactccatatggcacgtggggcccaccacgcccgtggagacccaggcccacaagtcaggcagcaattttgacccgcctaccgccgctgcggcggctatctctgcgaggcggtccggtcccacccgtcagagagacgtcctgatcgcggcaggtgtgaaaggcaagggggatatttggtgggctatttaagcagccggtgcggtaggtggtcgactcgctgcacgcctttccgcgatttcgtcagttacccagatctcatcttacgcaggtgagctccgatctcccctctcccgcgctgcgattttgatttgatccgtcgcgccgcatcgcgtcgtcgcttggtaggatcatccatccgtcccccgcgcagcgcgagctgtctagtttctgctcgattttttagttcctgtttatgggggagggagggagagagggagggattgggtggaggcgaaccaggaatcgtcctggcggtgtgatgtctggatgaattggattggcagcgtcttttagtggctgagagattgtttccttgttactgttccgtggggtttacaactttagaatttgtttcttcgacagcatgcagcaacttggtagaatttagctgcatgttctaggtggtttgttgctgctgatcctgctcgtttggatcaacgatttttggggggctgagattaattggttggtacagtcttggttagttacatccatgggaacatgcagttggttattggtttgcacatggagtactactgctaatggggtagatatagacagtgtgtgcgccaaagctttgctaccactagtttctttaagtatagtgcctcccaattaccaatattacctattttcagtgtaaagtgttaaatagaaagattgcttctgattgctatctcctttacctgaattggtagttaggtgcacatcttccattgtaacgtatgtgttaccatggctcatgtactagttatgctagatatgttgtgctgctaaacatatatactagaaagaatgctaccactcgttccttctgttgttaattgtggaatgttttgcaatctctagtttgtagctcacaactgaccatatgattccccatccaagtgtcgacctcatgtgtgatttcataaataaaaaagagcatattttcaggatcctgttatgatcctcatttcatacatttatataccttttccataatacatgaatgatgcctcactcaatgctataaatgttcacattatatattacctcctcctacaagtatgaaatatgaattgccataggccatacaaaagagcccactccctatattggactcgataaatatttttagtacatagctcttaacttgcatgtcatagtctgatgtactgtcctttttgaattggaaactctgttactttataaaaaggattgacatttgtattccattgttaaaagaaaagcaacatctgcacaaactagtttgttctgcgcatgatgtattgatacatttggtgcatctatctgcaggcagagatggctgtcactagaattggtcttgctggccttgcggggatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaannnnnnnnnnnnnnnnnnnnnnnnnnnnnnnnnnnnnnnnnnnnnnnnnnnnnnnnnnnnnnnnnnnnnnnnnnnngatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcgacaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggnnnnnnnnnnnnnnnnnnnnnnnnnnnnnnnnnnnnnncggggctcacacctacgagagggtcgacatgcccggctccttccacaccgagtggttcaagatcgcgcgtgctgctaagatgtgaaatgcttcaaattttcggtaatatttggttgctgcttgctgctgagtcgcttgtagggtgggaggaactgttgttaaattttatggtcaatgtgctacgcttaatttggataaggaggt

SEQ ID NO: 22201 - DNA, 698 bp, Oryza sativa
  unsure (1)..(698): unsure at all n locations
nnnnnnnnnnnnnnnnnnnnnnnnnnnnnnnnnnnnnnnnnnnnnnnnnnnnnnnnntttgaaaacatgtacggagtattaaatattgataaaaaaactaattatacagtttgcgtgtaaattgcgagacgaatcttttaagcctaattgcgccatgatctgacaatgttgtgctacagtaaatatttgctaataacggattaattaggtttaataaattaatctcgcagtttacatatgaattatgtaatttattttgttattagcatacgtttaatacttcaaatgtgtgtcagtatatccgatatgacacaccaaaactttacacccatgcatctaaacacacccttaatttcgtttggtttgaggagttgtgtaagtatgttggtgttcggtgttccctggccccaagctggcagcatactagtactcctattgaaatggccaaattaatactggtgttcaagatattgcttcatggaccacaagttttgcattgtagactagttgcatatccattccttgcattgcatctgctaagctatggccgggctgtgtgtcaaccccacagcttcttcttcttctttcttggcctacaaaaatcagcaccaacggttgtgttgggtttggggtttccatgtgtcccaagtatttgtggggatgcaccgacttgttcttgtcttgggagtttggaacgg

SEQ ID NO: 22202 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnnnnttttatccaaaataggtttcaggtcaagagcacaggtaaccacattccaaattaattttgcgaaggggcaatcaaaaaataagtgctggatagactcttccctgcaacagaactggcaaattttgtctccctttcgccaaccccttttataaagattgtccttggttagaattttatttttgagaaacagccacaagaaaatcctgatttttagcggcactttgatattccaaatttttttaaaaggacaagcagtctgttgcagtttcagagctctgtacagagatttgactgtaaaaaggccatttttttgtcaagttccaccaaagcctgtcttttttgtccacctgcagttgaaacccttcacaatgttgttttataaaattccaatcagcaagtttgtcaccatgaaggacccttctgaatttgattttatcccaaccccccagaagcacttcatgaacagaaatctgctttgtgtttgttaggttatacagggtggggtactgcaaggctaaaggtctacctccaatccaattatcttcccaaaaaagagtttgttttccattccctatttttttggtgcaaaacctatagaaaatgtccctaacctccatcagcccttgccaaa

SEQ ID NO: 22203 - DNA, 424 bp, Oryza sativa
ctgctgctgctcctctccctcatcatcggcatcgtcatcgtcattgtcatcgtcgcatcctcctcgagtctggatgagttgttggttgctcttttcttggagagctggagctgcatctcggcgagcgtcatctcacgcttctgggttttgggcttcttcttagccggcggcagcggctctggctccgcctccgcctcagcctccggcggagggggcacttcgtaggcgaggaaagtgcggcggcaggaggggcacatgaggcggaatcccacgtacttgcggtcgaactcatggaggaggcggcagccggcgcaggccgtccagaaggtgggcgggacgggggcggccgcctggttggcgagcgcggcgtatgcgttggcggcgcggtggagccgccttcttgacggcggaggagaccgcgggg

SEQ ID NO: 22204 - DNA, 245 bp, Oryza sativa
  unsure (1)..(245): unsure at all n locations
nnnnnnnnnnnnnnnnnnnnnnnnnnnnnnnnnnnnnnnctgcagaagaatggattgaatttaatttacctcccatcttgaagggttgaacattttggggtcaggataaacttggtcatccatgtgcacacttctgtaccacagctgaaccttccaccccttggggataagataacctgctgggttcttcttggttagtataacattcattcattcattttcatttcatttcaagcactagtagt

SEQ ID NO: 22205 - DNA, 556 bp, Oryza sativa
  unsure (1)..(556): unsure at all n locations
ctcggtacccaacatctggaggtggagcgtcatctacaacagtatcttcttcagtttcttcacataccccttcatcaacaactatgtcttcatcaattggagcatcatttacagcaggaatagacgacccttcatccacatgtgggattggtagatcacaagcattttttttgcttcatgcttctgaaaaagcaacgcaatgcttgacttctccatgcctcaacctcctaacaaccatcaaacaatgcaaaattgttatataaaggggtagtacactagtgttgatgcaaaaaacacacactggcctgggagatctgcttagctccagtgcaggtccaaagtttgatgagatgcgggcgtgctagtcagtttgatcctgcaactgacaagatatgtaaaccgtagatcaaatagccgatctgctgacaagccgatggagtaatctcagccgatgccgataatagccgatgctgatagggttttgagctatcggctatatnnnnnnnnnnnnnnnnnnnnnnnnnnnnnnnnnnnnnnnnnnnnnnnnnnnnnnnnn

SEQ ID NO: 22206 - DNA, 3746 bp, Oryza sativa
aaaaacattattaatgaacatacatgagagggtataaatgccattttgtcaattacttaacactattaacttcaccatccaaagtaggggcaaaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactaggatgccacgtcagtaaaaccgggcaaaaattgagtcgatactgccatgggacctcctttgaacgatttgaataagtttaggggtaaacatttctggttttacaggtaaggaacctcaaaaaatctcgctgttaagttgagagatatccggtgaacttattccttcttagagcgagagaggtcagctatgttaccccgatatgaggatacggatacggatacggatacgcgatacggggataccgggatacggctattttcgaaaaacatggatacgtggatacgtctatatatacataataaattaaaaagaaacaatgcactcctcaaagaaaatgggagaattgattgccaataattgaaagataactaatagagcaatacatagatacattaaagcttagaattgtatagctttgaccagacctcatgcagtagtactggatcttcaaaaagtcacttatggctttgtagtcttactttacggtgtccaatatcacaaactgatgttctccttccccggccccaacaaatcgagatccaggatgccctgaaccgtcaatacacgatacttacctcacttgaatgaagcaatccctaaccgcgagcagaggtgtgtgctgcgtgcgctaagctaggggggtgcggcatgcggcggcggcggcggctccgcggggcatggcgacgatgcggcgcctcggcggcgtgcggcagcagtagtaggcccgcattgcaaagtggtggctctacctttgcctcgctccagaacgacgacgccgttgggtaggaaaagatggacgcggcgaggattggtatcccgtgagaagttaggattagatcgtaccttgtatccatgcgtatcagagaagtatccctaattatttcatttttctgaaaatcagaaaaatagaggatacgtacgggcgtatcggagcgtatccgaatacgtatccgtattcctttacgtatccgatacggatacgctcccagccgtatcagggtatcctaggaggtcagtattgcagcttttgctcaacatatgcttgaggaattggagtagttagttcaacccaaatctgcgtgacgtctcgttccttccttaaaagaataatcttgtttagaagtaaagcgttttagtattagaaaggggccaaaatgttcgcttaacgagaggggcttattttgctattgtagtgttgtgcacagcaaggtttcgtaagtacaatgtacatatattaacaacctgtaatgttgttccccatcacgcaataccatactccgtattagattagtgctgaaccgggaagccaatgaagcctagttttacacggtaatcaaccaatatcctaaatggtttgctgatatgtccattgctcatatgcacgcttagcttatatcctagcaatatttctggtctagactaacatcataacgtgatttgtgtgcgcagccaaaaaaaaaaagagattgaaaagaaatcaccgtcctgtattgtgtggttaacaacaaaagcattcacctgtcaccccctcccgcactcgccgtcgccatcgttcgtggacgcactcccccactgaatttttttgagaattaatattatttttatggaaaatcgcaaaagtagtggccaaccggggaaaatcgcgaaagtaggtccctgtcgaacgggtgcaattcgatagggcacctatcgaacgacgggcagttgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcattcgacaggccggtttaaaaccccgtctccccagcccgcgatgcttgttcgatttgtttgaggaccacatcgccagccgccgtcgagagtcgccacatcgtcgccgtgagcgccggagggagcgaggggaggggatagcaggccggagacgaggccgaggaggcgtcggccgggaggaaagggttggcgatgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccaggaggaagtagggatggattactggcacgcagcacctcaggtcacacagccgacgcaggagacggaggccggtcaggggccagacgtgacaccacagcagacagctagagataggcacccccctgataatttgacatatcccactgagcagattaggcgtaggaagaagggaggacctagcaagcgtgcgaagggcactgatcgtccttgacttatctatttgtatt

SEQ ID NO: 22207 - DNA, 1162 bp, Oryza sativa
atattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagctatggagcgacggctgactccgggcgtgcgcgcctggtctctccacctccggaatatgaacgacgcggcggagctgtccgtggggaccgcgtcggcaacggacacggcgtcgtggtgcttcgcaatggcactgatcaggcttgtgttgtgcacgctccacgctgaggccgtggtccgtggaggtccgcggccggcggctaggcggcgcggcggtgaagccgtgcgaggaggtgtacgtcgtcggggaagacgagatgttgcacaccatcagcctcactcctcccgtcatccctctcccttctctctcttcttccctctcctccctctctctcttcttcgcggggagcgccggaacggacgggctggtgggcagtggagcagcagccggcgacctcggcgaggcggcgccctcgtcgccgccttccctctccggcgatggccttcacgcggcacctggaccagtagccagtaacgacaacgacgacatggttggctcgtgcaactgcctgtggctcaagcgacatccccttgtctgcggcagcatcatcgtgatcaacccggtcaccggcgagtccctccatatcccgtcgccgccgttggcgaccagccgcagccacgcggg

SEQ ID NO: 22208 - DNA, 3364 bp, Oryza sativa
tgcgtcgcctggggcgttgtcagcgtcaacggcgccacgtactgggtgaccgagggcaagtagatcatgtcgttcgacctcgagcatgagcgcatcgaggccgtcgcattgctgccgacgatgagcaagtgctgcttgccggtgtccatggagaaggaggacgcctgctgccagctgaccacccccgccacaccggcccccgctgcggcacccaccaccccgcgcctaccaccaccacacccgccggcgcgcctaccaccccggctccggccaccggggcacctcctctcccccggttgaggcttccgtcgccggcgctgttgtccaccgtcttggtccagctgccgcgtgaaggccatcgccgaagagggaaggcggcagcaagggcgccgcctcgctgaggtcgccggctgctgctccgcccgccactcgcccgtccgctccggcgctcccgggaagaagagagagagtgagggcctgtttggcacagctccagctccagcttcaccccttctggagctggagctcagccaaacagtttcggctctaccaaaactgggagtggagctgggtggagctctctcacaaaatgaactagagttgtggagctgggtttaggcagctccacaactccactccagactcaactcctggagttaaatttaggagttggagctgtaccaaacaggccctgagagggaaagggaagaagagagagaagggagagggatgtggggcccacttgggccccaacatttctaattttctttttgtgtaactaacatgtgggcccacgatttttattattttttctgtgatagaattgccacgaaagcgccacatcaatgccacgcgtaacgaagaccgagtcaaattaaccacgtggacgccacgtcagccaaaactgctctctaaaccgccgagggaccttatctttaccagttttgatagatgagggacctactgtatctggttttctggctgaatgacgaaaatcggattcgttgacgagttaagggacctcagatgaacttattcctttccagacttcagatccagatccaagttccaacccaacagctggcctattttcccaaggccgtcaaagctcgtaagcccaaaaggccacaagtctacgaaactaggccttttaccccgatctgacattccatcccatttggcccatgttgtcccagcccacagctccacacgtatgcaggcatgaaccaaacatttctccgggtacgcctcggtctcccgctgacaaattgcactattgcagggcatatctcctcacttgttcatctccagctctcctggcacactccaagcacaaccttctttcccgttctgcatccttccatcctcgccacctgcgatgatgggctcgggccgttccttgatggcgcctcgcctccccgcctcctcctattcctcgctgctggcgccgacgtcgtggtcgacgccggccgcgcgttctccgccgggggccgcgtctacgagaggagtgcagcgagctggaggagctgagcgccagcgtgcactggacgcatgtaccaccgaggcgaacggcggccgacgtcgcgttccgcgtgtccgcgctggcgatgatgaccagaacggcaccaacgtttttttctgcacttctggtcaggttgcaggatgccgaattgccgatgcccattgacgatgctcagagcaagtttaataatataacccactactagctaattcatacaatagttgcttattatactattaatacatggtctcacttgtcatacacacattacattttagagttcgtgctgcagctgggctacagatatgtagtctgctgctcttctctctctttctttattattttaaaatatgtttatagctggtttatagccttctattttacctattttacctgctctcagaatggtgaccgtgtagccgacggaccaccagtacaagttccagtcgaagcgaaccttaacggtcgtctttggtggcatcagcagggcagaaacccgagacagagagacagaaacaccacgttttagcacgtaaacgcaataacgaagttgctgaattttgtgctctcagttctcacaggtagcatcactggactgtctcattcaccgagtagctatctcaaaagcatcgatattgtggagtactgaagagttgctagggggaaatgtcaatacgcgcgattcagagcacgactgtttccgaaggtcaggccgacccccccatccggcggctccgattagtggtgaaaacggtacgaaaatttttaagattttcggctgccgtttccaatgaccatttcagtcagtattggttaccgtccgtgttagaaatggcaacggtaatatcttccggaaataggatgaaggtttttctgaccgttttatcgataaccgtatttgtatggtaattttcgtcaaaattctaaaagttccatagcgactcaaccaatcaaacatatcggaagcctatgaatgaaggaagcctagcaggtttgtagcacattagaaaggggaagtgaccaaaggaaaacgctgttaacgctagggcatggcatgtggacgttgctgaactttggtctactcaacttatcggtgttgagatattgttaaattttgtttatattgttgatcaaacttattattatatcattaattatcatataacggtgttatgtgaagtgtgatgatgcaagaatgaagttataaagtcatcttcgtacataattaaatgtgtattaggccacacttttctgattctgacatgaattttcgacttccgaccaatgtcggttgattccgtttcgacggtcccatttccgatatactgatatcgttactgtttttgaatcttcgaatctactgttccgattctgttttcgagaaaaaaatgaaaatgaaaatagtatatggtttttctgaccgctctcatccctgctccgattatgtaaccacagcattggcattttggcaggcgccatggagatagaaccaagcgatggaaacaccatcgtttacctcgccagtcgccagtatgacgcattgacgccgacggaacagagcgccccaagcccccccaacccacagcattcagaactccatggatgggtttgtccttgagattttcaccttgaccgtttgcttcaagaagagtggaaaaggctccaaccaaggtggctccatggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttt

SEQ ID NO: 22209 - DNA, 1395 bp, Oryza sativa
catccttctaattttaaccaaacttccaattttaatgtgaactaaacacagccgtattctaacaatcctgattattttttaaagtataataatctgcatctgttattatgtgtatgtgcaatttcagtccagtttctcgtatgtttggtctattgtgatcaaacggatatggcttcctatgtagacaaggaacagtacctcaaagcaatcgaggcttgtttggatcaatgccaatacctatcctcacaaaaaacttacgcaggggcaatgtttggaagttaccaaaattttgataattgtctggactaagatccatacaaatcattggttgaaatagactggtagctgcgcttggcacaagagcaagtcttatggaaaaggtagatttcacccctaattttattcatgtagactattcatcaattaaaagatagcatatacaataaatcacacatatattaattgtagtgcactaaccctaatagttttattttatttgtttgatcaatcttctcttccttttttttcccttttttattataatttatgtgaaggttaccccttataggaggggtgactatttctctcttctcttctctccagctcatcatacgagtgtatgtggcatcttggagtaaatgtttagatgcccatagcacttgctctaggcccattcatagcgcctcctactcataagaggagccccggaaagccatgtaggctagggctacgggtctaaattttgagttctttacgatgcaagtggctctaggagtggctataattctatatttcagctccccaacatcttttgttttagttctcattttttttcaatttgtatggaggtccaaaatttacactaaacaccctaaaatctaaaaaaaattatattaaaacccctctctcccttatcctcacccccctccccggcatgcccacctccttcggttaccacgagcccatggcgccctcctctcctctcctcatgtcgcggcggtagtcaaggagattgggggcacgatggcggtcgaggaggctgaggcggcgacgaagccaccaagcggacgatgacaacaagctcaggggtgcgtgacccctcccgaccgacgatgaggagatggagcccctcagaaggcgacgacctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtggacagtgtgtccggtgagcttcagccagcaacgcggattgaagtggagaggacggtggggaagaagaagaagagaaaggggtcgacgtggacaagctca

SEQ ID NO: 22210 - DNA, 5048 bp, Oryza sativa
cttgttttccgcactcacgttttccgaactactaaacggtatgtttttttataaaaaaaaactatataaaaggtgcttaaaataatattaattaaaatttcaaatttaaaataattaatactcaattaatcgtgtgctaatggtttagcgtgttttatgtattttcttaatcttatacaatcattctctctccaacacttcctatttagtccttttgggatatgctaacagaatctgtgttttttttcaagtacaattcctcttgtattcgtactaagggagcattcgttttggaagaattttaacacataggaatagggaaggtggaggaataggaatgtatgcacacttcgatccatagaaattttcttagaggtttgagtagatggaaaatttccacgaaaaattttcgttggttttcctatacatacatttctataaacctaatgacactaataggaatccaaatactttgattttcctcaaaaaacgaataggccctaaaacaagtaattcaaaacgtgggtaaaagaattatcaacagttcaaaatatacgaaaaatagttaggtggagcgccttgcacgtataggtagcagaaagtcataatgtaacctaaaagttatggtgacgtttccgtgatgaagaagccaggaagcagatttatagaagcagaaatcatgaactaatttctagagcaagtacatatatgccatgtccttaaggattaactacctaaaaagggtactccgtccacatgaggcccaaagctactttccaaaagacaacgaacagaaaggcacgaaccacatgccatgctatgaaaggctacattaaactaaaccaacaggcaacagcagaacagctatatataagctttacagcaaatatacaatgcacaaattggaataatcaaacccaaagttctattttaaaacgaacagaagcatatacatatggcaaatcaaggtagaacaaataagtatgcacttttggtggctttatttctgggagccaactgcaaagataggatcggcgtccccgaatagtttcactagtaagtcaagcagatctctagtatacaaatggaattggttaaaaagggaatgaaaacaagcgagctaatgtagccataaatgggcaagataataaagcattcctttggtatacaagtttgtccatatgacaggattccagcttatgttggaacactctaagtatgtgccgcaatcaccactgcacatctcattcaaaaaccaagacctaatacatgtaggaattaaactaaaatctgaaaccttcacaaaacgtttgtattcgctcctctagcatggtggtgtccataaaccacacctctggttagctagaaacaattaactaacccgtatattaacctgatatcaccaattcatagtcatgcacctgaatacctgatataatgcttctttcatctatcccaagtcatatatgaatataatagtactctcgctaggaagtgatacctgcaaaaagattcaataaaaccattgtgagaaagaaatgttgtagatatcttcaacagggggtttcactgattgaagatataaagcagccttatttacttcaccaatcgcagatcatgtgttaaattactggtaaatataaaacattatactgaaatcaagtactgtatttgatttattccaaaacatattcataccgctctaagcttaacaaatgcatgccattccagaaattgagacgattcctaacacaatttgtacaactaatttctgccgacaactgcactatatttatattacttacaaatgatttcatgcatcccatctgataatcaaagtttcaaaagtttgattgcacttatgtataaacatgtatttgtgactggaatgagcagtagatactcaatttgatgataataacatacatgaggcaagggggccatacaccacactgaaatttagacttggaccaactgaatgatttagtgatgacgatgaattgggctaccagtaagcataattgtccaaattaacaaccaaaacattacagctccataaaagtatctgcgcaggataggtagatgactcgcgtccgagttaattaaactataggaccaaagttcttttcaattttctataaaaggaccatgtagaaccacgtgtattacaaaagggcagcttatcacactagcgtacaatcaaatgcttcatccactgctcatttttaaaaagtgcacaactgactaactacagaggcgctaccgctttcctagtgatgtaggtcgtattgcccccattctgttcatttccatacaaataattcagatgcataaattaacaaatgcaacaccttattaggtttgatgtgaagtggaatgaggtcaatatgagccaactggcacccacatgcatccataaaatttaccaaaccatctaagacatgattattttattttaacaaatggttaacctattgccacgtttttaacacacgcagaggcaagacaagagtatcacagttcaaattgacaaattagctgtggcaagagattactacgagattaggtcctcagctaatacaaatgtttcaaaattctgtggtgacatgtaaatagagatcagcaatagcatatgttgatttgtccaagtgtagtgctcaactctcattaagtattaagttcgggcaacgaatgaaggaatcttgtattgaacaaaggcatctagaatctagataaacaccaaagtgtggattgagaaatcaaattacattttaggcatagatttaagaaaatatagaaagcataataatagatatagaatgtggattgcttttgtgctcatgcaaaatttagccattatcaggtcctaactcctaaggctaaattttgctggattggaaactcccaagaaaggtctttttttatatatggtatcaccagtctacttgagtatactccctccggttccaaatataggtcgcattatagttctttactcttcattaaatataagtcactatagccacttgtcccgtggatttttcctcttatgtccttgctaattgaatgccactactctcgtgaacaaatgaggtattttttccaatgtttaataacaatagggcaacgaggtcactttaacactttctaattcctgtgcacaactctaaaacaacctacattcagaaccggaggggagtatatgatttatttgcttcattaatggctaagtaagtgagaaagcattgatttggttataaagaaatagggaatatgtgtttagctcagcaaaatgttgaagtgattactgacctctgcttgtctgattattattaacagtatagttgcccatgtaacttgctggtatgtttgatttgatatctggatcaacatttccaaggtcattaccaaaaggaggcatatcaatctcagatgacgtgaacctccaagttgagtctccataaatggagctgctgccatatgtatctgcattgttcacttcatatgcattgggtggtgcagagaagggttcaccaatggtaccagttgcattgctccttccatagctgccagaaggcaagccaaaactgtctccagctccacggccaaggttagccagcccaaggcttgaaatgttgcccattccatggccaggagtaggccctccccaattaataccgtcactggtaatacccatttgacctccagttccagatggtgcaaaagaactcatgtttgtggggttgtttgggtagttcagattttcattaccccaaacattccttgacattgaactcaatagtgatcctgaatcatcattaagaccaacataaccaataggactacctaatctgtttgaactaccattgtagaatgaacctatctgccgcccattggagttattgacaaaactagaattggcgccaaaattcgcattcatcccagattcagaattcatgcccattccataaccagggccaaatgaagagaatccattccgtgcgcctgtaagcagaccataccttccatcaaccctcatgccataacctccaatagggtttgggttataaccctggttgaaaccattcaagaagctatggaccctgctcatagcatagttctgccctcccgcaggtgaacgtgcagcaggtccaggtgattgctcctttggaacagctctcttgacctcaaccatcttaccattcagctcatggaagttcttgtgcagtgccttgtccaccgcatcttctgagtcataggtgatgaatccaaagcccctaggcctctgcgtgttgtggtcgtacatgacaaccacatccgtaatcacaccaaattgctcaaaataccttctaaattcaacctcagtaacattagaggccaagcctccaacaaagatctttctagtacggcctggtccaggtgaccctatgctgctgccattgttcttgctggtgatgctctggtcgtccctgggaacagctttcttcgcttccacctgaatcggtatgcacaattgagctcagacaatgaacagccgcactaggacagaattgccaccgaaatgcacaatacttcactagcagaggaaagagcagggggggggggggggggtcaggtcaccacatgatttaccatgcgcccgtcgatcatgtgcttatccatggtgacccgctcggcgacgcctgcgtcggtgaagaccacgaagccgaacccacgggcgcggccggtgttgcggtcccgcatgatgacggcctcggtgacctccccgaaccggctgaagtactcgcggaggcggtcctcgtccgtctcccacgagatgccgccgacgaagagcttcccggagtccgcctccatcgcgtcctcccctcccctcctccccctgcaatccacaaacgcaagcccaattgataccagccagccatagcaaatgcggacaaaaccccgacttatccacaacgccaccacaaaaacgcatgcgcccgcgcgcgcaggacgcacatcagctagatccgagctgaaagcaacgccgcgatcgggggccgcaccca

SEQ ID NO: 22211 - DNA, 7843 bp, Oryza sativa
tggttgttttgggttttttacttttttgcggggagaggccaaacttttttattcggcctccggaaccctgcaattgcggtgctcgcctcgattgggaaagcgggggaggagggtggggggacgcggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggaggaggaggtgacgccgcggcgcgcgcacggctgtggtggggtgttgggtttgcggcgagcctgcggcgggagtggggccagtagcagtgtgggggcccaccaggcagtgaataggagtaggagtatactgtatactcctccaggagtttagtacgctacagaagggggttggttttgttttcctggaatagggagagaggtgaggacgtggagggatgtccgcttgaacaagctccccgcggacaggacgacggcctgcacgtttaaattgcgtgggacaacgaaaaagtggggatttttttgaggatttgaacggtaaatacaaatgtttagctccatttggaactttcaaaataagtttgcagatggatatgagattactcagtcggagatactccgtagatgagaaaattatgtatataccataaactgtaactagctgggtggtcggcgcaattgcgtggctagcacccaaacaaaatcatatatttttttagtatgattttacttaaaatttattaaatagctatctcactgtcttaagactttgaaagaccaaaccttatcaccctcgtgtttctaattataaagtttttaaaagtcacaccagttgctaccccttatgtcatctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgaatgcacacacgcacaccctacccctatgagcacctccgaaagactgggccggcatatcttgacatccctccttttaatcgtcattaggattctattggtgttttattaacaatttttatacgtcgtctcaaccgccaccactctactcctttgtaggcctgttacttaatttatctcgtcatgtattttagatggtcttattttttaatagtctttatttttatcacaaattttagttatttataaattatattcctaattgaaatcttatttttctttttctaatttcataatttattttttaaaaaaattagttaataccgcattgtgtactttttaatgtttttattttttatttccaattttagttgttttaaaattgtattcctacatgaactctgttttaatttttctaattttggatattattttattttttatttgaaattttaattaatctcgtattgggttcttatatggattcttctttcaatattgcttatttttaattccaaatttcagctaattttaaattgtatgtctacttaaactcttcttttgttttcttttgctaatttcggatttatttttatttttattccgaattttaattaatctcgtattgggttcttatatggactcttcttttaatattccttatttttaattccgaatttcaactatttttaaattttattcctacttggactctcctttccttttctaatttattttttttatttttattttgaattttgactaatctcgtattgggttcttaaatggaaacttcttttaatattgcttatttttaattccgaatttcagctattcttaaattgtattcctacttggactctccttttctttctaattttggattttattttatttttatttcgaattttgattaatctcgtattgggttcttagatgaaaaattctttcaatatttcttatttttaattctgaatttcagttatttttagattgtatttctacctggactctcctttccttttctaattttggattttattttatttttattttgaattttgattaaactcgtattgggtttttatatggaaacttttttcaatattgcttatttttaattccgaatttcagctatttttaaattggacttctacttggactcttctttttctttttttctttttcttcgattaatgtaagaatttctagccccacagcgaacgtggtgcctcttttcaaagctgttttagtaatataatagatagatgccatcatcaggtttgctaaaattccactatcaattcatgggtgttcgatacaatgttattttcatccttttaagtatttgcatatcgttttgactctatttctcactacccatggctccatgttttctctcttctcgaaaactggtcatctcgtcattgttttcccaacgagctgaggtaggagtgtgtggcccactagtgcaccgcatcccgctattccgtagccgcatcggcaccccgcctcagcatccatcgaagtccgccgtgtcgtggaggcggctcatgctcccctgtcgtcaagctgggacgcatcctcctacgggggtgcatcctccagagcggggttgagcagtgactagcgggcggcacaggggtgagcggccaggcatgccggggcggcaagttgtcctgggtggtcgagtctggcgcttgggcggcggggacgtcaaggaatccttgcatcactctctgctgagccgcttgccacctctgcctcctagttcgccactcgcattcatcgtcgtctcatcgtttcctcaatcaatttaatgttgctcctttttgtttcttgcctcgatgacggtggttgattcctctccactgttgcctcgacgtggtaggacttctttttttcttttgggtcttcggaggaggtgtgtggatctttcgacccaacgatcccttccatccatgggcttgttgcggcagcggtgaggtggggcggtgttggcgtgtacgtggctcgctgcctcagccaagagaggaagaaaaacgtgagaataacaagtttggttcgatggagaaaagaaaaaggaacaacctgtccaggtccaagggcaactccagtagaatacaactaaaaagagtgcaaaatcatttctatttatataataggatgaaaacaacattatacggaacgccctccgattgactatggcattttagcgaaatccactaagtgatggcattccagcgaatccactcttttacgatggtgcatatgcaaattttcgtggatagactgcatcaattagttcccctcccggcagggagactcttgcctataatcgcaaagtaatatgctattatttccaaataagtgttaattcaactttatcaccaacaactcttattaaaatggttaaattaagaggatgggagttttaagtttttcatagcttgaaacaaagtgcgggattatccactattaaaaaaatgaaagttttatgtttatgattatgaattagtataatgctacacactttggtattattgtatcctttgaagtatttatttttctaaaaaaacaagtgaatggtcaaattttgaggattagtgttgttaggtgacaattactttaaaacaaattaagtatttgtactccttgttcccattctcttcaaattaaaaacagagccactaccattttttgtctttaaggtatataatgtaggaaaaaaagaacatttagtttaatttgaaatattttaacaaatgagagagctaatgatccgcatataaaaatggtcatgtttaaaggagcttctagcaactacgattttatagagtcttagactccaccaaactatccgcattattatccaagattctaataatatatagtagtaatagagtacacaaaaaattaacaaaagaacagaagttgagaaatccagctcttctacattttcaccatatgcttctcaaaaagtcaaaatttgagctccccgaagctcgcgaattggtcactcatgacatcacgtgattccacccatcctcctggatgcgcaattctctgcctcccagctcgctactcgcacattagtacaacacaccgagcatcaccttcctcactgcttctagcttgtcgaagaagtgcgcctcctagctcgcccacctctattgagcttcactgcctcggcttcgcagctctgttatgctcagttgcgtctccttctctcaacaggccggcctaccactgtctcacactccctaactcgttgtcaacgagttccgaccttatttccctacatgtatgccccctctccttcacctgggtccccgaccgggttccgaggacccatcggggttagggatggggcctggttttccttgatgtgccccgttgtcaccactaaatgagatgcttagtagagaatttaagttatttaaaatttaaaatttgactactacagagactaaaaagaatattttctctctatcttagtttttttttctaaatacttatatgataaaatgaaggggagtacaggcatatgtatgcagtgttcttgtttgtgccatgacgatgttaccaataatgctggtggtgagagaacgcatagtatatccagcttgagaccgttgtaacttacctgtcccacaaatcgacttaacaacaataactgagtaagcatgtgatgcgctaacttcgtaatgtatcataattagattatagtacaagaaggggtgtaagggcctatttgattcagcagtttttgtacgctttccgaattacgaaataatgtttttcgtaaaaaatttatataccaaagtttcttttagaatcaatttttttaaaaaaattataatactttattcttaattaatcatatgtgttactgattcgcttatttttcttgcttacgaagccgacatctcaatttaatgcggctaatgtaaatgatactatatgttaattaatgcgttcattttggtgccaagagttattcacggtgaacaaaagtgtggaatttgttgttggagggcctcttattatgaagagagaacctattccatgtcatggagtttcccctagttcaacaatttgccagtgtttctcctttctataatataccattaggctgtgttcggctcttctagttcccatcatctcctccctagttttccatgcgcacgcttcccaaactactaagcgttgtattttttgcaaaaaatttttgtggaaagttactttaaaaaatcatactaacccattttaaaattttttagctaatacttaactaatcgtgcactaatccatcgctccattttccgtgctggagagaacccttacctaagaacaccgcctaagtccatgaacaatattctagctattcaaccacgtacctttttaaaatttcccaaaatgcccttacatatgttaatatgtattatgaataattgattgaccggctaaaagttccaaaagattatggacatttttgtgtagtctctttgcatgacatataagtggttgatttacattaaaaacaaggaaaaaaatccaaataaccccataaactttggatagaaatccgtctagcaccctgaactttgaaaccggatattcaacccctaaactttgcaatgccgtttatacccctaaggtagttttgaaaatttgtatgtaagttagatgggtttgaccacatgacccacacgttagacatatatattaaaatttcgacttaaatctatcttttactctattagctttcacttacaaataagtaccaatataataatagtataatctcactatataaggataaattgataagttataactgattacaaataagtaccaacataataatagtataatctcactatataaggataaattgataacttataactgatgatttgcaaatatgttttattagttattcaaagttgttcgtttaagcttccaaaaaatatgcaaaaccaccatataaagccactttaggaatatgcaaaaccaccatctaggggtgaaaacgggtcgtgttcggtcagaccttacccttcccatatcctaacccatattttataatcggaatcgggtcggacacagatagtgctgaatacggatacaaactcagataatgtcgggcaaaaatacggaacgaatacgtaccaaaatggatacgtacactatctcggttacaaatatttattcggatatcaagtcgaagcaataatcttatatatcacatagacaataactattcaacaattccatatatccataatacgattatattaggctattaggacctttgaaaataaatagggtacaatacatcatagtagaatcaatatattgtaccaaaaagtgcctcacaaaaacataataggggtaagagatccgtataactatccgggtaatacccggattttttaccggataatctaaatccgttgaatactacgttcccgaacatgatcttgtatccgtcaaaaaatacctattcggacccgatatccgtgaaaagtcccgggtacccgaatttgtcctgaaataatgtgatcacggacgggcgggcgggaaatacccgccccgttttcacccctaccaccatctaaaaccactttaagagggtaatatggacagtacagtgaagttttgggggttgaatatccggttttaaagtgtagagtgtagacaaacttctatccaaagtttagcggggtatttgtactttcctaaaaacaacaacaaagaatattctatatagcatatgacatacacacacatatataatattttataaaaataaggtagtgatcgaaaaaccttccaacttactccctcagtcccaaaaaaagacaaaccttgggtttccgtgtccaacgtttgaccgtccgtcttatttaaaaaaattatgaaaaaaataaaaaaagacaagtcacacaaagtattaatcatgttttatcatctaacaataataaaaatactaattataaaaaaatttcatataagacggagagtcaaaagttggacacggaaacctagggtttgtcttttttttggacggagggagtaggga

SEQ ID NO: 22212 - DNA, 4573 bp, Oryza sativa
aacactgataaactaagactaggttgactgtaaatgacgtgtcagattttagagctactagtagttggctatattattaaacttgctcttagctatttcatttctcataagagttaaatttagaagaggactataagtgggtcccatcaaataataaaaacaatatattagatattccctccgtttcataatgtaagtcattttagcatttcccacatttgtattgatgctaatgaatatagacatatatatatctatctagattcattagcatcaatatgaatattggaaatgctacaatgacttacattgtgaaacggaggaagtatctcatatgcatagagagagagcgtaaggagagaagtgagagattattattttatcccttatggctaccgatatgcatatggagagagaacttactatttatcatcctctcaaatatatttttcatttccgtttgtcagctgggcccacgtgttagcccccttctcattcgttgagtttgtggacccgtgtggacccagaaaggaggctaacatatagctatggactaccaataaactatatgcggtttatgctatctactattattacattgtggatgtcctaagaggtgatttgtgtattaacagtgtagtaggctattagatttgttgtaaatgatatattaaattttacataataattaattatactattaaatatctactctatagttcaacaaatactttcactcattcttccgttctttcattcatcgctcaaggttcagatcatccgcctaaaatccgaacggtccagatcgatcctgcctccacccccctcaatcagcgcaccgctcccgcacctccgccctccgccagaacaccgctcccgcacctccgccatcaccgctccgctccgtatcagccgccgcgccgtcctctgcatcgcctgtcctccgccaccccgccgcacgaggtgctcccgtcgccaggtagccgccgcgccgtcatctgcatcgcctgtctccaccgatcccctccgcacgaggtgctcccgtcgccaggtcgccgccgacgccttccgcggtgatccgatctgccatcgaatccccgccgccggctcgtcctccaagatccccatcggcctgtcctccgcctcctcgccgcacgaattcctcacgtcgccaggtcgccgccaccgatctgctccaccgatccccgccgcacgaggtgctcccgtcgccaggtcgccgccgacgccttccgcggtgatccgatccccgtcgcctgtccgcggtgatcagaaatttcatcgcagcgcctccgccagggcagagcagttgagaaggtatgggcgtctgatccaaaatcccagacatataccatgtgatgttgcaacccactgaaatcccagatagaccttgaacactcaagattgacatcaccacctcttgaatgttacaccatttacttttatgcaatattatacaagcagttgcaaacgacggccattccgttaatcttgtgatcataattgttatgacacccacacagtcttttgtttctatataagaagatcaatgacatattcatctgtcatggcaggtagaatctccaattcaaggggctctgcgccttgttcctcaacaagagaaggtgaattttccaactgcaactgcaaatctttcatcaggctgtcaagtaaacatttgtactggattgaagctgcacctacattatcctgttgcctggcatattcgtgtgtttacatggggttgaggtagccagtgttgatatagatatatgcaaactagactcgaggatgctgaacatgtttttttttttacagttagttcagaaatatttaggtttcagcattgaacgaggttgggtttttcttcccattgaacaaaaggcatctgattacaatttttctaaaaaaaattatttaggaagttctttgctttttttttcctcaacaagaaaagatggttagcattgagtcataaacttagaggtacaagttgctcaactgctaaggtctgttttatacaggtataatggcaggagaaatgtcaccaaaagaaaattctttctgttgattcacattattttccagttaaatgcgttcatcatttacccatttatttggatcacgtgcattgtcatttgctgtaatttactcatgtcccctaggtaactatattaaacctaccatctttccgaattgaacctgtttcatgtgtagttttcagtggtcacctgttggttgcttccattatatcacacagatttccaatctgactggtaatattgtgagatcatttttttttgtgtgtcatgttctttttatcagatgtgtcattgctgtacagaattaatatataattctcatgtgaacccgttggttgttgttcttttattagttgtgaatttactaaagaaaacatccaaactgaatgacgttggttactgccaaactgagatcaagaaatacatctactccagtagatgataagtccacctattggttcaatttaaaaaatctgaatttggcaaatttaagaaattggttcaatgtacgagcagcatcatatttcaattactgacatactcgactgcaaaactatttcagggctaaactgaattggagaaagatgttccgaagtactgtgataagaattcaaatagtgtgaagtgcaggaaaccaaggaggtatcgcttactactaattcgctcttcaacataacctggtgcttatatattggcatggttttgtacaatatatagtaatcaagattcaataatccgagtatagaagaaaccttgctgcacaaccatattgtggtgtattataacatttaaattataatattgtttggcgacatgatagttaattgtacccatcattcacgtggtcgaatctgctcttgagttattcttttagtcctgagtttaaacatggtgaggggaatgtaaatgcagtggaggaaatcgtgtatttaacattgccaaattcaggtgccattggcgattaacatcctatgttttatttggtgcgacattaattttgtctagccacttacgatgtgaaaaaagagttaacaatgtaattcagctgtcaaggttatttcggtcgtcctaacgtgtcttgtgatcctaattgttagaggataggtcctttttttattacttggttttaaatgactccgtaccgttaggcagtttggattcatcattttgcatatcagccataataagctttaggctcctatttcagaacatttcaccttgattggatagatgttttgagttttatatgaaatgccactgttcttcgagaatttgcctcaaattaactgctaagtttgggttgtacatgtaccgctccaaatataactattttcctattagtaattataaaattattctcttgattctctgatgcctcgaaatattaattagtattttgcaccccgcaatttccaacagggatccagtccctgttcgctgccgcccctcatctccgcatccacgccgccagatcgccgtcgctcggattctggtacataacgtcgccaatctgctctccgctgcacaactccattgcatctctcgccagtctgctccgccaacacgctgttccacctcctccgcctcaagcgccaccacgaccaacacaaatcccctacgccagttaatttttaaaaaacattgaggtacatatcaaattaatttttattatgtagtcatgtgctcatactacatactcatcaaaaatacataaaatgtaaattaggtgcgcatggacgcaaatcgggaggacggtggagctcgcaaatccctcggagatataacaaaccaccgtcaaggtgtacatataatggatagttcgttgtgtacaacgcaggtcttgtccttttcagtatgactatagtgttaataaaaaaatgcaggtcatgtggatcaatttgggctatccaatgagtctcagcgtaaaaaggaaagaaacttcaaacaacgtatatatcgtgcaaatctggaggctaagaagaaatgtagtacaagtcctatgcaaacaacgcatgtgtcagagtatgaagaatgtgatagtgccgaggtcaatgttgctgaaattgccacctcaacaaagagggaaaaaaataacagctatctacgtgagtggcgtgcaagaaatagagcaaagtcgagtgttgttaatagcactgtaacatccgtcaatccaactcaagcaacaactacatctgaaataaaccagagtgaagggggtgtggtagggacaagtgaactttctgcaaagaaaaagagagaggatacaaacaagtatcttcgtgaatggcgtgcaagaaagaaggccaaatcaacagatggatgcaatactgtatcttctggcacgccaatgcagtcaactattatgacccccgaagaacacaatgaagatggtgctgttcagcgatcttcaatctaccctatagttaaacaaatactttcactcattctttcattcatcactcaacgtccagattatccccaagagatctaacgtccgggatagcatccgcctt

SEQ ID NO: 22213 - DNA, 2978 bp, Oryza sativa
tctcctccgtgccgcccccaatctccggctcgtcgactgtctccgtgcaaccaccaatctctgctttcagaacagtgtcgccccatcctcgatctgattcgccgaaattaaggtacagaaatcatcctccctccttttttttaatccacaatccagtactatatatatttcctctccccccatcagtcgccgctgatttgatcatacgattcttaatataatccagaatcaatcaaaagaaaaaaaaaccgaaagcatcgttttggtatctaaagaattcatgtttttagataatgataactaaagtatctatgtctatgaacaacgcataactgtctgcacatgtctaaacatctccaaagaacaatagtatctggttatttaagattttacacatttcagaagtcaaaccttaaaattcgattttcactggcaatgacagaatatttaagatgatgcaccatctatgtcaattatcagtatagtagagattcattccttgattaatgaaatcaccatcaccatgcatatgttaggacaatccaattgtttctggattcttgacagatttggtcaagatgaacttatgacttcagtaagcttttgactaattctgtaccaagatggttcatttttaagcaaagtgcaataagcttcatgaaacattgcaccaccgtaatcttcctcatgattttcttattttgctgtataggattagggattattgatacaacatccggcaacctccacctcggggggccacaccggcgccgccgaagcccaccctcgacatctccgtgccgccaccgaccgtcgaggacaacaccagtgacaccacgccgatctcctccgtggccactacccaccggcgctgccacacgcaccgccaccaccacattgctgcggcgtctcccaacccatgttcgtctcatctccaccgtctatccccaaactgtatgaaagcattggtaaaaagaaaagaatataagataaaattttacaattttaaagcatgaatacaaatggaagggtggtttttctttagtttgaatccttcttacaactggaagtgtaggactacttagggaaaacatttttttctctataaatgcggtgctgcttcatttactttggtattatcggatgattcatttcaggagactgcataatgtttgcataacattcattattccaatgcaaaacaattatgttaatattaaaactcatggtaggttcctggtccaggttagaataccaatttgcaaaccggaaaaaaaacatgaacatgtttataagccatagcccttatccgtacatagaaacttttcttgaggtcttctgtgtcacatatatcattacatgcaaacaacaaaaggtaacctccagtcttccagtattattttgctccatagcgaattagccatctactcatatttgccttgtacttatggataaccgtgagatgttcaggtggatcaaaccagaaccgtggtttcaaggtcagtttctaaacctcaagtagcagaaaagttggtttcttatattacaatgtaaattattttatttattgtaggatcagtttccatatgctataaccatgggagctctctcagttcgcctaagttgtttgtctagaagtatgtcactgctttggttcatcaattcttttgtcagttcattggcagtagtactttggatgacaatgagattggcttggaaaaattctgcctttgagtaggcagcccagaacagatttcccctgcaatgtattagggatcacaaataatcacgcacgcgggatcaccgctcggtttcctttcccctccgtcaaatcgccaaccactgcagcctctctcccgcacctcctccagatcgcaaataatgctttattttgttcccgcaacaaataataaaataacttacttttttaacataatagcgtattatatactgaagtgattatataaacttaattcttgtaaagatttattgtgcccatgcaatatcatattattttattttacgttaaataagtatatttaatgtacgacatgaattgaattaaagttcaaatacacatatcatataaaaaaatttccgctaacatgaaattttaataattattaaagacaaatagaattgcaccgtaacgtttagcacggacatattactagtaatctattaaaatacaaatctaacctgccaactattatagctcgccggcataatagtaggtttgctgaattccacgtctgcgcctatccatctttttcttcggattgagaccacgtattcagcatcagcaatgctaggaaaattcaacgctgggcttttcttgagagggacagcatccgttgcaaatttttgttgtaaactacaccctctcaaatatgtgcaaaattctgaaagcaacttctaaccatctaaccattgtgaaatgaaaaaaaaacaaaaccaaaatattttaaccacgcaatgtaattttacttccagtacatatttttaacatatcaaacattcttattattgtttaggacaacagtacctttgggataaggagagagaaactccaataccataatgtgtgataaatctctgttttatgggttcgatatacaagtggtacatctctatcgtttgaaagggacatatacaagaagatttttgtattttcctagtcttttgcctaatgagttcttagcaggccacccttttgggcccaatattgtaagaggtccattacaaagaattagggcaatcttacatggctaacttctatggtcttcgccacttctgatggtatcatcggagacggcgtttctcgtcacttccacgtaggatcacgggcgggcttgttcactttgctactatttacaatcttattttttttcttggtaaagttacctaaaataatagctacatttaatttgttgctaaattttaataagtacatatgaaatcttgctaaaatttgacaa

SEQ ID NO: 22214 - DNA, 9212 bp, Oryza sativa
ttagttccctcccatcagaaacaacttttttgaaggaaaataaacctttttaataccgatgaactatacagatattcagaattttcgacctaagaaaaagtgctgaccaggccacctgacagtaactacaaactactcttcaattcttcagcattgccagcaacagcaatatgtacagactacatagtaccctgctcacatactactaccacactactactcgtagccaaggttcacagttcatcaaacctttggtatgggttaccgtcacccgcagtttgacggttaccatggtaaccacgtggttatcgtgaaaaccacatggtcacgtgataacccagtaaccgtacggttttgtaaacatagcagggtttacagtatgatctgcaatttcttttccacgtgtgtagtaaaaatgtctcgtcatttttttacctctcgctcagtccctcgctgcgtgcttcgttctacaggccactgagctgagctgctctgcacttgccctgcacttgctctgcttccccctcgacgtcgacgacgacgacgacgacctgctccctctcccgaacacggccagcctcgcgaagatgcgcaggatcctactcgcgcaccgccgctgcgatccccaccgcatggagccaatgcagctgctggaggacaccggcgctcgccgcctgaccgccgccgccgccgccggcgtggccgccgtgtccatcctgaagctcgcctccttccgggacgagctcttcttcacggtgttgtgccgctgcagcgtctgcttcaggggggatctcctgctccagcgcctggatcctaaagctcgccgtctcgtagcccgacgccgcgtcgtcgtcgtcgtcgccggcgcgggcgcggaccagcttcctgccgtcccgcgtggcgtgggcggtgtccgtgtacgggctgctggtgctgagcggctggctggtggggacggcggtggtgcacccggggctcggggtgtacgcggtggcggcggcggcgccgccggagacggggacgaggagctcccccgagtgcatgcaccggaacgagtcggagcactcggtgaaggcgcggtgcgtgtgcagctgctgcacgaacagcgcctgcacgatcagccggagcggcatccggtcgttctgcaccgcctggatgcacgcctcgtgcgacagcttccggcattcgaggtggccgcacagcgacgccttctcgtcgccggacaagccgggatgctcctgcaatggcagaatcaaacagcttcacaacgttagcgcgacagcttaacggactaaataatctcgtgcacgcacgagtgctctgctcgatcgtctttaccacgatgtatgtgtcgattgcttcgtagagatggtcgtgggatttccggtcgccggccggaacgacgccgatgagctcggccagccggtccggccggagcttcgggtcaccgacgatctgggcgatgtaccgatcccagagctccgcgacggcctccgcgcctcttctttgcattgagacatggctcgcgacgatgctctccatcgccctcacctccgggctgccggcgatggattggccgccggcgtcttgctctggctccggcagcgggaggtcgtccacgcgggcgaattgcaggttggacgcgaccagttcgcgcagcctcgtctggctctcgtcgctgagctcgagggtgatcgaccgcgccagcagcgcgaagtagaacgacaccgggatggcgccgccggtcgccgccgacgactcgagtgggaggaggtcgatcacgccctgcaggatcgcggtggccctcctgttggcgtcggtctcgccgtcgccggtgtccgtgctcgccatgaacttgtgcgtcttcttggagagcacccacttgttggcgtagaagagcacgacggggctgacgtacttctccttcatgccctgacgccggggcgccagcacgatccgcctgaagaactcgaaggggaaggcgacgaggtccttgatacaaaagtcgcgcgcagcgagctccttgactagctcggcgtaccaccggcgcccggcgaagccacgcgccacggcggcggcgaggaggcccggctggtcgcgctcgcgccgctgctcgtcgccgtcggggtcgaggatctccatgcacgccatgaacgccagcgactcgacgcagcggctgacgacaaggagctcctcggcgacggggagcagcggctggcatcgctgcaggacgatgagggcgtcgtcccagctctgcagcaccacctggttgatgtacaggtcgcagcgcgcgccgaggccggacacgtcgaggaactccgccgcgcaccgcaccgccgccacgttgaacgggtcgagcgccaccgcgtcgccgtagcagtacagcccgatcacctcgaacgcctcgctgccgccggggaagctcgccggcagctcgacgacctcgccgtcgccgtcgccgcaccggagaatcgcctgcctcaagtacccgcacctggacaccagaggatcctgcaacgacaagatcacacacactcatcaccatcttcttcctcctcatcccaaccaagaatccctaattaatcttcacacaatctctcctaaccttgtgcaggttgaagctcctgtcgccgacgtggacgctcaccgtcgccggcgaaccggtctccttggccctgcaatccaatccaatccagatcaacaaccaacccagccatcagaacccccaagggctccaaaattccaagctctaacactctgtaccatgaaacgaccctcctctgcaggagcaacgccgtgctcgggctcgagtaagggctaaacacggcggccttcgccgccgccggcgacatctgcacctccacctccacctccatctccggctccatccctcgcagattaccagtactagtagcagtagagactagagactagagagataggaggagtataaaaccggagtggtggagtgagggaggaaggaacatcgggaggagtggaaaaggggtacaatggctgagggcgcacgaatgggggacgttggagttgaaccccagttttaaggctgggaaatcggatcgccctccaccccctcgtgcaagtttccttattccctgggcgcgcgtgcgttctcctctgcactgcactgctctctcctcgccaccacagggcacagggaggcagccttgtaaagatccgagggagccagcactagtttaagcaaattaagctcgagctaacctgcctctaatggccggaatggcttatggcctcttcaggcaccatctggcctttggtatatgcacgtgttctggaaaaaaatacagtattttcatatgaatcagttcgattatcggagaaatcgagaaaaatttcatgtgtcacaaatggaggccacactttccatttggtgtgaatgtctaatgtgtgaaaagatgtgtgtatatattctcggttttgtaagtaattagtgtggtgtttccagtgtacagttgacgtctgattggggtgtccaaatttctcaccaaatggcagaaaactggatccttttgcgcctggggtcataccaagctttcagagctctgaacaggcagaacagccggtcattgttgtgtgctactcctaggcgtaaaacgtccaaggttagcaatctagcatcgccaaagcgaaggactgaaagagttgcttggaggtaacaatctccatataataactgccacgagactaagcatctcctatgattagactatctgtcctctgctaatctctctagatgggcttctttttcagagaaacttataatgaccaaatcgtacactatccggtagcataagttgggcagatagatgctcttccacacaacttttagattaaaagaaaacaagcgtgcacattgacgaacggacggagctctgaatatcatagtaggaagtatagtattatcaaactattaatcaaggtcactgtcagttcatttcaacgggcgtttcatcattcaccaggcatgcacgccagagactcccattcggactcggaactgtgaaatggtttctttaagcttcggtagcaagcaatggcagtgtggtcgccagaaaaccttgtttctcctgagtcctgacaattgcgttgccatgacaaattgacacctttgtattctcctgacgttcagaagtagctatcagattaaaaaaaaaggaacctaaaaaataagagaatatagcattcgtgtgattgcttagctgattagtgctgtaatttatgtgcgatcacactaccggcatggtcagcgcatttctgaatctaagttctgcaatggcaagattgccattgataaaggagaatgtcggtaataatcaaatcgttgacgtgcatcggacgctgcagaaggtggggaatttaagggcgtcaaatgccagtaatattttgctctggaatttggggggtatcgggaagccaatcccccacaattcttattctcattgatgcgttgaaaacttgaaatctcccgaattcttttcgtggctcgtgactgcatcgagatcggtggtgagaaatttttactggcgactcgatcgtgcttgggtttcagctcaacggagaaggagacgccgggtctgcaaggcttctcacgcccgtgactcacattttgatttttgatcgcattaaagcacccaagggcgtcgttgaaacggagagaaacaatgcaagagaggaatggacgaactctctccaattggcaaacgttacgtatcgaactgtcaatctcagagggtcagaggttaaagttaaaaaaaagaaagggttactctagattgatctggcgaaaggtttcgcccactgttttcgtcgtttcattgtatatgtttatagtgatagaattctatgtttataccattcccaggctctcatcggatggcccaataagccaaagaataagctaaattttgaattttcaaacttaattttaagattgattttaagatattttcaacgtattttttttcagcattggcttttaaattacaaagaacacatatataaaagttttacctacaaatttatttttattccctaataaaccgttttggcttattagaaaaaaagccaaccgatggggccgccaggtgcttggatgaaaataaagtttcacagtaggacatgtatgcttataattgaactactttttcatttttctctctctgttgttccataaattcatagtaaaattcgtaaaaaaaatcaaaatttataatggcaaaagagcaaaacgcttggacaaacaacaatcgatatttattacttgttcagttaacatttcacctcacttgagagttcatagcattaaatagcatgccaagtactataaaatttgcactacaattagtacaaagagatgcaagaacaagtaatggtacgaaatacaaccacaaagactccaacaaaactattttttcgctgggctgacaaagaatgccgaccgaacttgtattaaggagggagggggtaaaaatttatagactttgtaaatgctcagccaaaacacagaggatgaagcatatcgggcgtgagactgagatgcgaagcgagccctgtcataaaaccaaggcaaagtgcctgatgacctgggctcgtcggcacaatgctacacttcaggttaccaatctgttgtgctatgctaggcacctagtccagccatcttccatgtcctccgctcatcaattgtgcaatctgcgacctacagtaactagtgggtgaaggcttcaaagactcttgtgctcctttctttccagatcatccagcagaagaggcatatgaccgtgtcgaacacctggagactccaacaaaaatttatagtattgagacatgtttccaatgtgtctagacattaggtgattaattgggattgggtaataaaattgattagataggttcaactatgcactaggcgaacaacttctttaatggtgtcttagattacatggattagatacaacctattttgtgttgtatgtattgggacggctcttatagcccttcagaaaaaggaatgttttattttattcttcagtaatacaatatatagtcaattaccttatgtatttctcgcactgattgaatgagctctctcataactagaaatcttcgcaaaacatgcacttctcatgtaatttatcttttttcacaattatatggaagacgcacatgcacacatacaacacaaaatgcaacttattttataaggaaaaagtccaacttacccagtcaactattgtgatagtttggattacccgcgaactgcgaagccatacatttcacacccttcaacttttgacactagacaaattggtcggtcgacccgagataaaacacgcgacaatccaataagaaaaaaaaatcaaggaacccacatgtcatctatctcctttgtgtgtgtggaagcagttgcctctgcaacgtaggtaggtgccgcctggtgcagatcccatgctcttctcgaagcacacactaacccgtgcaaaagcttaccaccgacattgtagaatgtaaagctgcgtccgaatgtgaagccacctccaccactgcaaaagcttgtggaggtgacgatataggaactcaagctagctcggggaggcagatcttgccttcgctaagcacgtgctagaggtcgagaagtgggtggtggtctggttgaggcggatatcgtcagggcggagcttggtatgtggtgagcaggagacaacgatggtgagctctcctgttgaggtcgatgccgtcattgggcgagctattgaaaattggtgacaaggttggagaaggaggaagacgaagagagaaggtcagtggcgtggcgctgaaggtatcgatattgacacaagttgcaatggtggtggtcacctaggggatctggccacaacagagggagaggaggcatatctcgtcaccgtaggcctctacgttctaggtcaccggtgtcatggtgaggcttccttcgagtttcaagtacactgtcaatgcaacaagcccctacctccaagtctacttccataggctttttgtgagagagaaagagaaggttagagagagagaaagggaaagagaagaaatagacattgactgacatgtgggccactagatcttttttaatctagttgctgactggaataccacatcaggcaaattattgtcatatgtgtgtcatgtagggatcaaaatgctctgggttgtgttagggggtaatttgaccagattaaagagtttagggttcataatttatggttctttggtttgattggtggggaaggggaaggcgggataattcaaactgttgcaatagtttatggggtttgaacttttttttcctttttgtaaaacctttgaggacatctacccaagtcaattatcaatccagtcaaggattttatgtcattagtttccttgccattaaaatgcacttgtatgagtacacctagcgtcaataatactgtcttggttagtccaactacccaagtaaggtaaaggactttagttcccttaagattatgcccctccttagtctatatcaaccaaatttccttatagatacaactcataaaaaaagttgtgtataatcttgaaatgttccatgtatccatgacaacccaaggcaccctaccctaagatgtaggaggcctatttgggaagcccagaacccccgtgttcatccctgtggttggactgggagtctgggagcttgaacccttgtggatggatcggattaggattttaggcctcccaatcgagcccgtaaaaatcatttatatctgcctttagaatgcctacaattgaccaaagatactggaaaacacatactcctaggtgcgaacaagctgacatccagaaaattgaggataaacaaagatacagcaggataagtccttcagaatccataggtgcgaacaggctgagttcgaatgattcttcagcagatgcgatgccccacacacaacaccccatcacctaacgaacttgaccaagagcaccaaaatttgtggaatgtgcatggatacggcaatggcattgccactgtatccgatgtccaacggcaacatgataaccgcaagctctaccactactccacacaagcagaactgcagaagacatgtatgcgctttttggtggaaaatgctttccttcaactgaattgagctatccgtttgccagccgtctcctctctgtacaggttgtcggacagcctgtttgcaacggacgctacgtaccccgtcgtgtttcctgaggcttgaagcaaaaaaagagcagcgcaaaagaggaaaagggcccgagatatctcagatattgattgggtctcacgtctacatccatctgattttagtattgaactataaactccagcatccagctcatggaaatctcacacctttaatttacaaccatcctttgaaaggattgtgacacatttgacacgcaaagccaaagccaaatacagctcctcatcttccatttctttgaagctcatgaatcaaatcagtacaaaccaaagaacaaacagtacaataaatactacagtactagccactaattaaccacatccaaagctacaggctacagctcgagcgccggtgagacatgaacctataaacatttgctactcgctggagcttaattcgtttagaacgtttatttgtttccaatcgaattcacatacaataatttctagtactacccagctggttaacaggctagccgagcgtgccggtgctatcgtcgtcgtcgatgccggcgaagaaggggtcgcggaggagctcggcggcggagggccggttccggggctggccgatgcagcgctcgatgaaggcgcggagctcggggtccctgatgcgcttgagcgcggcgggggggacgccccgggtgacgctgtggtagatctgcacgacgctgtcgcactcggcgtagggcatctcccgcgtcaccatcttcagcacgcacatcccgtacgagtagatgtccaccgactccgtgtacgtctccgtgtacagctccggcgccatgaactccggcgtgcccaggatcgtgtgcgccacgtgggtcttgtccacgatcgccgccagcccgaggtccccgatcttgacctgcatccatccatcgaccgatccaggccgatcgagccgtcgtcgtcgtcagccacacgaccaatccaaactcgattcgcgagacag

SEQ ID NO: 22215 - DNA, 27945 bp, Oryza sativa
  unsure (1)..(27945): unsure at all n locations
nnnnnnnnnnnnnnnnnnnnnnnnnnnnnnnnnnnnnnnnnnnnnnnnnnnnnnnnnnnnnnnnnnntccctccaaccaccgtctaccaattcaaaatttgaataccatttcagttttcaaacatttcattttgaaaaagaaaaatggcagttcaaaggcctaattaagctattgctttgctcctaatatagtctagcagatcgaacgttatcatgattttgattgtaattaattctagccctaaatttttgggataggtgagcttgtcaaatctgctaatctgggaagaaactggatgcagtaatgaggggtgggggggaacctggccggtgttgccgttgatgaagacgttgctgcagttgaggtcgcggtggatgatgcaggggtcgtgggtgtggaggtggtcgagtccgaggaggatctggcgcgcccacttcttgagcgccttgacggagacgtggcggtggcggtcgcggtactcgcggaggctgccggaggtgcagacctcggtgatgaagttgagcacgccggcgtcgcggtcgagccagaccttgtggaagccgatgatgtgctcgtggtggagggagcggaggaggcgcacctcggcgtggaggcgctccaccatggccgggtcgcggtcggcgagcgcgcgcagccgcacgcggttccacgccacctcgatcccttcctcctggtcgaacccgcggtacaccttcttcacggagccgaggccgagcacgtcggcgtaccgcccgaaccgccccgtcgggtccacctcctcgaacgcctcctcctcctcccccgccgacgccgacaccgccatgcccccctgctcctcctccccccggcggacgccgctggtcgccctcgtcgtcgtcgtcgtcgcgcgccgcggcggagtcgggttggggggcatgcgttgcgtcgcgtcgcggcgcggcggggacgcggcggcgcgacccgaggcggggaaagtggggcgaggttagcagcagcggcgaaatcgggggcggcggctatttatacgcggagacaggcgtagtaggctgacgtggccgtgtgaacgcgtggtgcgtcgcggttgggccacccgcaggtaagcgcctgcaccaggcagagccggtataggagtacaagcctgtgacgtatttgtactcgtactacgtccgtatagcgctacggtctacggcggactggagggttgaccaagcttggtgggcccgcctcgccggtaggagcatgcgacacgtggcacggatgggccatggcccatgggagtatgggactcgatctggagttagttaagccgacggccagtgctctctaggaaggcgaaggtgaggtaggccgggtatggtgcaggtcagaggagactcagaggcgattgtacagataccaaatgctcatccattctccagggattttcgaatactttacgccatactgatattagatgaaaattcaagtaatggagtaaaggccatgttcttttctccaacaaaaattggattaaattttggatactcgtgccacgctttttaaactgctaaacggtacgtttcgtacgaaaactttctatatgaaaattgttctaaaatatcatattagtctattttttaagtttagaataattaaaactcaattaattacacattattataacctcgttttgtataaaacacttaatcttcatcttcatcttcaggatattcaaacactaccaaagtactacaccctcatatgtcccgatatataacaatctaggatagattctaggactataaatctgaacatatgaattagactcgtcttaaaactacgaatctgaacatagtcacataggatatatccaaattcgtagtcctaatatgtgcttgctacatatggggatggagggagtagcctactagctagctaagcagtgacatatgcacaacgtgcagtccgcgtttatcagacggtaatcctacaatcttatccgttggtagcgctgtttgacttacgcaggtcgcgatctgatcgctgtttcggcgtgattcgtctcggagaatgcagccatttggatgcatcaacgtagcaggcggcgcgtgccgattctccgctctgttccttcatttgtgccaagtgttctgctcatgcggtcattcccagaatagaaatgctagggaacacattaactttatctctagttttcgagctaatctgaccaagctcgcagcttgttagaaatgtaggaattcaattttaggcagcaagcctatgagagcgttcgcgaaaaaaaaaatccgtccgaccaaacaggcctcaaagagtcaaaggttgcaactcaatcccatccttggccatttaagacgattgagatcaaaatatacaaatgtcaagaatgggattgaaccgtctccccattcgcaaactttcatgaatggggttaaccaagcaaactgtcaagaagttttcagaggttcagctgaaagaacagtggatttcacatgacattatatttcataaatgcaatttaatgacgatggtcctcgccagataatcaattttggggagaattgaaacccaatattcagcgatattttacatggtttcatatgcctgcatttgcagacttaatagttcagcggttttccaatcactatccttctttcagcatcatgtgcttctctaatatatacttgccttctttgtacttctggtcctcactataagctttctcctgcatattgttcaatgagcacagttacatgatgatgactgatccagaaaaaataaccaacattcatgagagaaatggcatgaacattaaagagcatattcgttcgttcacgcttatggactcatacttgctgacatttggatcaaatgcccaagtgtgtatgacccaggattggtcttatagtccatctggcagtagcaagtgtttagaggtataattagtcatgcatgaaggaacatccagccaatgctcctggaggaaatcatcactacaaatgcaaccaaacaataaaaatctcatattaagttaacaatttgcaagattcctgtggaaagggcagcctgaccatggaactaagggagaaatggaggaacaaattgatcatatgctccttagctgaaaagacccactatggactagatgttcccaaccacataacataggcaacatattgttttttccccaaaaaaaaattcaccaggaaaaaataactataaactacacagtggtagaaaatgaggtgtacttaatttataaagctcagaactatagggtagtgatcgactagtctcggtatatattattaagatctggacagtcccaggtttaagctacgacttgaacactaagcattactacctactttgagtgttgcagaagaatgcattcaaacgataaagtgccgcatggaagctcatgaaacatgatctaacagaaaagcctacgagcatagatgagtttgtagagggagtgatagcttgttagacttctaccggtaatgcaccatggagcatggattcatcatgcatcttctcaactgacaacatcaaatttcgaaaatgaggaaacaaaaaaaccagatcatgtttgtcttgtgtcagaaagcatagccacatcctgctgcccattttgcctcacaattaaggcatatagtattaatagagttttacacatcaaagaaatgataacacgaaagagatccaggaaatagaaagtctgacaaccagtcgatgcccatgaatcataaggtaatgcattggctcttagcaaaaatgcaatctatagccaacataattcttagttatgtgctccccagaaatgcagaggttatgccttggagattcccatacattatgtagcaaactctaccctcctattgtttcaaaagacatgaatgctatatgatcatgctcaataagaaaagttagtcaaatctctcacagtcttctgttaggacattaacttatccagatatagataaagtatcgaatatttaacaggttgaccatcatgaaggcatagaccgtcctacatttgtagtgttcaaatgaattctcactaaacaacatggaaactggcaacttacgtatctccaaccaaggagtcgttggcagcagctacaatagatatcattcactgtgtgcaatccagtcatgagaaggcgatcctccctgggaccaaggctcacgttcaccctggatgtcatgttcactccggatcaacatgtaaacaagaattggttgagagtggttgttcaaattatcaatttgaatgaccaattatgccttaactaatactgtgatgtaaattgatgcaacattaacaacattgccctaattatcatgtttgtttgttggatcggacaaaaataaacgccagacaaggatacttcatttaaacaaacgaagtacatggtatattgcttgcctatttcagaaaacaacatatggtttacatgttcaactgatttcacaaaacataaccttcgcatgcctttaacatccagtagtaggtcagttacaaagatatgaaaaatagactaagaaaaactatataatagcatgttatactctgataccctattttgtgagcagcaatactggactggattgggtattgtggcatacatagtccaaatagaagcaggaaccaaaatcctattaggattagtacatgaacccttgtcctactaggtttaagataagagccacctttgcaacatatcagattgacatagctacaatgaattaagttctcaactcacaccttgctctgttcatcttcattctttaccaagcatgatgttgttttccatcatgtaatatctaacaagagattgtggctaattaatctccaaactatagctctgtagcttaacactagccatcaacatttcggcatttcctatcagttccatctgtgtctagattgacagaccaaaaaaattaagaacaagacaatttatcatgtggaacataatttgcatagctcttattagcctcttatgccctagccacgcagtactgatcaaatccaacacaaccacatcatgaatctacttccgaacgcttgcaatctagcttaattgcaccaatataagataccgccgttttccctcccatcccaaaacaacaatacgcgagaaatccatcattaaacagcactgttacaagacaattccacaattccccgtccatggacacgctaatcctttccaggacagcgacattgccacgatcgcgtcactgtcatgcatagaaacgcaataatcaaaagagagggggaaatggaaatagtggatggatagcccagcttacacgctgtcgaagagataggcccggccatggcggccgcggaactccttggacacgatggcgtccggcgacgccgagtccaccccgcagaacttgcacttgaacaccttcggccccgggagcgactccacgaacagcaaacccatcaatcccccccaagcccgatcgaaccaccaccggaggcaggcacggaaatcttcccacccgatcgaatcagcaagcaagcgctcaagcaagcaaaaagccgtcaaatcccgggaaccccaaatgaggggcgggagaggcggcgattgggcccgatccccatgcgccggccggggagggatcgaccgcgtcggcggcggaattcgggggcggatgattcgatggatttaggtggggggagatggtggattgggaaagcggaggcgacgaggaggacgaagggaatggccctcttcttctctgtcgcgattgcttctgttttcgggctgtttttttcgtctttcgctcgcctctttccgaatttatagggggtgaccgtagatagcttgccttcgtacgcgacggcacttttcttttttctttattttgtcatttcgtcgtcgccggttgttttggggttggttggtggaggtctggaggatcagtgggcaaagccacatgcggaaatcaaaccaaagattgggaattgaatcgatcgataccatcgccgttcggcgatagtcaaatttgaaaatatactgtttatttaatttttttctcaaaaatattcgtgatacaatttttcttaaaaatataacatcgatatcccataaccgttctgtgaaggcgtgacgtcgtggacgatatcgcgcggtgaaaatgtctcgcggaatgtgagactgaacgctctcacgaaatcaaacagatacactgaccaatatctccagtaattaatcactcaattaacaattaactaataataattaatgataaattatcttgatcagtgatttaattaattcgttaattaatggctaattaaatcatcatggcaccagtatcgctccttgcttcagcgataccgaacggtctcttcgcactttcatggcgcgataccgcctgcgacgttattccacgttattttcgcgtaacgcgtatgcgagaccgacggtatatttctgtagaaaattttgtatcccgaatattcctgagaaaaaaaatgaatgaacaatttaattccattcggcaagacgctgcggattttcctggtatattgccggtttagagcaggttttctgatattttttcctaagtcaaaaaaaaaatccaacctagttagtatgggatgtccagatctaggttgaggtttttttactggacagagtaggtaatcatgtactccctctgtttctatattaattgacatttagaaaaagattgatgttaaacttttataactttaaccatcaataactttaaaaatatttagtttaaagaaattagaaaaacatatatagatatgtctttcaaaacactataataaaagtaaacatgcatttatttattgtatatattataatagaaaaataagatcaaaggtatatcttgtaaagcgtgtcattgtccaaagcgtcaattaaaatgaaaccggagagagtactatctacagcccataaaaaacaaacataaaattggatgtgacatatatctagtccaaattcgttgtattaggatatgatacattcaatcctaagtatttttaatggagagagtaacattaatttacaatagattgtacttgtttacactactcccaatacacttggagtatgtcaatccactgctccctccgtcctaaaaaaaggcaaaccctaggtttctgtgtccaactttaactgtccatcttatatgaaatttttttataattcgtattttcattgttgttagatgataacacatgattaatattttatgcgtgacttgtcttttttattttttttataattttttcaaataagatgaacggttaaatgttgggcatggaaaccagggtttgtcttttttttttacggagggagtactctctttctctctcatttattgaagtatgtgtgaaaattacctggcttctcctctttctctcttttcttttctcctccacatcatcatacgaatacgagtttaataataataaggggccggctttgctcttagcataactcaggtacaccaaaacactgatgggtccacctctagagatttcttttcttttctttttcacattcgcgtcctgatcacaccgtgcaatgcacatttttttcctgttcacagcacaggagataaggaacatataaaccatataagtggtgtctataaagatagaaataacatgttcccaaattctactccatccgtcttaaaatataagaaattttgagtttcatgagttacatcctcttatccagattcgtattagatgtatcatatccatccaaaatctctttatatttatatttaggacagagagagtaatacatagtccattaattgctattttctttctataaaccaaaacacccctgcatatgtttcagatccatatgggcaaaaagtaatatatggaagataatggaagaaaaatagtctccatttgtattcggccaaaaagatctagacggatattgcaaattaatttgcttccatttaaaaagaggatattgtttttatgcagtatgcgccaaatcaaattacaaatagttaaatctaggtaaaaataattaacacggtataaaggggagggtcccctttccctcatggagagatcgtcgtcgatgaataccgcctgatctcgccacgttgcttccacagttgaacctgcgctctgttagagcaagtttaatagtatagccaactactacgaaaacgcttataatcggccgtccgatgtgaggcgcatcgtcagacgcacgcgcgagccgttcgatccgttaggacagaacgcacggctgagatttgctccgtgcgtttagcccgttgcaacatccaaagggaaacagctgggtttcccttttttccaccgtaaccgctccaacacaatcggatagagcgcgcggagaggtggcggtggagttaggtctagcgggtaggtgatggcggcggctgaggcggttccgaccggcagcggcgatgttcgaggcggcgctggagaagctagaagctgtcgcagcggcttctccaatcgtcgcattcccctctacggctctacccccaccacacactcaccccgcggctgtgtgttgctgcggttccgaccagcggcggcggcggctgtctccattcccagcgttgaggtgagggcttcgtttacccccgttccccattccacccccaccccttaccacccctctcacaccttgctaccccatgctttctccctcaaatccgaaatgatttttgacttttttttttgtgttttgcattggtctactagatgtgaatgtgttctagtaatgacattaattttttttcagaatgtttttaggtataatctatgaggatgcatttatgagattccccctagatgtgaatggattttttttttattattgtctgtgttgcatgtggtctcctagatgtgattgtgctctattagttacattaatttgtcacagaaggataatctatgatgatctattatgagatataattgataatctataatatgagtttgcactgtgattgtttcatatggtggtttttttgttttaccatttttgcactgtgataatctattatgcattttttttattttttcatttttatttgtgtttatgttgtttttttgtgttcccatccatgcatatacaatgttgcagtacacattaatattatgtttcatagtattccctggtttgttttacatagtagtacacacatttttttttgttgcagagcacatgttgtatttttgtctcagactttgtttctgtgtgttttttttcaaggatgcctgattggtgtagtggttccaacttcaagcatagatggggtggtgtgaggtttaagcgcactatgcttcagttggaacccgatcaaaagcaattcatcatagataatgactttgaatcttttctatcgctaagcaatttcaaggtccatagtcgacttgcagaatggattatgcaaaagatgaacccagagatttgtgagtttaggttccgtggcaaggttatcatgtttgataagttgttagtacagaagattactgggctaaatgatggcgatctacctgttaagcttagtggtgccaacagtgaagttgtgaaagagatcaggaccctgtaccatccatattttgtcagcaatagacttggtacaggcatgtgcgagaaattgttgctttctctgcatgatgaagagaagttcttgaggactttcattttgtacctgcttgccaccatcttgtgtcctgccactggcaattatgtgaatctcgactatgtgcattctttggttgatgtccagatgtggagtcagtatgattggtgcacatatgtggcgagctgtttgatgcgggaaatcaagaaatatcatggattctctactaagcaacgagattccatttttcagattggagagtgcctccccttgcttgttgtaagttttttattgtttcaccttgctatatatatttttttattgtttcactgtcatgtgcttgatccaatatttcagcaaaatacatccatttgtctcatttaacgtatatgttttgtttcacacaactgttgtcatatgtttcagtaaataatcagtctagcatgctaattacctatgtatatgtttcagcaaaatatatcaattgtttcatattacacatatgatatgtttcatgcaccgctgccatatgttctagttcatattttttggccaatatgctcctgctaactacctatatcaaatgccttttttttagattgcttacatggatcatttgcaaatgccaacaactggactgcatctccgcatcattgactacagcacaccaagattttgtcatgtcactgatgaggactttgagtatattgttgttgtagaccgttgtaggatgaaccttggctatgtcacatatgggtctcgcccggtatgtttcacaactatgaatgttttagtatatatacattttgtgtttcaccacttactaagactatgtttcatctttttatttcttcagttccgtccacagaatgagatcccatatctagcccaagttcatgttgttgctggtgggtctgaggctgagaatgctagggttgcaagggctgaagatgttccaattggtgctggtcaagatggtgtaggcattggggctggtgttgttgttgacagaaaacacgaggcctgggagatctgtttaactctagtgcaggtccaaagctcgccttcgaatgtatgagcgtgccagttgatttgatcatgtaatgaacaagaaatagaagcaaagaaatcacagttaaatctataaatgatagccgatcggctaggtgccaatgacatatcatttatctttgagccgatgttatatatgcatcgatcggcagtcattaataaataaggaaggactgaatctactcgatcggctgcagatattaccaatatataatctttatatcgatatatacttaaatcaagtgattgagatagatcggtcgccatgccgagacagtataaatcacttagatcgaaatatatattaataatgagactatatacgttcatagcatagccgatcagatagatctagcatgtatcggctaatactccgataccactctatattaagatattaaagcgagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattctaatcacgactcataagatcaaacttaactgatgcagctataaatatgaaaagaaggacaatatctagacaatcaagccgttggatatgtcatagagtggtagatatcctatattatctaagtcaacatcggtatttaacctaatcggctgccttctattgacggatgttagccgattgtaggttggatatcgatattgccaaggattatgtaggatatatgataactcgacgaattacataaacaagattagagtgtcataaaaatggaagcactaatcccgtgaacgcatgccggcataacaagttttacctcttggtgaagatcgaaaccgatgcagctcaatccgaaagcaagaactcgtcgaaataaaacttaagcaaaaaagggtggcgatgcgccgagattgtattgaacatgtgtgttaaaagttacatagggctcgggcctatttatacccgaaaattacaagatatgtccataacggacacgactactatctctaacaaactgtaagataccataagtctttgcggcagacttttgcccaagcatatctctaaggaaattacctaaaacatcctaattaatatatacaattgccttctcaggactctatccatgtgcggcaatcaccttgaaacacctcaactcaacccgatgtcatacaccaagttgcattgtcggaatcggctgcatcggcttacctagcccgactcagacccagccgatcctaatcgtagccgatctggactccagccgattcctgccctgtttctgaactcgatctccgcctccgactttgcttcgatctaattttctttcccgatgctgatattaccaaatttggttgttaacagttgcccaagatggtgttgctcaagattctgcttcattgaatgaagggatcaggctattgttttagagtcatatatgtatctatacaaagcttcatggaagcctttctttgaagtatacacgggcaggagctgctgatctgcttctgttgtcacgtgccataagcaacatctatgaattgtaccggggaacacctttttaatcgctgctctcattgctttatctcggtctgtcatcactgaacctggcttctgtccattcattgctcgcatccatgttttatagacccatatgaatgtttcagttgtttcatcacaaatcaaagcacatccaagcaatattgtttgcaggtggttattagttccaacaatgggtgcaaatggcatgttgtaacggttagtcattaaggttgtgtcaaagaagacacagtctttatagctttgatacagtttccgtgttctgccatccacccaaaacagcgccttcaacacgttgtcctcatcatatcttgcagcatagaagaaggaggggttatctgcttgagttttttttttttggaaataatcaatagtcattgcaacatctttgagtgaaacttgttgtctcaattttgtcctcaaatttgagacatctttagcagtgaaagttagattcctcacaccaccgtgcaaatctcctaacaacgccaaaatctgcgatgttgcaatgtttcgatcatgcaaagtctttagaaaattcatagtcttcatttgagatatgcctgtgagatctgtaatatctccttcttccaaggcgcttcaccatcggatgcgtgtgttctggttggaaagcaatgactctccacttgttgtctccattttcagatactttacatttcttcgatgctttttccccccgatgatgcctggctgtttctagatgatgcaattcttgttccaaatcctagcttataagcataagcgttgtaaacatttcttgcctcttccactgtatcaaactccattccaatgtatggaacaattggtggggaataaacaacatccttttcttcttcatcattttcagatgcatcttcatccaattgttcatcaatttcaacagtcacagcagccacatctgtgttgtcaacactttccacatctacaacctagtacacaaaaaagtttcactaagttacatactgtgttttcaaaacaaaatatttcccccctacatttgcaatgtttcaaatccaaggacaactcaccaagtcagtttcatgcccagtggattcggataatagcacatcaaggaagccaccagatgagcttggtgcttggacatcgatctgtaacattttgttttgtttcattagtttgtacagttatgtttcagcaagttaaggattattgttcaagtcaaattccagtccaaatttatacaaaagttaaaattaaaaataagacatgaatataaatgttgcatgagggaagacattgtttcacagatctatgcttcaattttttattgaaactttgtcaaaaaaaaaagtaaaacaagcaaaaccctagaaattttttactcaccaaattcattgcattatgaattggggttgttcctccatttgcactagatgagctcggcggaaaatccctctcaacttggtgtatcagatgagccatggcggcggtggcggcatgtggtgtggcggcatgtcggcgttgttgtaggcttcgtcggcgtcgcgaggaggataggggcgtgggggatagggtcgccggcgccggagagaatcgccggtggcagcacagcgccagtcgcgccaccgaaatctcccctcgagctagcggtcaacgggcagacacattgaatgaaacagttaatgtgtccaggtgttgcaacggcgggggcgtcgggcgcgagttgtttctccaatcggacggctggcgcgcgcgtgctgcatcggacggtcgcgcgaggcgtccgatttttcgtctcgcgccgtacgtccgacgcgtagcgctctcacaactactagctccaaatcatctatagccaatgtaatagccaattcatacaatagttgcttactacattattaatgcatggtcccacctgtcatacacacattgtgtcttggagttcatgctgcagctggctacagatatgtagcccgttgctcttctctcttttttttatctctttaaaatgtgtttatagctgacttatagtctgctattgtacccagtcttagcgtccccgacttcaccgtgtcgctgccaccaccagaccgcgcccaattaccgtcccccacctcaccacgtctaaatctgcttgcaccatcgttagacttgtgcctcatcgtcgtccccgccaccacatgcaggcaatggtatgtgctgccatcgctgctttaatagggttagggttgcataatataaagcacaactactttttttgatgtttcataatataagacatatatgcatgcatacaattaattagaacctcttctctattaaattattacttttttaaatcctccaccctcaagatctctaattctattggatgcatgcattatatttattatgatgattcaaactagtagatgataataattgtttcttagtctttgggttaaggttggttgtgccttatattttggaacatagggagtataaggaagtgaggtagagtgttttggtacttcgaatatgcggaagttaaaaaacgcttcaacatgcgtaccacacgtactacgtgttataattcatttttgaaagtgttccaatgacacgattaaaattacaaattataatggtattttgaaaataaataatcaatttataatggcacgatcaaattagtccttaactaaaaagaacacattagacacacccggaagaacaacagccaaacacacagacccatcaagtcatcagccccttggccattggttgctacggaagacgatatgtatggccaagcaacaaggggagtaacaatttccaaacgacaatttggacaaatcgtgagcgctagcgtcggcctttttttttttttcaatctcatctcgttgaccgtggattatcaacttaattataaacataacttaaatgtgtagatgttttggtaaatcaactttataaaatagcttaaaataagcagtttgaataatacaattttttttagaaaaatgcaatttttgaactatggagcaattaatacagtgaataatctaatgcctatttgatttagattattgaacatttattgttacggattatctactggttatatgggtagattaaatattttaagaaatgaaccaagttgtataggaaatgtaatataatggaattttttagaagctgtattttctaaataaaaccattgagcaaataattcggtgaataacattaaaaaaagcatggacttgtaggtttgagcaaccaaaaagaattccgctttcgcaagcttggatgatcgaggtggattttctcaacccgatactcataaactaggactttttggagcaaaatgtctcgtgacaagagagtttcaccattcatggaggaggcaacaaagccaacaagtacttgaacacatgggggctcggtttaaatagcctccgcaccagtacacactgcacaattcgttggactgtatctaatgaccaagcaacaacttgcaggcggatctacatcgtttctgggtgtaataactcgtcaaattttctgtggcatggttaattagtgcacaaaagattcggtacaagacttgattttattcctcccgtgttttcaaatagtatttcatccatcctaaaacataaacattttcttttaaaaaaaagcatgctataaactattagaggacgatacttagtagtctcaaatgcatgcggtaaatatgcgatccaagatgtttccacccaatcgataaccatactatttagtatagtactaaaatcgttccagttttattgtactcgtaacaattatctttttaaagttagatacatgtattagttacggttgattaaaaagaaaaagtatgtgaaaaaaaataaatggagattaaaataagaatagttataataggttgagatgagagagtggatggataaatatctttacttgtgaaacaaaacataagcggtataggtagctttattttaaactagccacataagccacgtgttgcgtggctcttaagacccgtttaaaagatgtgtatatataggtcaggccaacggtgccctgccgttgagatcttcttgatgggaaaaattttgaaagtttgctcaagaaaaaacaaacgtcatatattatgacaatagagtattattgtatgataaaggaatactaacttgtttctccatctattctaaaatatataaggcatttttattttgagaaaaatcaaaacataaaaacttgtctaatgaatggattaaaagtacaggattggatatgtgattaatgttatgactttttatttgatttttatatcattatataataaagtagtattgttagatttttatttagctatttttatatggcatcgattctgtaggtattgataataaacaaaagaaaacagtagtagttaaagtataatattgaaaagattgtttgagaagataattatatctatatgtatctcaatacattttaaaataaagggagtaatttttacatatgcatacctggtaaaaaaattagtacaaatacatattagtaatacagatgttccaaaataagttcattgttcactcatcctacacataccaatacaaacatcaaaagactaaaatatcattactttatctcatcttaatataactatttatcactttatctacttccaatgcaattattctttactattataaactttgatataattattactaaaaatcaatttattttgagataaatgggatgagctaaaaataatcttaatatacgacagaggaagtacttaataaaaatgcttaaaagaagacttgctacactgttacatatgcatattaacacacataatgtaagtagcctatttgtctgcttaaccaaccgatcactgatcacatacggaaataaatggaggaggtactacagtatttctcgcctccgaaacaacatgttagtagaaaataggaacccgtcagctctgtaccatcttccaacggctcgtctgcttgtagaccagcctgcagatcaattcctacggaacaattgaatgggctgggcacggtcgggagggatgtgggccatgtgctgttaggcaacaacgggtatggcccaatgcaagtacacgagtgaaccttgaggttgtatggtccaatacgataagtggctgatggcccaagacttttgtagattcctcgaagtttttcttcgatttttccctgccagatcattctctctctctctctctctctctctctctctctcaggcgtgttcttagctcattcactgtgcaagtttcatttgagttttaatctcggtaaatgagatgccatatagactaaactgatgacatgccatgaattttattaaaagagataaagaatgaacatataaacaaaacttggtttatacagttacctatgcttgaagaccgaataaaacccaattgggactgaattattttatcctatgccttaaaagatggaaatgaaaccccactgtgaccaaatagtttcataacaccattcaataattaaattatatgaatataaaatcacgaaaatgaaattatgcatttgagacatttgtttcatatttttagattatgtagcactataggaaaccacaagatgaaactcccactgaaaatggacatagtcagatttaatttacattgctgccaaataaggccatgtctgtttccgcttaaaattattgtaatctatattattgagctagattactataagctagattataataaaccgatatagaataagttgttaactgtttgtttctctgaattattagttgtttgttagttgttagccacccaataatctaaaaaagcacctttagagtggattatcagattatagaaatcgtgcttatagattataataatctatcataataagctatttgtttgtttcaatttacttctaacaatccagattataataatcataaactgaatcaaacaggacctaaatctcttcaaatgacacgacatctttacaaatgagagacgtctaaaattgttcaattgcatggaaggcacatacacatatcccactatagatataaatcacgcccctctaaaaaatggaagccatatatactatttcttttattcttacactaaactatggtcgtaattttaaaatatgaataaaatcttatcataaatgacaaaatatctatgacagggagtattaggcaccagcattcaaatatttcccttctatatgacgaaacaaatttaaccgcatgtagaaagtaaaaaacattcgcaatatggcctcttgcattcaatttagattcaccactcctcaggttctcattcaatttcaaggagatcatggggtactctgacaggcatcccacgccgaattaaaaacccaccacatttatcttgtttcaccatatttcccagccacacccaccaccccctacacaaacaacgcaaacacctcactgacagctgggaccaccaccacgtgggggcccacactccagtgacgcatgaagccaaaccactcggtgccccgaaaccgccaggcaccgcagccagcccgggtcgctgtcgtcactccctgcccccggatcccaccaccggtttcgtgccccggttgctcacatcacaccacgcttgcttcgcttccccttgttccaactcgcgtactacccctcccacccccgtaattacgctcacattgcaggggtggaagagtaatttcaggggccgcaattaattaagtcaacacgaaccgcagcctcccagcccacgctaccttggctacaggacgaccccactttccccaaactgcccctcccctccccaccccgcaccatcgcctccaaaaccaccaccacctcaccctccttcctcttcactctcacgagacagcttcccacgcagcgcagcgcaaccgcagcaatggccgattcgccaaaccctagctccggtgaccaccccgcgggcgtcggcgggtcgccggagaagcagcccccggtggatcggcgcgtcgcggcgctcgccgcgggcgcggcgggcgcgggggcgaggtacaaggcgatgtcccccgcgcggctgccgatctcgcgggagccctgcctcaccatccccgcgggcttcagcccctcggctctcctcgagtcccccgtcctcctcaccaacttcaaggtgagctgtgtacctcggccgcgcgtgtagcgtagctatcacccacccatctcctcgcgcctagttactgcgggatctacgaatttcttcggcgcccgcatcgtgccgggggattaatctgtgtcgggggggaaaggagggattccgatgcgcgcattagctttatgcttctagtttatgagacatttgcaccgcggaattggctcgtggcgtcggaataatgcgcttttgctgcgcgctttcgcatttctggtggtgccttgcggtttctggaactgacttttggcggggttcgcgcggatatagttgtttttgctctgtttctccttttggggcgcccctgcgccgtcaattttctgtggagtgaggtgggagctgttgtttgtgcgtttcgggggaattattctgtgctgcacacacttggtggctcgggggaacaaatcatcatgtggcatttttcttgttgcggcctcaaagggccttacataaggaaacgcccccttggctttggctgctattgtgctggtggtgtgcatgctaaggaatgctgctgtttcgtaagggaagcaccaagcactgcaagagagttagtttataggcttggtttagaaatgattgcttcactgatatcgagtgctgggtctggccttaggtgttgtattggcggttctgattcttctcggtgaaaacccacaaattggaatttacttgctgagcatagagtgcttgtttgcagcttcatatcacttgctttctcttggttccttcgttactttgccgaccttcttgatgtttccttttccaaaacatagggatgcttggcaaacaggttttaattaaatgaagaatttatgaaggtaacatttagttgacaagtgtttctggataatttttcatactagaggcataagtattgtactaagcatgacataaatactttctgcaagttactgttcaacatgtacactgtaatactgttgcgcattgttgaatgttcaaaaaattatagagattatgcttaccttgcttgcaaactaattatcaaaatttccctgtttaggttgaaccctctccgacaactggtactctgagcatggctgcaattatgaacaagagtgcaaatccagacatacttccttcgcctagggataaaacatctggtagcacccatgaagatggtggctctcgagattttgaattcaagcctcatctgaattcatcctctcaatcgacggtatggatcctttctttgagtgattacctggtatcgtgtaattcttcatttgtgtatactgtatttgagagtttgaaaaaatttccatagaaaataataacatttgttgtttacaaatggtcccgccaaaacagtggaatttatattggggatgtacataaaaggagtgtaaagttctaatgtgcttatgctaacttcctttccatgatctaaagttgttaccttacggtatgctatttattggatctatattgcattttacttggtaaatctatctgaggttccagcttttgatatttaagttttcctatgtttaattcaaaatattctcacgtgaatcgcaaacctcaccaggagtacaataaattcgttttattattattgtaggctgtgttatttctagtccatggttcggtgtcttgaaatttcagtgccaaaattgggatggatctggttacatcttcaagtctaataaatgatcacaccgactttattgtgtgatttgattatagcagggtcttgcaacataaatacaagctattaattgtgaaaggagaaatgagatctttggtgagatcatgagaatagggtataacagacacaatatttccttgctaggtgagacttgagtggtgctagtctggctgcaaatttatagaagtatgtgaaaatttgaggtcagaatacaagtaattgaatggaccaatctaatgagttctgtagctttagaataattaatgttaacataaaaatatgttcatgaaatcaggtccttctgcattttgttgttaaccgaattccacattcttctttagttctcacaagtacagacaagtatcttgtaatggtggattcttttttggaaaacaaacttcattacatattttgtgtgatccatctatgccttgtgcccttgttacctttatatccctacaccttgatttctcttgtacttagttttgcattgtataacacatttgctgtactcgtgtcttgtactgtaggcttctgctatcaatgatcccaaaaagcatgaaacttctatgaaaaatgaaagcctgaatactgccctgtcatctgacgatatgatgatcgacaatatgcctgtatgttctcgtgagtcaactctcgcagtcaatatttcaagtgccccgagccaactggttggaatggttggtttaactgacagctcacctgctgaagttggtacatctgagttgcatcagatgaatagctctggaaatgctatgcaggagtcacagcctgaaagtgtggctgaaaagtctgcagaggatggttataactggcgcaaatatgggcaaaagcatgttaagggaagtgagaacccgagaagctattacaagtgcacacatcctaactgtgatgtaaaaaagctattggagcgttcgcttgatggtcagattactgaagtggtttataaagggcgtcacaatcaccctaagccccaacccaataggaggctgtctgccggtgcagttcctccaatccagggtgaagaaagatatgatggtgtggcaactactgatggtgagggttttatcctttgttttaaaaactgatgctggatccctctggtttggcagcttgacctcctgcttcttggatctgattcccccccttttttttgtgaattctcttgctatttatgtcatctctgaacttcttattgcttctcaagaatttcttgcagaattatgattcatattcctttagattcttaaaaaaatgaatgatttgacatataaaacagcgaatgaacgtatagcgtggtggtagagcctccaatagtggggacgccgagtcaccgacctaagctcgaacccaggttttgcaccaaaaaactcccctgcatgaggttgagtgcagcctggctgtgcactgcgtttgggtggttttttttctcaacttagttgaattccacgggccattttaacctgccaatcatttttttttgtaacatacaaaacaaaatttgataagagttttctgagctgtatttgcactccagtacatcactgctggtatatttttgccagtccatacaccgaaggaaaagtcgtgtgatatggatgaatgtttttgttgtgttcttttatgcgatttttaaatgttatgtttttatatgcagacaaatcttcaaatgttcttagcattcttggtaatgcagtacatacagctggtatgattgagcctgttccaggctcagctagtgatgatgacaatgatgccggaggagggagaccttaccctggagatgatgctgttgaggatgatgatttagagtcaaaacgaaggtgcagttcatttgaacttgttacacactagggcgagaatcacccatttatactactgaatgtgttgtttacaactgttcaaacaggaaaatggaatctgctgctattgatgctgctttgatgggcaagcctaaccgtgagcctcgtgttgtagtacaaacggttagtgaggttgacatcttggatgatgggtaccgctggcgcaagtatggccagaaagtagttaaaggaaaccccaatccacggttagttgttattttcttcatctattgctcctagtaaattctcctctttttttctctgacatgtcaacagatttttaacagtaacaacaaaatgttcaataatcttctggtcatgttattttaaatcagaaagataagatttttttgccttatacatatttgtaaaacatgtgtgtcggattgtccggtgatactgctggggagtaaggctgtaggggcttaatgctaagactgggatgccgggcatcacttaattggaaattaggccttctcttaaggctctaatggttcaatataatcagatattttccatcacttattgaataggtgtatgtgtccataacccatatatatacaggatgcaacttgtatattcattttatttcatgattgcaggagttactacaagtgcacaaatacaggatgcccagtcaggaagcatgttgagagagcatcacatgatccaaaatcagtcataacaacatatgaaggaaaacataaccatgaagtccctgcgtcgaggaatgcgagccatgagatgtccactccccccatgaagcctgttgtccatccaattaacagcaatatgcagggccttggtggcatgatgagagcatgtgaacctaggacatttccaaaccaatattctcaagcagctgaaagtgacaccatcagccttgatcttggtgttggaatcagcccgaaccacagcgatgccacaaaccaattgcagtcctcagtttctgatcagatgcagtatcaaatgcagcccatgggttcagtatacagtaatatgggacttccagcaatggcaatgccgactatggctggcaatgcagctagcaatatatatggttcgagagaagaaaaacctagtgaaggttttactttcaaagccacaccgatggaccattcggctaacttatgctacagtaccgccggcaatttagtcatgggtccgtgagagtctatactaatgcttatagctcgagaatcatatattaccaatgcttcgtattgacattctcttcagaaagatgctcctatcattgacacatcagttgaaccggaggcgagagctgtacctgtgggctgcagcaaaatacaccacatgggtcttctggagcggcaaaggccttgttgtatacttgtatgtggcactggccctatattcgttgtacagtgaacccgttaagattaattagatcatcagaatttggttttctttaactatcttcgccttcagtggaatgtggatagaacatggattatggttgatttggttttgtgagcttgtctaattctcttttgtgacaaagctttgtatctcactgcatatgtacaatgccgttggcagtaaagatatgcaaatgtgatacctgtaacacgtacgaatgctcggaccgttggattcgtcccggttgaaacatgatgctacattttcagctctacttgccagcattccaatggatattttagcttatagtggatgataattctgatcatagacattagtgtgccacaacattactacaagacatttaaaagaaaaactgaaacatatactctcaaacatgtactacacttctacacctcatcagcattttgcccattttcgagtttgaccctagccgctaccttaccattacaacaccattgttacagctacccttaccagtccatgatcactatagctttctaaagcccccagccaagatggttacaagggaagttcgtcgtcagatcacctcacaaagtcacaacgctagtgccacgccgacgagaccaccaggggcctgctcttccacccgaggtagagcgccccatccctctcggcgagcttgtagttgtccgagtagctctgcagcagcgtcctgatggtggcgttcaccagcgagctgagcggcgacggcctgaacccggccatggtgaggcgcgccttccacttgccgaagggctcgtaccggtccgccctctcctccccctcgcacgcgatgaggttgacgatctccctcgcgaggcagtgctgctccatgttgatcctctccctgtcgtccctcggcagcgtcaggtcgatggactcgaagatggcggtgtagtagtccagcgtctccgcgaacctctgcgggaatggcgccgtgttcgtgttggactccatctccaccagggtgagtaccttcggcgacaggctcttcaccatccttaggaggcggtcacggtggttcgccgtgctcaccgactcgtctggaatgtggtgcagctccagggtgaagttcacggcgagggcttccccggggatgactccgagatgtgctgcctccaccttgctgccggagatagcaagtgggtggaattcaaagggcaccttgcacaggctggcgatgtgcgacagcctccttccgaccagctctagcccgccgcctcgtgcgtaagctgacactgagtcatcaataccagtgatccttacagttggtggtccaccaggcctggctgcaagggcctgaaggagagagatccactgagccccttgagagatatggaagtcgatgatatgaatcctgtcttctcccttgacagcctctgcaatagcaccatttgccgacatatacccaaacttgaagtagggacaggcctcatacaggaagtgcatgtaagacagaaggtcagagctctttggttccttgcatttcaaagctttgtagattgaaatgccagaggaggcaagcctggcaacaagcccttctaccatgtaggctcccaacctctcaagtggctcaccagataccgaaactatttttctcagctctggaatcatcatatcaatagcaaagctattcttctcttccacagctctagcacaggcaatcagtagctctttcaagttgcctctaggaatgcccatcatgcgcacccacttctccggctccaaggaaagttggtttgccaccgaattctcaaggctgttgactatttccgagtctggcccaagcataacggcctcgagatccttcagtttttgcttcagatcattaggatcctcagtgacacaggaggcgcctacaggagatccatcagtcgagtcagagtggctgtcttcctgagatagagggctaccacttctggttgtgaaactttgactggaaggagaatcatgtctcatacaaccagcaccttcagaggagtccaatgtgtacttgttaggagtagcctggctttcataaccagcatccggtgaatgtgactttaggccataatgatgtggcacaacgtgggtgtctgaaggtgccctataagggtggcaagggtgctgtggattatcagaatactggaactgcttcaggttttggctcggtatattgctgaagggatgaatcattcgggaagttggagtatcagccattatggttcagtaaagacctcctaaccaattactgcatagtatccactgcttcgcgtatggcaaggagatccaggaacagattaactggaaggaaaactttgtactagtttgttgttggtgtcttgatatctctagtcctccagtaaaatttcagaaatccagcaggaacaaaatctgcaatgaaccagtagatatcagaagtcagaacataaacaaactgagctaccaactcaagtaaatctggcactgaactactggaagcaattattttaagtagtatcagaaccaaacaaggcaatatcggtaattgaaatggattttctgacgttgtttcattgaagaaaccacccactatgaattctcaaacatttaatgttgagaaaaccacaatatctcaaatctcagatacctgagataatctactgtatctaacgaaagaagatcgccagaaaactacatagaatctatcctacaacaatactgagtatctgatcagaactgaagaaagcgggcatgccaaagtacatgttggactgtggcaacttaacttgggatcaaatgtcatacatgcattcttttctgccaaataaaactaagacgagcagaaaccttagctcttctaaacaagcatcattatgatgtgaaaacatgttaattccgctaataaaagacgaaacaaaaaagaaacaactaagaaattaggttgtgcaataccaccaactattttggcatcctagtcctaccgacaagtgaacaaaatcaagcagcatgccgtaacgctgaccgtagaacaacgtcatgaatggatgggtaccgtacacccatcgtacaagaaggttcgaccaatccgtgtgccaacaaaacagagggctgtagatcaagtcgtaaagtatccccctctcccataattttccgacaccaaaacagagggcaaagtttgacactttgacccgtttagcgcaactacccccgggtcccggcacaagattattacgaacacccaccttaaaaaaattcactccaagtcagcggtcaaaagcttcaagatctaccttgctcagctaccactcgtgcgctgctatgacgcggtccgtctctctcggtgattaacttcacggcttcaaccaaaccacgattcaacggggactaagccgctgcatgcgtcgctaaacacgctcacgaatgcgtagatgaacaacgatatgcctagaag

SEQ ID NO: 22216 - DNA, 1921 bp, Oryza sativa
tgcgccccgtgttcaaacgaacgtggggcccagcagaaaagggtatctatccctctcgagtgtcctgtgactcctgtccagctaaccagccactcatctgctgctgatctgcttgctattcgagggggaagaaaaaactcagctgctgctgctgctagcctacggatgattggatgaagtatcctctcagtagtagtagtagtagtaatagattacggcattcgcatgtccaaattggtagttttaaatattgtctcatctaattttaggttggttctttctagaatggaatgattcgttatactgggtaggatcccatctatttttagatttgttttttcgaaacggaggggtatgtcgtaggtcacttatacgtgggtcagtaaaaatatgatttttatataccagttatctctctactattataaaaattaaagatatttttaccgttactttggtagatcattcgtatttgagtcggttgttaagttcgttcgtttttggaaatatagatccgtgtttgagtccgcttttaagtctgatcacttttgaaaatacaaaaggagtcatataagaaatctctttaaaaaaaactcgcacactaacttgggatgcttttggaaatacagaaggagtcgtataagaaatactttaaaaaaaaactcgcatgctaacttgagatgagagatagactcctaattgtagctcatagttttctaaaagaaatatccaagcaaattcccacaataattttcactctaactgaaccgtataataataataataataataataataataataataataataataataataataataataataataataataataagactaaaatagccttcatctgttgcaacacatgggcattttttctagtaaaataaaaaaaagtatcatctagttgttgttaccgctggtttttcagtaaattttaagttttagtagtaggttaataggattaaaagtatacttttcacttttctttacttagaaaaatggcaactaattgactcttcaagtttgtctaggccaaatattactagcaagtaggagtataggatatattcttggaagatgacgctacctaaagagaagcaaactagctaggcgctaaataattatctcacggaatcaggaatttcataccgaacatgcttatcatgaaccactaaggttttagtattttgacttcttgtaatatttatgtgacgctcgtgtagagaaaaatattgacgattaaggttttagtattaagttatgtactccctccgtttcaaaatgtttgacaccgttgactttttaattcgtgtttgaccattcgccttattcaaaaattttaagtaattatttattcttttcatatcatttgatttatcgttaaatatactttcatgtacacatatagttttacatatttcataatttttttttgaataagacgaatggtcaaacatgtgctaaaaagttaacggtgtcaaatattttgaaacggagggagtatgacataggacctagaacctaaaggagatatggaggcttccgaagatagtgaatactagtatttagtatttgtcgctctcatgtaactgtactagaaaacacgtgtttgagatttttttttccttggaacagcccagtcaaagcttctcgaggcattttgttctggttaatattatcccacagtacattactagcggaattttcccatctatttttacaccgagatattctttttttttgaatttgatacatgcaattttgcactggacacaattatcctagattatgtttctatacatatatacatttgtattggcgctgttctacttaatttcactcttgtgcagtcaacacacagtgtgttgtgtctgccaggggcggatccaatatgggtgcagggggg

SEQ ID NO: 22217 - DNA, 7509 bp, Oryza sativa
ttccgacttccgcgcggagcttgctgaccgcgggcggacgagtgtgcgttctgggttctatatgcttctctgctgctctgcaactttgatcggaaaaaaaggttaacgcgacgcgcacgagcacacgggcagaggctgtctgtccctttttgtaggtttgtgtagtcgtgtatcgtcgccgtcgtagggagactggtcgtgcttggtgcgcgtcgttctgttcatgtccaggggcgccggaaacggcgtcacagataatacaatggaccgtcaaagtttggctcacgctgtcacgtactacatccatatctatattttaaggtaggatgccgtttattttttacccaacgtttgaccattcgtcttattaaaaaatttttatgtaattattatttattttattgtgacttaattcatcatcaaatattctttaagcatgatataaatattttcatatttgcacaaaatttttgaataaaacgaatggtcaaacgttggtcgaaaagtcaacggtgacatacattaaaatacggagggagtactcgtctgcgaggtacttgtaaaaaaaaacacgaacgataatacaagaacgagaggaccgtcgcaaatttcccccgaaactatcggcttgtttggtaactcgagggaaggggattgagagtttacacgaggaaattgatgatgagattaagatgggaatttgatttttaatcctaatatcttgtttggtagaggtgatggaaattgataggaagtttagttggagattaggtcattaataaaaatggatggctgagatttgcttagaaaaactaaaggagaaattacttcccaattacctgcccctaccaaggtattgaaaagaagggagtttcttactcaattccccatccccatcccaccaaaattatcatgtctcctaaccaaacaaaacacttaatagcctcatccctctaaactcccaatccctcttaaaaactcccccaaccaaacaggccttataactattgtcgatctggacctatttacagcggttgacttgatctaccaatggtaggctagcgatccatgacacggtggcccgagcagaggcccaagtcaggacacgggtgggcaaaaagcttccaaagcccaacaagcagagcgttcgattggacccgcctcggcctgtaggcatactcaggcccatcgaagccgatggatttatgcctaatccgtatatagggaaaatccaggtactgcatttttctttgccaaataaaccagcaaaatttgatgttttcgcaaatttttttcttttttgacacctttcccaaaagtcttcggagaactatttcagatgattttgtttttgtgtaattctaaatgtgaagatagagcaaatcaatctgatgggccgaactagaggcccaaatccgtgcaaaccgaggggaacaatattttcagcccaatattgaacacgacctcttccttctccaaacgaacgaccatgctcccaaatctctttcttgttcgaggtcggcgaagcgcgcgggcggcggcgatcggctaggtctcaatgagcggcggcgggtctccgacggacggccggggaccgccgccgcttggcacctggctccggccgccggcgcaacgggtattctcatcctcattctctccgatcccatttcccccctcctaaaaccacacctccactgggtttcaatcgctgcttataaatacactcttccccctccaatcccacatccattgggtttcaatcgccggggtttatacaaattccccctctaatcccacctccgactggtttcagtcgctgcgatttatccaattttctcctctgctaatccctccccaactgggttcaaaatccagttctttcccaatgtatggcattcccgggtggcatttcgattcccgacatccaaacgggaatcgactcgccgttgctgagctcggtttagcgaaccgccttctcccccccgcgcgcatggcgctatataaaccctcctcctcctcccaagaattaggagagggacaccaagtagcgaaatccacagcctttttgatcgaattgccatccgcggcggaatccatttcggtaccaagcaagcaagccggtgcgagaggcgtcgcggcattagcgtcagcggccgcttcgtcgtcttcgtctcccttctcccccctgcccccccttcgccgctcggtgtcgcagggtggtgcgcttcctggacgacaatgtatgtactagtaaattggggagctagcgcggcgttgcatttgctcttttctgtcgtttgcttgatccttgtgcgttcttgaggtgttttgtggagcatctggtacaatcaagagcggttttggttgaattccggggacgggtgggttcttggctagaacgatccttcgcttcttgtcttttctttacgcgggtgaattcatgtagcggttcgtggattatctggtacaatcttggtggttctagttgaactctggatactgattcttggccgggacggtgccttttactcttgtgattctttgcgggttcagctgttctaggggttcgtggattatcaggtacaatcttggcggttttagttgcactctggatactgattcttggccagaacgatgttttgtactcttgtgattctttgcggggtgagctcttctaggggttcgtggagtatctagtacaatctgagtggtattggtttaattccgagattatgttcttggctggaatagttcttgtttgtagatatacaacttctcttttcttcttttggtgtgttcttgtggaggcaggtctatggattacaggaggagtagcgttcggctagttttggttggattctgagaagggttattggaaagaacagttcttgctcattgggttcgttctcttactatggatattttggctgggttggtgggtatagagtttctgttttgcatccaacagataactttgcactttgttcttcagatttggaaccaggaaaacataattttgggtcaatgtggaaaaacacgagttggtgcaaatgtttcctcttttgtgggtgcaaacagagatagatgcaaggtttccggttttgcttgcactaattttctctactgccaaattttggtttaattgttatccttgtaatcttttagaaataactgctgatttttccaatcagaaatattggcttgcagtgggtttttatattttgtcccttgtgttgcaggaacggggggcatatgctccaatgtcaactggttttgcggcacaagccaagttggatcagttggagccatcatgtgcaaatgctattgttcagtacgccaacatatcaaagccaagttggatcagttggtatgcattttcagcccgggatgaggcaatacaagccttgattaatgaggcgaagtcatactacatgaggttccccccaatacaacacctccagcagctacccttactgcagtcaccttcaacgcggtatgattatgaatccccatcgctctatttggagcctcagtttcaggtaggtagttgttatcatggagttaagtttccatgcctccccgttggtcaaagtggaggttttgacatcccattttctgcgcatttgcagtctttgaacattccaggtgatggcttgccaagggattatctaaatgcacaagttaatgttctcgggtctgatgtccatgagatgcacaatcagaggcaatctcatcctcgtggccgacatagggatttctttggtgaaggttccgattttacgatttatattaccatcaactttgatggcggcagattaactaaggaaaatatttgggactacttcaagtattttcttctaacctttgtattatgtttactagtttggaggacaatactaggtgtaatatgatttaaagtttcaaattataccactacattcaattcaataattttacgatggtatttcttccaggaagttcgggcctgtgatcaatgtctaccttagctgtaagccagggaatgaaaagtacactttcggttttgtgacatttgaaaatgctgatacggtgagccttctcttatcaaagagcacacctcatttcatctttggagtaaaagttagagtcaagcgttacctggaatggaccaaacaagagcaaaggtctgttatctaactttgctgtttcttttgttgattgcttctcgcagtttttttaattaacctacaatgtaaacctactgttgttttcatccaaacgatatctgagttatggtttacaaactatactgttgagcgcctgttaggaggagtacatgttaacaattcccaaatcgatccctatgtcctggcaagcagcttggtgtgcctctttttcagtggggttatgtaacttacgtcacagtatcctgctgctaattgcaggctttgagtttgatgtgttctgtttgttctgaggtccaaatggcagtctttccacaatgtactctcccttttctgatcttcatttatttggccggcaaaagatcaatccctctcatccaaggacttgcacaaaatcttccataagtgcattctttaggattctaaaattagttattagttgaagattctttctggaggtcaatttgagagttcctgaaatatggttgttaataaaagtatgatctattatcggggcctccttttgcatggcaatggttggtggggactaatttgattttaatattcattcagtctataggacagagttcatgcttttatgttatcatgcactcatgcatgtgcaggtgtgcttcataaatcatattgacagtttattcatttggttacttattttaaatgtgtagtcaaatcgtccattttgttccacatgtaccgtctttgtgaaaaaataataactagcttttctggctgtacttaagttgcagattgaatttttcagtaattatataattacgtacatcttaaacaagtacctgcaaggtatccgtttaatttttgggcacatggaaatagtttgttttcactgtacatttaagttccacgagacatttatttactgatttaatggttggaaattagtttgcttttattgaactaatatttttagcttgttcaatcgtttttgctctcttatttacacattcaaacctaacatgcttactgatacaggaagcttcctcaagaaaacgaccattttgacaatgttgcacacaggacatcatgtgccaatgccttcgatggcatgccaagggattacctaaatgcacaagttctcgggtctggtgtccctgagttgcacaatcagaggctatctcatcctcgtggctcacagagggatttctttggtcacaatcagaggcaatcccatcctcatggctcacagagggatttcttcggtcaaagtaccgagtttacgatttatattaccatcgctaagaacatattgacttggaaaaatattcgggactacttcaagtattttcttctaaacttagtactatgtttactttgttttgaggacaagactaggtgcaatatgatttgaagtttcaaattataccactatgttcaattcaataatattatgatggtatttcttctaggaagttcggacctgtgatcaatgtctacatcccctttaagccagacaatgagaagcacactttcggttttgtgacattcgaaaatgatgacacagtggggcttctcttatcaaagagcacatcgcattccatcagtggagtagaagttagagtcaaagccttacctggataggaccaaacaagagcaaaggtactttatctaacttcactgtttcttttgttgattgcttctcagattgtctttaattaaccagcattttaaacctgctgttgtttttgttcaaacaatatctgattcgtgatttacaaactatactgttaagaacctgtttggataaaggggttagactcaaatctatagtaagtacattttaaccattcccaaatcaatccttctctgtcctggcaagcagctgggtgcacctctttttcagaggggttatgtcacggtattctgctaattacaggattagagtttgatgtgttcttgtttgttctgaggtccaaatggcagtcttgccacagtgtcctctcccttttctgatcttcatatatatagcttgcaaaagatcaaatctctctcatctaaggacttgcacgaaatcttccataagtgctttcttgaggattttaaaactagttattagctgaagattaattctggaagtcaatttgagagttcttgaaatgtggttgttagttgaaatatgatcttgaccagggacttctttttcatggcagtggttagtggggactaatttgattttagaaataattattggtctatgggacatcagtttcacgcttttttgttatcatgcactcatgcgtgcttcataaatcatactgacatattactcatttggttaattattttaagtgtatggtcaatttgtccattctgttccacatgtaccgtctttgtgaaaaaataataactagcttttctgtctgtacttaagttgcagattgaatttttcagtaattataatttatacgtacatcttaaacaagtccctgcaaggtagccgtttaatacatggaaatagtttgtttttgctgcacatttaagttccacgagacagttatttactgatttaatggttggaaattagtttgcttttgttgaactaatattttatgcttatacattgtgcaattgtttattctctctgtatttacatgttcaaacataataacatgtttaccgatacaggcagcttcctcagagaaacgaccgttttgacaatgttgcacacaggacatcatgtgacaatgccattgagggtcactctggtgagtaaatctgtaaatgcccttccttggctttgtgctgtgccacttctgatttagttctagacttatggttgtgattctatattttgacttattaagccatttcttttgtcatttctgataggacaaaaaatgccgaatttcattgaactttcccaggagacactgacacatcaatttggagattttgattcacctctaacacataacctctctgagaagaaaacagaatctccagaaggtattcatgtggaatttccctactccatattcatccttgtttttcattaaactgttatagtttttatattagtaagtcttagggcctgtttggcacagcttcagctccaactccacccctcctggagctggagctcagccaaacagttttagctccaccaaaactaggagtggagttgggtggagctctctcacaaaatgtaatagagttgtggagctgggtttaggcagttacacaactccactccagactcaacttctggagttatatttaggagttggagctgtgccaacaggcccttacttgattctgtgatgttccatatgatcatgcgaaacaagagtctaatgtggatgaatcttca

SEQ ID NO: 22218 - DNA, 2019 bp, Oryza sativa
tcaagatatgttggaaaattggagcacttctgatgctgctgcacagttgtacatctgtaacgttgaagtggcatttttcattctttatgcagcatagaaacttttttgagtaaagttcacagccggtccttaaagttgtagcgaggtgtcacttaggtctatgatctaggaaaattgtcaatacggtccgcgatcttgtttaagtgaatcatttaggtccaaagcgcctctgaccgggttgactggcttacgtggccgtccacggtggcagcatttttgcattttagccccgccgcatcttgcctcccctatttccgatccaggcagtctcccccaaatcctcctccttctacacgcgaccaaaattgacccccattctctcgttctggccgagctaggagcactccgaggaggggcggcgattagggcggagtcggcgatcggggtcagggtggccggagacgcgttctgggtggcgcgtttggccgccaaccgattgggcgccgtcatcgaaggcgtcggaggcgcgagatggacctgaccttgcgagatgaaggcgcacctgcgcctgtttatagtgagtgtcgtcgtcatcttttaatccctttcatttggtaagtttaatctgtgattgagaggtttggaagtttgtttcttcaagaaatttgggacttttggtcggtggcaattttttctagggtttcatctagaatgcaattagttgattttgtgttggtaaatgtgtgtttttttagctattgtgatgtaatgtagggtttagtatgttgtctcatcccgaatgtgtgcactatataggtcctggatcaaagtacttttcaattgagtttcatcatggggggtttttctgtggtatgggagtgaaccgcacatatatggatggcaaagtagactggtttgacaatattgattctcgagattggggtagatgtctacatttagcagactttgttgccatgcttggatatgactctgatggaaagttgaaaacttattggttattgcctggaaagaacatgtctgatggattgaggatcatagacagtgaagttgagatcaatgtcatgaaatcagtgtcaaataaaatcaagaattttgtcatctattttgatcatactaatcatgtctcaggaagaaatatagatgacattgttctgagcccagaagctgagttgccagaggtgttcaaccctagtagacagtgccagcagacagaggaggcagaaagcgaggatagaaaccctaggaatgcacctgatggacatgtagtgcatgaagaattggatgttggtgaagaaatagttgagctttcatataaactcagatgacagtgagtctgattctgattttgttgatagtgattatgagtgggaggatgatgatgatgacctctttgaggaaaatgtggatggtgatgtggaagagggggataggaagaaattcaaccataagaaggctgcaggtagtgtgttgaagggcaagaaagttgtggcagatttgtcagaaggtgacacaagtgatgatgaacaactgcacttgccaagtgatgatgatgatgatgagttcaacttgaagtttaagtcttttaatcctgaagacattaacaacccaatcttcaaagtaggcatggtattctcttcagttgaattagttagaaaggctatctctgaatatagcatgaagaacagggtggacataaagatgcccaggaatgatagaactaggatcaaggcacattgtgcagaaggatgcccctggaacttttatgcttcaatggacagcagggcaaaggccttcattgttaagacatatgagccccatcacaaatgcaagaaggagtggattctaaaaaggtgtactgcaaaatggttagctgaaaagtacactgagtcatttagggctgatgggaagatgaccattcctagctttgcaaagacagtacaaaaagagtggaacttgactccttcaagaagcaagcttgcaagagctaggaggctggcc

SEQ ID NO: 22219 - DNA, 1213 bp, Oryza sativa
ggattgtattttgttgcttgaacttgcttggatgcaaacaagttatgccaatgcaaacttaatgggttcaaatctatggtttctccaactgaaattgtgattttcaacttgcagacctgtgattttattcattcttgtatggatcattgccaatttttatttgctactgaattcatgagttgaaatgcaatcatacaagccaacattatagtacccaatttgcattgattccagagtaaattaagcccattgccattacatcttaaaactgcatttgttttgccacctacattcagacaacaccactacaaccagtcaatccagtttgcatatataaactgcatacacttatggccattgattctagagtgaattatggccattgccattacatgttaaaactgcataatcctcaactgacaactactacataatccacccataatcatcatcttatttcagccatacagcaagcaccaaacacactaaagcaacaacaagtaaaataaaaccaactagcatgcccttcaagatctgaactatctccaacccaatggaaactagagataacattagcttcttcacttcatcttccccaccatcttcattgttcacagccttcttcctctctgacatgtgcttcacatctcttagctccttgtcagcaatgtagcctttcctctcaagatacttcacatacccttctttcctgtaccagaaattgcatccagaaccatccttctacacacattcatcaattgcaagcactgtcatgttcatgaaaataaaggaactcaaaaaacccaaaaccaaatcaatcggaccattacctcgtggtcaggacatgtgaaaaaaatgcgcccgcgattagcatctgtcgttgcagtgagctccacgatgttcttcacgcagcagcaagggcactttatcaggggaaggtcggaccttctcctctgggcacttgaagaagacccactacttcgagtacccatggcctcccctaccagcgcacttcacgaacccgaggccgcctcccatgccgttgcctctgtgcgcgccaccctcctcgtcgtgggtctcgtcctcacggccgccgcccctattgccgctgcaatcactaaccctagaaatcgcgtgtagaaggaggaggatttgggggagacttgctggatcggacatgggggaggcaagatgccggggggggggggggggg

SEQ ID NO: 22220 - DNA, 27490 bp, Oryza sativa
  unsure (1)..(27490): unsure at all n locations
tgctttgtgcttttgaatgtacaatagcaacagccattgtatttcatatcttactcatatactgtattgtgtttcgcccccaactaattaatctggttgtaacatccgacatatgccaactgctttgcagggagcgctgtcttccagatgacctatttagtgaggaacagtgaaggtgaagcagcacttgtatgactttgctagttccaagccacctaagccagtcaaacaaaagggaaagtttgtgtacagtggcccggaggaatgtttcttagttgattgattttggcgtcacactgaagtcgttaggatatactactacacgtaaacatggttaagtagcagttgatgttaatgctgaaacagcttagtgcacttaagagtgtagccatacaatacatgttaatctttctgtgacaagaatgaaactgtgttaatcttgtgacagtttcattcttgagtgtacattctttggggggctgattacctattttttgacaaggtggttgaatgcctatcgagtgtagatttgctcagatatgtgggttaaaccggttgcatcttattaacattgtatataattgttattataattggagaagtgtttagacctatctatccttctattaatgaaatggcaggctgcccgttccctcgaaaaaaagaagtgtttagaccagttccttcacaaaaagaatgtattttgtgtttcagtgaagcatctaaatttacaggagtattttataggaggggagtgactgaatttgcacggtggagttttgttcttgaaatgctagaatgagtccagatgcagcatgccatagctgatgatgtcgttctgaaatgtatgctggaagataaacgagagggaacatattctgattctttttttcatttgaggggaaaatgtcattgttgggaagagtaacgttatactccattgcagaagatctacggtagaaaatatatactaaatcaactttaaaatttagttgtaaaatttaaaatttaaattttagctatagggcaaaagatagaaaaagcaacgataactggttatagctgcatctatcgaccctggattttttcttcttctcgattcgcatcaaaatataggcattttataaagttttagtagaaattaaggataacttgtgattgataggaaatatctatataaacatttatattgtataaattttgagtaatttggaacgggacgagtatattacgtcaacatatggtactaaatcttcagcgtcgtgcggtcgactactcgactccatctccgcacagcgcagggcgcagcctattggccttcctgtctccggactccggtaatgtacttgcatagttgcatcttctctcagccttcctaacccacgggctgaaagaactgtgacacattatgcaaacatttgcaaatactaagattaagtttaagatatttttacgttctttagtaaaattaagattaagagaaaaaatatctttcaattatctcagcaattaattttttgaattgcttagattttcctataaagaacctgatttgctgaaaatgttattcccacatattgaaatcaatgctctagggttggtgatatgggcccggggtatcatgtttagagggaggaggccgcccccgaacccacgtggcgccccccctgaggggggccgggcctgggctggagcgacggctgccccctcccagcttagggtaccgagtttgaaaggaggagactgcccctagacccacatgacacttccccgaagagggtcaggcccggggtggagtggcggctgccccctcctcgcttgggggtcgggccacctcgaccccctccacgtggcgccacgtgtgccgtgctagacgggcgttcctagcgcccacctaaccgcgtttaaggcggtctgagcgagcgctccacgtgcaacatttattgtggcgtggtgcgtcagaccggtccgtgaccgatctgtgaccgatgattgacatggctggggtagtgtgcctgcgctctggttgcatgtcaagcggccggctgacacccccccccccccgtcatgtcgcaattgtgaggggcagctcagcctctcacgtctgccggagacggtttgcctaacccggttagggcagggttcccacttcccggtgcaaatgaggacccaaaagtcctcactctttaaatgctgaatgacatgcgtgttgacactgtcagccggatggatttgacaggccctacgtcgcagcaaggtgtgcaacagacttccaagacaagcaataagaaatacatttaatgtgattatcctccctgaataggctcggcgggcccatgtggtaactccttgagatataaaagaaggtccaagcctacttagggaggggggatcaactctttgtctaactggcgcttgggggctcacgcgcttaagcatatgtattccacatatagtcagctaagcacatgagtagggtgttacgcttctcagcggcccgaacctgtataaatcccttttgtctctgtcttcgagggccccgcccccctctctttctctcatccaccacaggaatctcgaatctcactcgctgcccctggtcgaactaacaaagagggggcctcgcggtaccccgatagaggagctcacacttcgacatctaggatttaaaatttgtctcaaaacacaactacttgtgttatttaaatttttcaaaaaatacagctacttctctacctatctcctcatctcaaccaagcataatctttctcatatattttctcatctgaacccatcacagtcattttccacacacccagccttaatctcttattaaaaagggcacaagtacattttgaaatagagggagtataaattagtatcctaaaaatagaaagttttagcaattcaaatctagtctctactactccctccgtcccataaaaaacgaatctagcatcagatatgatatattctagtactacgaatctagattcgtaatgctaagatgtgtcatatccggtactagccatagccatctttctggttcccaccttatcccacatataaaaatattctgaaaaaccattaaaaaaaagagagaaaccgctcaaaaatccgcgatctaaaatagcatatgaaaaaaggttaaatgagagaaaaataccggataggagaaaatgttgaaccgctttaataaaaaaaaatcaagagagaaaattgaaccaccttcacctctgatccaaataggagagaaaatatggaagaagagaataaggccgtgtttagttacaaagttttttttcaaactttcaacttttccatcacatcaaaactttccttcacacataaactttcaacttttccgtcacatcgttccaatatcaaccaaacttctaacacaccgtgtgaactaaacacagcctaagttaaaccatttacggataccgtctctttgccagtggcatgccactaacggaaaaaaaaaagaaaaaaatttacaaaagctacctcatttagagatactaaattttgaaatgaaagaaatattgaaaggatatatcatctagaatattacatgggattaattaaaattcgaaatatataataaaataaattcagaaataaaaataagataaaattgagtgtttaagtaggaatataatttagaaaaaactaaaattcagaatggaaataaggaatattaaaaaatagtccgcgtagaacgcaacacgatattaattaaagttataaataaaaataaattctaaaaatagataaaaatgagttatcaagtagaaatacaatatagaaataataaaaaaggaatataaaaaacaatacatctagaacacaacagtggcaaatgccaaaaaagaatggggtagcggataagctatacatggttagtgtcgtggcggttgatgaaaaatctaaaaactataaataaaatccttcaatgatgagcaggtttgatttttagaatccaatgacgattaagagaaaggcaacggacaggccgtgaagcactaaggttatggcgattgacgggacttataaaaagtaaaaataactaggttcagttttaaattccaataacaataaagagtaagagcgggctggctataaaaaagtacagtaacaacatttgacaagacttctaaaaacaataaaaagaaaaattaacgagacaatgaactctaaaaattataagatatgatttttaaatgtcttaaggatgaaataagtcgtgacatgtcggacaagtaaatagaggcagaataaaagtaacaggtgatggctggtgtaactttgaagagctataaaactgaaaaacaaatattcaatttcttttaatatgctaagacaacgagatgactatttaacaaattttgagaaaatcacgtgaaaaaagcttaaataattttgtacgggagctatggccacgtaaatacacggcccaccaggtagtttttataatttcaaaaaaaaaaaagggacacgtttgtgttcgcacttggcacacgaagaacaaccgcaggtcggcgcagggcctcctctctcgtcgtcagtcggttccgcaaaccgctctcccttccggcgaaaatggcactataaaccctcagtcccaagatttagggaacaccaactggcgaaagctacaatctttccaacctctggaccgattcccatctgctaaatcccacctacgcggcaagccccgcggcctgcacacgcggcgacgtacggcattcgcgcaatcgcgcccgcttgggggtttcacatggtggcgttctttcttcctggaccaagaagggatccgcgcattaggagaactgcgagacaaggtgggttcttgggagggtttgtggggggtatctggtgcaatctgagtggttttggttgaattctgggggacaggttcttggccagaagcccagaacgattcttggttgcatatatgttaaatttattgaaatttcgccttttctttttggcgtgttcatgcgaaggatcgtggtcttcggtcggttttggttatattatagggatgggttttttggtacggcatttcttgatcttggattcgttcggttttgttatattatagggatgggttttttggtacagcatttgttaatcatgggttcttctcgtattctgaagaggtttggtggtttagttaaggtagagttgtaatttgttatccagaattgtttctgcatttttgtcgtttgatttttggaagcagcaactgggagaacacgaactcggtgttgtttgtggtggaaacagtggaatgtgcaatttttcgtttttgcttggactaaagttctatattgtcacagtatttgcatcttaaccttttaattaatcataaaacaatctcactcttgttttgcattgcagtgaaattatcagaaaacaatctcctactttttctaggtggaacttttttttatagaatgaaaatcccatcatttcgtttctgttgcaggaatcaagaaatggctatgaacaaatgttcagtgctgctgaatagagctcgggaattcgagccatcgcgtgcaaacggtggttacatcctctcaacaagttcatacccgcagatcagacagtatgcagctagtcctgacgagcatctacgttccttaccctcactgctgcctcctccaccggggcaagaactcccactggcttacttgagggctcagcgtcaatcaagcggcaattatcgtggaatccaagctcaacgtcgcccattaattgatcaaactggagcattgcagagctcatttcctgaatccatctgcttaaaggaagagttgcagtctttgagcatgccaaggaattctccaaatgctggtcgaaatctcgtcggacatcctcatagtagctcgaagtcgagttccaagccttgccatttccatttcttcaggggttactgcaagaaaggtgtcaactgtcagttcttccatgggtccgtccctgagctgcataatcccaggcaagttcacccctttgcgtcgctgagcaagctggatatggagatcagagaactcctgatcggaataccaccaccagtcgcagtcgatcgtttgccgtcgatgtactttgagaagtacggtaagcccctgcggcctgatggatggctcactgagagccagcagcatggaaggactggttgcagtcttacaagtctgctcatggggcttaacaccatcagagtggtcgagaggttttcttctatgaatttctgatatggctctatcatgattgattatttttcttttttcttcacatcctgatcatggctctttccgttttcaacttcagagaacatggacagtatcatgtagtcctggtggaagatgctcggaagaagtacatggattgcttgggcttggctcacagttgcaacttgatggatactggcactgggtctaaccagatttatatgaccttccctgttcacagcaaattcactgatgatgatgtcgagaattacttcaagtattgccttaactttattgttactaggtgtgaattgtcaatttgtcatgttattatgttactgtgatgacaatattgtcttgataatgccaggcaatttgggcctgtctccggtgtgcgaattccctatcaggagaagcggatgtttggttttgtgagcttcctatacactgagacagtgaggcttatcttatcaaaggggacagctcacttcatctgtggattgcgagttcttgtcaagcgctacatggaaaagtctgaactaaggtaacactctactgttcaatagggctgttttatgtcgcttgctgtttctgacattattactaccacgcattggaaaccactatcgatttcattaaaatgattccttgctttcatgcgtggcagaccaagacgttaaagatgaaaaatgatatttgcttcccctttatggtttacccaatttaagcctatagtttttactattaaggatctgattatgtaatgcgggtttacaacatacagaacaatacccctcatccatacacacatgaaaattccataaatgcaataatatttattttatttgaagaatgacatggctgaagagtgtttctggaagtcaagttgatagttgtttgaaggttaccattggccacactatagcaaaggcaccatccaaaaaaaagaaagaagtcaaagaacagtgtagcaaagaccaaggccccatgttacattacagtaatcagtggggctaatttgatctcacaatcaggacagatctagaatatcatttttgcagagattgattccatgcttatacttcatatttacagcactacatcagattaggggttcaatttgcatttttatcactgttctacacataccatcgtttgtaaaatcattagcctatcttgctcagttataattgttgactgaattttgtctatcagtgaagactttattggtgtagtttctttataactattctttttagagaaatggtgaactaatatttcatatttgctggttataccttgtgtaattttcttttgctctttatatcttcaacttgaggaataaccaacattctattcccatttactgatacagaaaaatttatcggaaaaataagcaatttgactatcgtgaacacaggacatcaggtttcggtgtcactaatgagcattatataggttagcaaattcttacacttagatttgtactgtgtcacttctgagggaatgattacgattcagtcgttttccttgtcatgtctgattttgtctcatgtaaatcttccaggtaacaacatgaaaaaaaaatcacacaggtcggatgatttggatgaagcttcagcatatgaagataggtaactgttcctacttatgttatttcagttctctttaattcttttttgttttccaagataattcatctggcatttctagttataacatccgagtcgtctgaactgttttgcagtgatgagatcattcttccagatagccttggtctctactgagcgctattatttcttcaccaatactacaaacacactgacaagagattatacattggtacacaaattattattattattattaattatttacttgccatagattataaataggtacacagacgcagtgaggtcaagtaggtttccacagattattattaatagtagtagtaggatggtttttgggttatacttataatacagaacttaggattcacaagtaagcatggtcaagtaggttgttatagaaagggttattttgcagttagcagtaaagcagaaacagcttgacgtacataagcatagccctgagatccagtctatttttttgtcatgttgcttactacctagacatgtaatacgtgctttttcctgataagttgacaacatttgaggctttctttacttgtgatgcgtcgatttttcccttttggggatttctccccggaatagcacctgaccaccagttccagttgctcaaaatgcaaacaattggccactatgttttcgaaaaatcatactccctccatccctaaatatttgacgccgttgactttttttacctaaatatttgacgccgttgaccctaaatatttgacgccgttgactttttttacctaaatatttgacgccgttgactttttaaaacatgtttgaccgttcgtcttgttaaaaaaaagtaattattatttctttttctatcatttgattcattgttaaatatacttttatttatacatatagttttacatatttcacaaaaatttttgaataaaatgaacggttaaacatgtttaaaaaagtcaacggcgtcaaatatttaaggaatgagggagtatatctttatcagtctttagatagcttttcccaacgttcgttccttttccagaatcagaagttacttcctccgtttcacaatataaatcattctaacatttctcatattcatattgatgttaatgaatctagatagatatatatatctatattcattaatattaatatgaatatagaaaatgttagaatgacttacattataaaacggagggagtatttgctaaattctacctttcaatcaccagtgacttatctagatcagttatatcgtaaatgctgtgttgcagcataacgttatacacgaaaaatatgatttcttctatatgactagtaaaccaaacacaacacagatagaagccacagcaacaggaataattttccaacataacaaaccagaaaagcgcacaaagtacagatcgaactggtgatagaatttctatcatttacaaccgtggaaaataaaatatcgtgcttaacgacgctacagacttacggcaacgtaggatgctgcctaatacatccctaatagatggttagtttgttgtgctagacatatttaacattagctaatggtcaaggtgatgtcaccgtggcagtagacaacaaaatgccacatcaaccattctggtgcatcccttttcatccttagattgactcctggaacatccatttgtttttcgactggaggaatcagatgaagaatttacaccttgttgtaataggagtaaaaaaaaaaggaagtctaaactgtagttagtgatgtatctgtgatattgatatatgtgtgccgaatgctgatgattgaataccagcacagcaacccaggccttttcctgcaaacagtaaatcaatcagcattgctatgaaaagcaacttctgtaaaataaactcaaaatatttgaggtactgcgtgaaatgatcatcttacagcgtggcataggttcaaaaacaacctacttctcaatcatgaagtatctaccgcctcgatgttaatgttttccttccagtcttctctgaaaaacctttgagcagcatgctctgacgaaatgtatgatacttttctaagctagtcccagcccacctcttgcaaaatcgctcatctgtaggcacaaaggagctaagagggaatggacccttaggagctttcttcaatgaaacaagaaaacggtgacggggacggattctctggtcaagggacaagctcaagtacataggatactttgtcaaggattgaacatcgtttttaaggtcattgaccaagtaaagatactttggtttgagattttcctccaaggacaaagacaacacctgaaaagaaacaaatattagagggtattataatggcatctgtctacattgaacaatgaagatacttgtaaaaacaaaacaaaaatgaaaaggatagggaacttgaatgtggtaatacctgagtcagactcgtcaataccttgagaacatcagtatctctcatgccaatgcttctaaggaaattgattcgaggcaatattccatcctcaatactgtaatgaagcagctgtgggtgttttgtgaccattttaacaatgttatcttttggagcccctaattcttttgatagaaaaagaaatcgagatttccatgcactatcgattcgctggaccagaatctgtgggcttagttgcactactttgcccacatcactctcctcaatgcccacttcctcaatcagataccttatggttggcttcagagactgctcaacactgtaagagaaaaatgatggagcagcagaaataatttgacctatccgtgcactaggaacacctatgcccaccagaaatgcaacatgagacttcaggttgctgagagtgtattccaaaatttgtggttgtctaacaagcatcctcttcatatccttgcttttaacaccaacacttagcaggaactccaacctttcttctgcagaagcttgactgatttgaaagcaggccatgtgtctctcatacatgtttgtaaaatgagattccttcagtccaaatgtgcacaagtaatcgattagtggtaaccatttatcatcaaagtcatattcttcttgaagtttctgaaacaagcttctagagatactttcatttttcaactgcgaaaataaatcaatcatttatcctgcatacgttaaatattgaacataaacaagaacatggacacactgaatcaaccttagtagtctacctctacttcattatctatgtccacaagaccagttgatctgctagctttactcttggcatgcagagcatcgactttttttgaagtgtcacatctgtctcgtgttttaggtgtcttccttcccagttttgtttcagcgctggtttttcccggcctggagaataaagtattaatacaaagtacncactggatatcagggattttcacagcctttcatacttggtttcttgattggagcacgaggattgtttgaataaagtacaccaggatactccaaacctgatagatcatcctgaaaagagtaagagaatatattagaatgctggaaatgtagaatattgccaatggtaagtttctcatatttcattctatgagaaatgaatgaaagttagcatcacaaaactttatccttttgaatccaataatctgcaattctgcctggtttggcatgtggactaaacacccagtgatgcagtatactatatattgaaaactcaatgcagaacagatcatatagtcagggtggcagaagaaacataactgattctctctccctctctcttttaagtcttcactaatcagcagaaaagcgagtttcgctgtttctattggtccccgtatgttggatatggtttacccaaggcagaaatcaaattagtctctcaccctaatgcccacctctacctactgttacccagctagcctaagtttaagagcataccattgagtatttaagcacataaatatgcatggaacaaataaaccatataaataagaattgtttaactgtggcagccaggcagaaaacttttaaaacagtttatcatatgagcggttaaggtgttataccattaaatacaggaacgatgatttaccactagtgcgctcttcacaaacttatgcctcttttaactcaatgtgcatacaacattacatcctacaatgtttgttgattcctttgacaaacttatgcctctttaactcaatgtgcatacaacattacatcctacaacctaatgagatgttggttagttcaatttctgaaactctctagcctgacgcaataaaatggtatcacatctctaatgtactccaaaacaaaaggaataccggagctctagttacataatgagcagcagttgaatgatattccttccggagctctaattacataatgagcagcaattggatgatgatatcatgtgatagcacagccttgcacttatcccatggcacgagcttgagtacgcaagcaattttagctaaggacccagccactcaggcaacctctcacgacagtagcaaagctagaagcggctactgccaaacgagggaacttacatcggtctcgtagccgtcttcctcctcctcctccccttcctcaaactcgaactccgcctcatcgtcgtcctcgtcctcgtcgtggtcgtagtaggggtaccgggatcgccgggagcggcggttgggcttgaggagccgcacgttggtctgcagcgagaaggcgacggcgccgcggcgggcggcggcggaggcggggcaggggaggaggcgagggagagggaatggcgcggggcggagcgcggcgagcggcggaggcggcgccatgggagggggcgcgtaggcgtagtactacacgttggggccttcgattccttggatttttatccgcggcggcggtgggggatggatgagaaccaggagaagaatctttcgggatacgtggaaccggggagcagcggaatcaggcagggcacgagaagaagagaggggtttagccgacttgggctgggccgcttcatcacaggttgggccgaattttggcccgtggtaatctggggatagtgggttcctccattttgaccttggaagattttgccttatttgatttatcgttcacttaattacgttgagacaggcgagctacgcgcacatacacggactggtttgagtgtaaaaaaaaatagcttttactactcccgccgcccaaaattatagggcgccctgtttttttttaaaaaataaacttggtagcttttgagtaataatcatactaaagggtatttagatttagggctgtaaaattttggtgtgtcacattgaatatacggacacacatttgaaatattaaacgtagtataataatgaaacaaattacagaatccgtatgtaaactgcgaaacgaatttattacgcctaattaatccgtcattagcaaatgtttactatagcactacattgtcaaatcatgaatcaattaggtttaaaaaattcgtctcgcaaattagtcgcaatatgtgtaattagttatttttttagcctatatgtgtaattagttattgtcagggttatggataccacatacctaatagtagttgactaaatctcggcaggacccaccacataccatgtcttatacggaaacaaccttcggatatagggggagttccggataaggaaagataactagagttctatatgaaaacgacaaggactactcggattgtatccatactgattttcctagttctacttggacaaggggacacctatgggtataaatacaagaccgcctaggaggagagggacacagacaacatagacgccacaaagccacaggccaatacaagcctacatacgccaagacaaactgccagatatcgacatcagagataagcctgggaaaacccaatatggtacctacgggaaccaaagagaggaatctagcgctatctctgacctcgtcgggcacagattcgaggaggaagactaccctgttgtcgactacgagtcagcacttcagaccgccaagtcgacaacagatagataggctaccccaaatattgtactggtgtgattatggtgaataagagcaacgaccggtttcggccaacaggatgtagggctattacctgacaattcaggggcccgaacctgtataaaaatcctctcctccgtctcttttacctaagtctcgcgtatatcctagtaccaacgatccccatactatgcaaataccggaatcgcgacatccaacgtcgacagttatttaatacttcatgcaggtgttcaaacgttcgatgtgacatggtgaaaaattttggggtgggatttaaacagggcctaactatatctatactaagtattatgcatgttatattactagattcatattttgaattactttcatgtgatgctaattttatatttgttgagattatagaatgaaataaaatactagtcaaactatgttattgaagaccatgtaaaaaaaatataggcgttataattatattcatggacttttttactttaaaaatcactcgagtgatatatattagtttatggacacatgttacatataacttataagaaacacatgatcgaaccggataagagggttgggtaaatccgaacccaaaatcctgctctgcttctctatcctcacccttcatcttgccattgatctaaccctacacattaattaatgccacctcagtgattgtttagatgggatttgagtaaggggccaaatatctttttattagtggggatttaatagtatccttgagaaggaatagcgtttaatgttatgcttatttgaacaatctcttagatttctccagtactccctaataataatggaattaataagggtatatttttcaacgagcaaggtgttagtgaaaaaaaaatgacgaaccgagtgaaaggtcgttctcaagactcgagagattggacatttggactgttgacaagagggtgactggtgccatgtacccatgtggccattcattatgacatactaataagagcaaggttaatagcgcagccgctgcaaaataatccacctcagcaaaagtaaataaaaagaagaaatactacttaagctagtcatagttacttttaatattttattcaactaactttacgtatcactcggcttagctccatccaattggctggccatgccctcccacttatgggccccaccactttgcgttggaggctgtgctagagctagcgctaactgaagcgctcgcctttgcgtttcctaaccttttctcccttccatgtcagcacagatataatatttaaagtcttaccacctactattatacctgctctaagttgatactactccattgatcagtgtttgcatgtctagagacttttggtgtaggccagtgtggtgcattgcatctgcacatcctatccattttgttttctgtgatgtcaacataagaagcagctgatgattatgggtacttttgtatgcaatttgggtgtctttgttgattataatgatgccatgctagtttggttcgttggccttttttcccctttgatctacctttttatgcaatattatattttcacttagaaaaagaaacacatagcacctcacaaaacctaatggctattatattattctggcctagaaatttatcattgaaattgtcttaaataagtgtaatttgaaagtaatatcttcctctccaaccaccctcgtttaaatttcttcatgctttacccccaaccacctctcatttaatgaggggtatttagattatttccctttttctcctaatattaaaactttagtcattttgaaatggagtaagtaaaatactcacaaccacatttcatgccaaaagtagattatgcctgactacttaccactacaacgatggattctaccactcaattacatgacgcgggagccggcgagagaataaaagtatccaacaaagctaatgccatttgtgaaaacaataaaaaaaaggtacatttattgtctcccctttcttggcagtatatccatcagtctacatatatttttaactaacccatgcaaaccctaaaaaacatgttatcggactaagaacctattgctgctcagagagggagtcagaaattaccaaaacctagaactcacatagggctcaactactagattttaagttcttttttttcaaaaaaaaactttcaatagtgatttaaaaggacctaattgtgattatgtaggcaaaagccctggttgctttaagcttgcttacgtctctccctatggtcaacatagtcacattcaatctccctcaccaaaaatcaccacgaaaatgaatgtaaataataatagcaatttaatcgttagggtttcacaaatgtttcatataataaattacatcgggatattttatcacaattgattattttgactattcttcattacagaaattgtttacgccttgcctacatagcagccaaagcaagaagttagcaatggcaataaagctaccatggcgtgccattatggcattatctatcagccacaaagtcacgattcacaaaagctcagaagcaagcaccgaagcgcgtcaccggctcaccgctcggacgaaccactgtgcagccagccagatagcacacgggaagcacgagaggagctcgccgcttgcttgggtctctctccatgaacccaaataaaggcggaccggtttcgaccaccccacttcgcattcacaccatttcgtcatctccccaattcgcggcgacgccagtgagggccgtgttttttcgtgttagttgatctggtgattagaggatttatatatatcatttttcgtgttagttgatccggtgattagagggtttatttatatcgtgcattcgtgcttctttggcgagcagtgtctgatttttatctctagatcccactttaatgcatacacatgtaactagtaaggctttgtttgcaaataggatagggaaataatattccaccctccaaagggtagtattgtatcctaactatccattcatcacacctcatttaatcctaatcattcatccatttccctttctcaatcccacctctcataacccatttgtcaaacacatcctaaatagaatatcataactcacttaaacaatatatatagtgcattatgatcattggattcttaacaagagtcgatctctaattcatttataaaaaaattatatggttatatatcgttcaatattattaatctttatagcattctagattatgtttaacaaaaatatctttccagttcttagaaaactagttaggtaccttatataattacaatatcattaagaaatataataattgttgtttactcatgtaaaaacatagataatatatattacggagcacacacatatgagttagctgctagtattcatgtgcaagtactagtgttgattgtagcaatattattatcaaaaataaataagaatgagaaagcgagaagaagatggaataacagaagaatataaggttaaagttttagttttacaccgtattaagacgaagaataattttaataatattagtatattatcgattaatgtgagtatataccataccatggatgtgagtagcttttccccacgtgtgtttgagctaatgactaaacctccttttttttcttatcttctttcgaagttctcctaacgtgtttggtagaaaaaatgttttgttttgaataaaataaagaaacttttttgactagattattttttaagagaatccactgtgtgccgctgactttgtccctgttctataatatggcactgagtttgttaagttatacaatatgctatcgtattttgcttatcctctgtaatataccgtcgccgtccatttagacttcgttagtactgtataattttgttctaatgaccgaaatatccccgggacagaaattccaaaatttgacagaatattccaaaatataatattataaacaaggcagagaagatatccatctcaaactttggaagtttacaatgagatatttgaaatttttcgtcccatggctatttcggtcattatgataaaattatacaatactaacagaagctaactagacgacgatggtatgttatagaagttaagcaaaatgcgatggcatattagaacttgacaaacctagtgacatattgtagaataaggacaaaatcaataacacacaatggattcactatatattttatggttgtttagttcattacctatctactatcatgcagcatttttataaaaagttaaatcttatactataagttcatatcttacacattaaattacatacacttataatataattttcaaattatacaatgccctcttcacattttatagtagaaatatgaaaaatgatttattaaatatttaattatgagaaaaaatattagtccaaattaacgtatatgtagaaaaaaataatatgaaagaattacggtaatacctacaatcgtatatcatgcagtgagaaaaggagaccacagtcgaatgctttattgttgagaaaaattgatggcattaattttatctttttttagctgaatctatataaccataattaattatctcgtgttagtagaagtatgcatcttcatgcatcaacatatcatgagactattagtaatagccaagtacactgacccaacaatacttaatatatcacaagactattgagtaatggacaactcatctttaattgtactaatgacttagtatatcacaagagtaccaggtaatagacaactcatctttaattgtgctaaaccaaaaaagtaaattacagttcgtactatgtattcttaaaagttttcatattatgtcatcctttaaccattcttttcatttacagaacaactaactttacatttcaatttggaccaccctatttcaatggcttagcttgactacccatttagcaatacggccgacgacatctttattcctgatgacttctcccaaaggggaggaggagatcactatgaccttatgggcttggaagttgtggtgtagctttctggatgtcatgatcacagcgtagaatagtttttggatctgtggatatttagtttttgcatcgtggagggccttgctgacatagacactgggtattgtactctttccctctctacaacgataaacgtactcatagaataaggtgtggcagtaatataaatgaataattcttcattattttgtggggcaactagtccggggggtttgacaagtagcgtttgagcgcaatgaacgcgctctcagcttcttgggtccactcgaatttgtcctgcttcttgagcagggcgaagaaagcttgtcctcgttctcccatccttgcgatgaaacgacttaacgaagccatgcatcctgtcaatcgttggacctccttgagtcttgtgggcgacttcatgttctcgattgccttgaacttctcagggttggcctcgattccccgcccggagaccaggaagccgagtagtttccctaacggtactctgaacgtacacttctccgggttgagcttcgtttgatatcgtcggaggttgtcgaacgttttccttaggtcgtcgatcaatgagtcgcccgtcttggttttgacgacgatgtcgtccacgtaagcttcggcgtttcgtccgagctgatcacctagtgctccctggatcccgcactgatatgtgttgcctgcgcttattaatccaaacggcatcttggtgtagcagaatacaccgaaggacgtgacgaacgctgtcttctccacatcctcttttgccatgttgatctggtggtagccggagtaagcatcgagaaagcttaagaactagcagccggctgttgaatccaccagttgatctattcgagggagagggaaatggtccttggggcatgccttattgaggtcggtgaagtcgacacacatcctccacttcccgttggcttcatgtatcattactggattagcgagccactctggatggagggcttctttgatgaagccaattttgagaagtttgtcgaattcgtatgacttgtgttcgatcaggtgcaaatctccatagtttttgcttaactggcttggcgtcgggttgcaccatcagtttgtgctcaatcgcctccctgggaactcccgacatgtctgacggctgctgtcacgcccagaaatttcacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcgaaaaaaaaatgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaacacagtaaaactgttgagtaattaaagtaaccttaaatctccactgatcaacgctacaccacgttgaacaggcccaaccaacccacctaaactacagtgtattgggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagagaccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccctgaagaatggccagatgtctcgagcacgcagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattaggtatgaattttagaagttttaagccatttaaatgaatttctagaattaaactcgatttattgcgcaattattatttatttttacaaaggaaatggtcctcgctgacgtcagcaaggggtgaggcgcggaccacgtccacaaagggggcaggccccacacgtcagcggcacggcccaccgtggaccgagtccacggtggcgatcggccacgcggccgcgcacccgacggtctagatcggccaaggccgatcggacggctggggacggccgggcggcgcggcctggccagcgcgcacacaaggctggcggcggcggcggccgggaccaaagcgacggcggcacacgggccgggcgtcgcagggagcggcggcgcgcagcgcaggaagcggcgagaggaaacgggggcagtgagggagagggatgtggcggagctcaccgaggggcacggcgacggcgagagcagccggcggagggaggcggcggcgctccataggtcgacaatgaggaggggctcccggcggcggaaggcggtgaccgggcggcggacggggaagagcgggacgcggcgaaggaggcgatgcggccggcgcgtcgcggcggcagccggggtgatggcgaacggcgaccggagacggaaaaaaaatggccggtagggtggcgtggtagggaagtggttctggtggtggaggggaaaaagggatggacggccgggcttgcccttgcggtggtggatctaaccgaggcagtggcgcggcttgaggtggttgaggatggcggctataggcggcccaaggcggtaggtggtggtgcacgagacggcggtgttctgaaggcggagaggggaaatggagtagaggccgggctgcggcacggtgccgcgaacccgacggtggtgtcgtattggcgcggcggtgggtggagcaacggtggcgggcggccggagctcgccggaaaccgacggtgcgcgggaccggcgtggggagggggagagagagcacggctggctcgggtgaggaggggaaaagagagagcatgctccgggttcgtttttatagggtcggagcggcggaaacggggccgagaggggcggcaaccggcgggaaagtggggcgccgacggggggtggtggtggctcggccggcgccggtttttgtgggacgagcggggaaaatggtggaggacgtggaggggatcgtgcccacgtcgttggatgcgagctcgggtgcgggagggcgccggattttgcggcgacgtgggcggcaatggcggttggggttggccggcgagaggtaggagctgacaggtggggcccacggtcccacctgtcggccggatggagagagaggagggaaaccgggggacgtaaagcagactttcgcaaggcgcgggccggccgagagagagaggaggcgcgcggcccgcgggagaggaggggaaggcttgggccaagcccaaaagggaaggaaggagatttttatttgttttctttttatttaattggttaaatgatctttgtgactttaaaattatttcttgagcttcgaaaatttgcggaaaaatccggagagtattttagggcacaaagaatattacaaaatattctcggccaatgatttttaaaggaaatttttaattccctcaataattcacttgattaagttgatttaaattttatttaatttctagaaaatgtattattaattgatttttattcccgaacgaaaatcggggcgttacagttgccaagcgaacacgtttgcattgttgcggaggaaggtgatgaacgcgagttcctatttgtcatccagctttgccccgatcttgatggtcttgtcggggttggagttggacaacggaataatcttgatggcgccgtctaacttcggtttcttgttgggcttgctcactttcttggggtgctcaattgtggcgggcgggttgggagtatgctcgaccatgtcgaggctccgcttgttgcactgcaccgctaacttggcgtttccctggatagtaattgtcccttttggtcctggcattttgagaacttggtaagtgtagtgggatgctgccatgaacttcgcgagtgcagttcttccaatgatggtattgtaagtggtatcgaactctgcgacattaaaggtgatctgctctgttcggaagttgtcggcttgtccgaaggtgacgggcaatgtaatcttacccagcggcttagatgatgattctggagtgatttcatggaagggctgatctgtgggcgtcagctcgcttcgcggtatccccatggcatctaaggtgctggcgaagagtagattaatggaacttctgccatcgatgagagcccgtgctaccttgacattccgaatagtgggttcgatcacgatcagatatctaccaggtgtggtcgcgatcttcgggtggtccgtctccgagaactcgatcttgtgttgggaccatctcatcttagcggtaggcccctgcgacgtggagcagacttcgtgttctatctttttgtactccctttttgaggtgtacgatgtagaaccgccgaatatgtgcaagacatggaggtcgtactctgggaacgcggagttggagtcgggagtggccgcctcttcggccgtttcgacaacacgtactcgcttccctctctagagtgctagttgtcgcgcgagctcctttttgaagacataacaatcctccatggagtgattgttagtcttgtgtatagggcaccattacttcttcgagtcgtcgttttgggggttcgagcgcttgggtgggtccgtttgcttagcggcgaggacctctcccgagggtttgcgcttcccacttttacgacttcttttcttgcttgattccggcgcgtctttgttggctgacttcttctcctcacctacactgctctttccttcctttcatctcaaggcgtcatctgcatgagcgcatctgtcaatgatctcaaatagtttgcaagcagatgtgattcttcgagttgccagttcctggttggtgtatcaatctcggacgcctgacttgaatgtgcggatgacagaagcgtcagtgatctcggggatcgtattcctgcactcattgaagtgccgaatatagtccctctatgattcatctgggttttgagttagggcatgaaggtcgtcctcaatcgcgtgacacttgtatgttccctggaagttgacaacaaactgttaccacaagtcttcccatgaagagattgagtagggtgggaggtgaaccagtcatgaacgagcggaatctttcaacgcgtctggtaaatagtttgccagcgcattgtcgtatgcactagcagcgtagagaattgtggagtagacttgcagaaattcttctatgtctgtgcttccgtcatacttctcgatcgcccctgtccggaacttttcgggccatcgcacatctcgcaatgtgcgcgcaaacgctctgcacacgcctccttgggcgaaaggtggcccgcggttgtgatgtcgtcgaggaggcttgtccgatgaagaagatgaccaagacgaagacgagggatcactagggttaggagcccagcttctcgaacggtggtccactagggttaggagcccagcttctcgaacggtggtcacgtcttcgatctcgcctagaggcgggagaccgggagctacgttctcgtccgttgttgctgcctcgcctccgttctcaattgttatctccattgtcttggtggtcgctacgggcctgccgatctcggtcaccgttgggatggcctcctcgatccgcgttcccacctcggcgtgaaagggaacggtgacggtgttgacgtgagcgatgttctctcctcgtctggagggagagcgatgctgatgacgatcattgtcattccaatctcgcctgtccctccgccggtcatctagatgttcatgaaggtcacgattttcaccacgcgatggagtcgggtctcgagccggtggttccctagtagggttttgcgcttccgcgttcccgttagctggttcaccgttccctcccggtggatcttggggtggaggctcgactgctgcatccacgaatgcgctgttgaggttggtcacagtctctcgtagtcgtgccgcccactgatcgacatcggggtttaggacagggtcaaaggggctctctcttaatattgcgtcgaggttccgcagttgttgtggaggtgttctcgcggccgcggaagcacttgtctcgacaccattgatcacgttcacgtctcgtggtgagtctgaagaagactcgtaatctttcagtaggtgcagcatggatggctcgctagggttgacaccgataaagcctacgaaccgatctaaagtcgctgcgtctcgttcctcgacaacgcactgagattgatctcgtggttgtgggatgtgaggatgcgacgacttgaatgtcctaaggaagattatgcaacttgtgagatcgtgggatctcgatctatgaatcgggcaataagtggtgcccgttggtgaagtgcgttgaatcccacgtttccagcaggcgtagagttcagcctttgcgtgaagtatcacgaggcaatcttccagagtatgcttggatgtcttatggacgggacaccaagacctcggtttctggatgggtatccttgtcggctctggtctcttgttcagaggacagaactcggccgcttgaggattccttccaggtactaaggccgtcgatgttccattctccacttgcgtgggaggaattgtcagcgaagcgtcatttctcgaagtcatagccgtgccgttctcgttcccaatagtgattgggcttgtcgagatcggcatgacggtgtagaccggaaagacaatagtcccgacttgagtccaaaccagcgatgtcgaggtagaggctccttgattgacgccggtgttggtactgttgtcgggatggcttgaagtcatatttgtagaaccttgagcaccaagttcccctacctggcgtgccactgtcaatgagtggtactcgtagaccggatgatttgggtattgggatacgttggaacaaggatttacgtaatatgacatcaagcaaatagaagacaaggattatactggttcaggccccttatcaggtaatagccctactccagtttatatgggattgatgatggaaaaccacagattacaaagaaagtagtcgaaactgacgatactgacgagatcgtagtcgatgttcccgacgagatctcccggtgacctagctccgagtactctggcttcgtaaactatggtgggtgtgttggtgatgaattttgatgccttgcacccctccttgggccccttaataccgtggatcatcttgatctccaagtaaaactcagagacatcggatcttgtacgatataacataaactttatccccaccaagcaggactttggaaatcacttgactcgtagagatattttccataattcgaaataaattccttcggcgtacacgagaacaatccgcatacgtgaagatatgccatatctgtgggaaatttaactatttgccacttttaggtttgccaaatatccaaattcccttcttatatttgcccttattttcttgcccttctaaggttgtgcccttttaactatttgccacttttgcctatgtggtatgccaacatggcagcgtagtgcaaaaatcgccgtgggacccactcgtcagtcacacaactgtccctttcccctctctccggtcagccccatcgtcctctccttcattcccgactggaggtcgtggttgcggcggagtgcggcaaggcagaagttgaactctcgacggcgctcggcttctcctgcggggcctgcctctccttctgccatggctccctgtcgaggga

SEQ ID NO: 22221 - DNA, 3154 bp, Oryza sativa
ttcgctgccacctgccaggaaatagagggtcaccggcaatgaagggaacggcggggctgatcaaagacagagggtaaggggacagttgtgctactgactagtgggtcccacggagaattttgcaccgcgctgccacgttggcatgccacatgggcaaaagtggcaaataagtaattaagaagctacaagctaagaggggcaagaaaataagggcaaatataagaggggtatttggataattggtaaacctaaaagtggcaaatagttaaatttccccttttctccgagtgtcttccccttccctttgtggcgtaacagaaagaaaacctctcgtctcctcctccttgcgccgccaagacgagtcgcggctgaacaggggagtggcggcgatctccatctggcgagcagagcaggggagaggatcatggtgagcatcacatcctttttctgattcatctctctctcccatcggttctggaatttgcttgtgttcgttcgttaaccctagcttctcttctagatctggaagaagctcttcccttaatttcagtgccttaaccttaatacaagtaacagtttgtttgttccccgaaaagtttgggtgtcccaagttggatccgcccctgtcctggcgatgattttgtgaaatagaaccgacgaaatgttgatttctggtttacttgtttctgttcctcttcttctgaatcttcgcaggaagatccgtggctgtgcacatctgtttgcttttgaattcatatttctcctgtatgtagatagtgtagtgtacttctatgatgatcgtgcctacctgtagtttaaaccgttcatttcgtaacaaaagatatgtttatttttaggctatgcttcaatattatcctttggcaagatttagaggatctggtaacaagtttatcaagttttgttgctgactaactaatgtcaggtttagaataacagtgacgcagagattgattttcctgatccgagagcgaacattcactagttgtcttgcattacatcacttcatgtaaccgcatattctggattggcctatcaaagacctagaaaacctggttatgcatttacgtgggctagccatcatatttggtagtatatagattactttataacgcatttgaaatgtcgacgaagagtattaattgacccatgcaattttgcatttgtcgtctagcacactacaacgcttccgatcctgcgtaacttcaatttagcatatattttaatgtatggttttattgttttcgactcctatgctttgattcgaaaatgtgttccaggataagatgtgaagattagggattactccctctgtggctctgtcccgaaaaaaacgaatctaggactggatgtgacatattctagtacgatgaatctggatagaggtatgtccagattcgtagtactaggatgacatccagtactaggttggtttttttatgggacagagagagtagtttggaatcagggtccaccaaatcgagcagaggatattactatttttatgatatagtaaagcatttctaattttcttgtcagcattatcacgtgccattgagtatcatctaatacatataataaaggcacaaaaacatataactcacccaatacgcttgattttataatttcgatggatttagttatgatcaactttcaaaccctgcttactggttctagggggtaatgtaaaaattactcccttaacatgcaagtcggacagatcaacatgttgtcagaaatatttggtagcaggcatcagttagctggtgatggcaccattgtgctttgcatcttgagtaacattttttttcctgaatagatgaaagtttctgtatgaatttactggcatcatgaatgtcatttccttgggattctgtccaaatacactgcatatttctttcctttcttcaaacaagttcttttatgatatcttctgatattatttgctgatgatgaaacagactacctcaaggcgtctctcagataggaaagtggcacggtttgagaagaacgtcaccaagaggggttctgttcctgagacagtcaagaaaggaaatgattatcctgttggacccattgtgcttggatttttcgtctttgtggttgttggttcatgtaagttacattctttttttatatatttgtggtgaatggttgagctatttatcttcactcatactcttcataactcagaatgcctttaccaacctaaatagattttaactattttcacccttagttcttgtttttatgggtattgcttctgtgctctctccaggactaaactgtgctaaattgcgaaagtgctaatctagtactattatcagtagtcgtgtatgggggtagctgtagtacacatcattagttttgctttaggatgttatcactttgtgggaaagtatctatgtgtttcctgttttgatcttagattagtcaaatccttttcaaagaataagaagctagattcctgctctgattaattccaaaaatagtctcatggtttactccagatatggttgttaactgctgcagctaccacacccatggacatcagctactaatctgttgccaggcaataaatccttatatgcttataaacttctcaaaaaaatatatgcttctccttaagactttggaaaatagaagaggaaggtttgatgttaccctagttaaggattcaaatggaacagacagtctaatgttggtaaaatagaactccttgcatgaaaaatcctgcaactatttcagtcttcattacagccttggcagtagtttccatctttttcatcataactttatgaacatcttaccaagtcattgtgttttctactcttttctttgtgcagctctctttcagatcatcaggacagcccaaaatgctggatacttctgagaactgtagtggccgcttatatatatagtctcggttaccttcaggaacatggttgatatatgtagctgttcgtcactccaaaaggagaaacttatggcatagctagttcgctatgatgttaccttgtcgttgtaccgtgccttaagtcatacagataacagatcgatatatacccagttatacttggtgcttaatctggatgttcatgtttgttccagtcttgacgtgctctgcagttatgtt

SEQ ID NO: 22222 - DNA, 747 bp, Oryza sativa
  unsure (1)..(747): unsure at all n locations
nnnnnnnnnnnnnnnnnnnnnnnnnnnnnnnnnnnnnnnnnnnnnnnnnnnnnnnnactttatcattggtgtaagcttcaatatgttagtgcgcttggcgaattcgcatgccctatcttgtggtatgaactgagcacacgataatttatggtgcgtattgggggcttacaataagataatgccgtgaatttgctaagcgttcaaacccactgaagtgttgtgtgaaggtaaatatttgtaagtgttcgtgaaggaaagacatgcaaatattttgaatttatttatttagaaatgtagctgacatattagaaagttttaacacacaacattacatattaattagaataagaaaaatataaaatcgttctactcattagcctcatcatcgaaatttcaggatgtgctagtgtcctttttctttccctttcttctagcaccagctggaggtctgcgtcttgacaaaaataatctttcaggtgaatgtcgctcgcgaacagacctacgtgccacctaaataccgttgaaatcaacgtgcctgtagtcttgggtcagctgagttattggaggcggttcatcaatctgcgacggtcctatctcgtgttgtgctgttgacgaccccccaccgtagctacatggttctctgtaggactgtgtgctgccggcatatcccattatttattgggggtgtacattcctacaaaacattgaatccaaagttgtagcgcacacacatactggaactaaaat

SEQ ID NO: 22223 - DNA, 11956 bp, Oryza sativa
attttcctattcgttgtggagttattttttttaattttttgtgtgggttgatttggttctgatgtcgtttgcttgtcatgtctggtacgattttgcagaccggatgacacgccgtgggatggaggtgagtccatttgacttttccccttattttgttctgatcaagatatctagttactagtgattgtgataatttggtgtttggtgaatgaaaaattaatgttatgcggatttgcaagttatcagatactgcgcgtaaaggttccattttgttcatctgatttcacgtgtaaaaaagaggaaacaccgaaacagcaacctccctacttaaactcaactttgtgcttcgttttgtttacgtcttggttcgcttctgatacaggaagcttataattaagccatttgtgactgtgatgcattcttgtttactgaaaagttagagcttgatcttctgatgcgtttgatttgtgctttattgacaaggctttcactaggtaatgaaaaagcatatgattggcatgtttatgaaattacaggctgtatgcatttttacccaacaaatgcggacactctaacaagtaaacgacactttagagtagaaaatgagtagctctttctcatacagcgtggcatgctaacaataacaagcacacacattagagctcttataagaactttctccataccacttggaattataaatcgaagaacatacccataacgttctcatcggagttactttatctgcagtactcagagcatgttatgatcaggtttggttattgtgctgctctgtgaaatgtggttgtttacaagaatctttactgatccataggattacttttgttatggcaaaaaggaaagtgtttccaacctagtttttgtggtgaaaagtagggaaaagcttttgaaaagccatcacagagccaagtatgagccttaatagaattctgctcatctcttgcttaatcatactcttagacttatagagtccaggaaggctaatgggtgatcagtcgcgcgcgccttcccccgcttgactcgacacgtgtcgtgcggggagggggcacgggcggcggcacggcgcgcagtttcttttttttttctttcccctcctcccccgcacgttcctttcttttagttttttctgttttttttccgcagtttttttgtttgttttttgcgcacggttttttaatacgtacgtgtacaaactttgtatacacgttacaaagttcatatatgtgtatacaaagttcgtatatgtgtttttttaatatgtacatatacaaactttgtatacgtcgtatacaaactttgtatatatcgtatacaaacttttgtatatgtgtatatattttttatacataaaaaatgtatacatattaatattaatacacacacacacaatatatgtactttgtatagacgtatataaagtttatacgtatatatataaaaagtattttatacgtatgtatataaagtatatacatacgtatatacatgcactgtagaggagagagtcagagagactaaagacgttagaactgaccgtgcgcgactgatcgccaatcagccaccccctatagagtctgttagtcttaaatttgaaaatatattttttttcataatttgcgtatacacgggcgctgaggaatagcagaaatattcctattccgcgagctggagatgcgggagcgcgacgatactgcaggctggcggcgcaggggcacggtaccgtagcacgggagtgcgggaccggctcggtcgcgcagaccgggggtgcagaaccgagtcggtcccgcgcggcggctgtgcgcgttgctgtagcccacgggaccgcctgccagcccggccgatcgcgcagaacggtggcgcgggtccaaagcggtctcgcatgaccaagctgcggcaccgagccggtctcgtagggctccggtgctgctttcctaaagcgcgggagcgcactctcttcgcatccccattaagctgcaccgcactgaaagttgtttgtcccctggctccatgtgacatgcctagcgagaaacggcaccgcaccgaaagttgtttgtcccctgccgtcagctccatgtgacatgctcagccaggaacaaatgggagagcgattgtcttctctcttagcttttttcatatggcgtccgccgaaagttttttgtcgtctggttagagagcttactcgtcgagtgcctatagaagggaacgttacgaaatgaaagaagcagactcaagtatagcatataactcatatttgtagactttatcattggtgtaagcttcaatatgttagtgcgcttggcgaattcgcatgccctatcttgtggtatgaactgagcacacgataatttatggtgcgtattgggggcttacaataagataatgccgtgaatttgctaagcgttcaaacccactgaagtgttgtgtgaaggtaaatatttgtaagtgttcgtgaaggaaagacatgcaaatattttgaatttatttatttagaaatgtagctgacatattagaaagttttaacacacaacattacatattaattagaataagaaaaatataaaatcgttctactcattagcctcatcatcgaaatttcaggatgtgctagtgtcctttttctttccctttcttctagcaccagctggaggtctgcgtcttgacaaaaataatctttcaggtgaatgtcgctcgcgaacagacctacgtgccacctaaataccgttgaaatcaacgtgcctgtagtcttgggtcagctgagttattggaggcggttcatcaatctgcgacggtcctatctcgtgttgtgctgttgacgaccccccaccgtagctacatggttctctgtaggactgtgtgctgccggcatatcccattatttattgggggtgtacattcctacaaaacattgaatccaaagttgtagcgcacacacatactggaactaaaatattttatagtaaattacaatttgtacccgttgtttgtggttgcatgataggtgcttaggagttatgccatgtagctaatttagctatcatattagcaagaatagggatacctcgtttaaaatggagccattctatttgtgaacattggagtaagaaattgtagacttaatttttggaagctctttaagtatagccgattgttatcatttatcaatcatcaggacaaaataaagtagttcttttgggtgcggttagaccatgtcaccatgactaaatcttcattgtttaactttgatattttttagcaatagtgtgatgggaccatagcaattagatggcagcttcatttgatggcctatttattgtttgaaatcaactacaaaagagtgatagaatgtataggaaaaatcaccggatggaaactctttttagtatttggtgaccacattttttgcatatggtacctccaatcttatggccttcaaataattgatgaaatgcttttgacatacacaattggtaacatgatcactccctttgtctttgtatgtcaggattgcaaatttgcaacctcatgtaatcctttaaaatcacatcgattgaaatgaagtatgttttgtggtgttattacttatgaacattatttcatgtttaagttagtactaataagtgattttgtcacataggcacgttcaagctgacactacaatttacagaagattatcccaacaaaccaccagttgttcggtttgtctcaaggatgtttcacccaaatagtatgtctcataacttgataatttgaccacttcattatctttgcaagctactacattattcccaagagattgaattattgaagatatacacaactaattgtttttgttatccgttcagtttatgcagatggaagtatctgcttggatatcctacaaaatcaatggagccctatatatgatgttgctgcgatattgacctctatccaggtatcatttgaaccttcgcagagtgtcctaacaatcacatcgatagcttcacttggtttaatgctttcccctggttgtagctcacttgattacaatcatttatatatgatagaaaatacacgcatattctgtatttttgtcatgtcattggtgtagaggtaattccaatattgaggaaatcctttcctcctactatagttgcatacaccaaagtcattattgacagtcgttattgttttccaaacaacctgctatatgggtaatgtgacaccgataaattagttatcaatagcatctgcagcctgattctaggatgattagagcctttcatccatgtcatgttgctgtacgggttattgacctacatttgctgacaaataatggcttgggggaccatagttgatgtcttcctgcctgtaatcctcagttccacattgagcttagctgtttctgttttgccttttatctgcagtccctgctctgtgatccaaacccaaactcccctgcaaactccgaagcagccagactgttcagcgagaacaagcgcgagtacaaccgcaaagtccgcgagattgtggagcagagctggacggccgactaagccaaggacatgattgagttgcagtttctgcaacaagcttctcctaaagatatgcaattctggctttcccggtctgtatcacctactaaaaacataaaaaatcttcagttgttgtaattcctgagcttgatcccctgccttcccctacttgttttcccaatgtagtggctacctatttgatgaatttataaggtattgatgcttatgtaaagaattatactccctagccaagaagttgctgttgctgctaggttgcagaagcctcttgaatcctccgtgctttctcgctgtaccagcgttcagtcacgagaaggttggtgatgctgtaattggcagcaaccgcagctgtttttataattatcacggaactctgaccgttggtagtagaaactattccagctttaatattgacagaacgatacaggggcttgcacagcacaacattatttgtacgcctaaaaagcacatattattgtacgcctaaagacaaaaaagaaagaaaagaagaaaaaacaaatgaaggcgtttctgagatttaaaggattcagtgagcaaacacgatcaggaaaggggaaggttgtgtgcatcaagacagaagcacaacccggaggatcagttccatcaatatctttcatcttcagcttgcctcctgcctgtctcaaaatttccatcttctgttgcagcctgcagccacactgatccacgagctgacgaatcctcacattctttttcccgcccagccctgtaagaacaagctgaactttagaatccttcaaaacaaaggcaaaagctcttcctcatttcatccatacacaccaatccaacaataacctatcaacactacaaatctaacaaatcaatcttggtttggaaatgtgaatgtgatggtcacttgatcagaggatacttgattgatttggatgtatggcacacctggtttgctcattctggaatctggaggatttcgtgatccgggacgacgacgacaccattgaaccgtcgctgctccggttatctccttcccagtcgtcctgcacctgtgcagcgaactgcaggttccagaggacgtcctcgatggacggccgctgcacagcctccttggccaggcacctcaggcagatctgcatgatcgtcctcagcgactcgtcagagcatcccttgctcacctcctggtcggcaaagctcctcctcctcaccaaatcctcgtcggcgactgcccatagcatctgaaaaaaggagtaaagattcagagattgtgctgtgcattgctaggtggaaattcagaggttggcatttttcatgtgaaacaatggttttcaggtgatggtcatgtctcataccagttctttcattatctcaacctcatataaggatgtgattggctttccagacacgatctcaagaaggatcaccccgaaatcgaagatgtcggttttatcgttgagcagtgggctgcaaaataacacatgcagaattcagtgggttttttttcactagattgtactgattgaaactaccagatcataggcatatgtacggatcaagtcctgataagtacctttcagtatggtgcttgcctccaggtcctcccttcttggattgacaaacatcataacatttctagtcagcaacagccagaaaaacaaattaccaaggactgttaaaaatgactgatctacctcagatttcatggcctctcctaggattgggatattgtagctgctgatcttcgcgacatgattctgatcgagaagaatgttgttgatcttcagattgtttccaaacaggccaggcatcatcccagcatgcaagaactgaatgccgttggcgatgccgatggcagctgatattctctgtgcccatgtaagcttccttccttcagttccttctggtgaaaatcagtacaggatgcagtgcaaagcaacagtcagtgactgaatactgcaaacaactgaaaagaaaaacaatgaaggagaacagctgacaatttaacatacgcgaaatcctgctccgtaggttcccgttttgcacgtattcgaacacgaggtacagctgagtgacagtagaatcatcaagatcatactcgaagcagtgcccgagagcgctgaccaagttccggtgtctgagcctagaaattgtttcaatgtggcgactgaagcttagggaagactgattcctcttaaccttcaggctcctgatggccactagtgtgccattgcctagtctccccctgtacatctgacaaacaaacaaagatctgatctcagctcccaagcttttcaaaatgcaggacttattcatcacactcatataagcccgtgaggttaatttgaacagaatacagtgaatttcatgcatcaattagttgtaggttgctcaatgggtaattttaccatccttaaaaatgtactgagagataccacattttgtattgtaaatttgataacttcaggtgctaggtatcttgagtatctaaactttaacttgcttagggaccataaaatttctcttgctcaatagagtctgaactgatcaatggagaagattggcatacctcgccgaaagaatcttgccccagtagcaaagagttctcaaagttgtcagtggcagcttcaagctcaaccaaagaaaatgttctgtatggtggaattcccagagctcccagcttcactgtctgtgatatgtagcctgttttgattttgtcgcagacaccagtaggaaatcaaatcttagtgaattttgacatcaaatttggtgaaattttagataaaattcagtgatgagtgagagacaaatcaaatcatacgtgcatcggcgaacatcttggatgggtagccactcgtgcttgaagaattgtcttctcccaacatcgccggtggcctcaccattacgcctttcttgttcttcctcctcacggcgacgacggcgacgacggcgatggccgacgcggcggcgagagccgccattgcaatgccggcgaggaagccggcgtgatgtgtgagcttcttcctcaccttgccgccgtgagttatccccacggccaaggcttggttctggcagaacggcgacgggtgctgcgacgcgtcgccgccggtggcctcgaggcaattggcattgacgagcaccaccgtcgccggcttcttgtccggcctcaggcaggccggctcgctgccggtgaggaggttggaggacaggtcgacgaactggagattgtcgccgcaggcaaccttgtcggagagcacgccggtgaacctgttgccggcgacgttgaggtagcggatggccggcagggacagcagcgccggcatgaacgggccgacgaagcggttccacgacacgtcgagccgctcgagcaggtagaaggaggtgatctcgccggggaggccgccggtgaacctgttccggctgagcaccaccgtgaccaccttccgccccagcgccgggaacgccgggccgagccagttgtcgccgacgtcgatcacctggaggttggtgaggccgctcatgtccggcaggttccccgtcaggttgttcgacgcgagcaccagcgacctcagcgactccatgcgacccacggacgccggcacggcgccgcccagcgagttgttccgcaggctcagcacggccagctgcggcagctcgccgatccacgccgggagctcgccggcgagcaggttgtcgtcgaggatcagcgtctggaggccggtgagctgggacagcccgccggggacgccgccgtagaggtagttgccgctcatgttgacgatctccagcgcggcgaggcggccgatcttgtccggcagggggccccagagcccgagcccggacagcgtgagcaccttgaggtcggggagcctcgacagcgccatgacgagcgcgccgatggagaagttcatcgggagcggcggcgcgccgcggacgccggcgatgtgcagctgcgtcaccgtgtcgccgtagcacaccacggccgccgacggcgccgccgtgccgccgccgccgcagaagtcggtggtccggcgccagtggctcagcaccggcgggtggttcagcatctgctggatcttgaacagcgtccatgtctgcgagtactgcagctgcgagcttcccgggagcaacgcgagcagcgctgccaagaagacgaccaggtgatggcttgcacccgccattggagaagctctcatcaaatgcttcttgatcagcaagaaccagcagagaagcagagcaaatcaatctgtactgcaagaaattaatctctgtactctgatgattccttcaccttctccttctactacgatcaaggacagtgtgtacaagcaacagaggaatcaaggctttgatgtgtgttgatagtaccagaaagtaaccaaatcatcatcaggaagaggaagtgatcatcaaagatcacatttcttgccagcttgctccattcttgaactgacagtaacaagacaaaaaaaaacaatcatgttaactgaagaacactcatgcacatcactactaccatttcacaagaaccaaacaacaaatctaatcaactgcaccttacctagcttaggcagtcaccgactggaatagcaaagaaaatcttgctcagatgactgacgaactcaagaacagaacggataataaacaacaagagaaccttattacagtatactgaccagtgaggcctagtgcaagtatatatcctctgattctactgtaacttgtactagtacaattgctggcttgccctgcgctgcacatcactcacgggtggctggcagaagcatgaggtagctgcaggcatcaacggacaggtgtgtctccaacgattcagctggaaacggggagcaggcaaaagaccaaggactagcagtcccagcgttcactttttctcactgttgagtcttcagaaaaaagaaatatacacacacaccagtgccctgctcctctgctttcttgggatcacactctgattggtgcttgttaggcttagaataatgtgctgctttacgccttaagtttgattagtaattctactgattaattaggagttatgaaatcagtttgacaggccttagttttacttcagaatgttgcttctgatctactgttccaccaattgctttaggatcaaaactgaaacttcgatgataagccagtcctgaagcagtaattagacgttaggacatatgctggtactgctgcacatttttgcacagtaacaatctggcagtgttaaatgatgctttactctccaaatgaacttttttcccttggtgagtaccacatatcacatatggcccttagttcagcaccactgttagcaagtgtggtgaacattgcccttttttctttcagtgcttttccttcttttcttggattcttttattttttttccttttagcacttttacacctgatgatgcctctcctccttgctttgcataaagccaaggtagaggaagcatcaaagcacccagcaatcctggcattggaagatgcacataaattgcaagagacactgcaagtaattgtttgcactgaatctttgaactctgaaaacttcagataactgtttgcactgagtctttgaactctggaaacttcagatggagtaattgtttgcactgaatctttgagctctgggaagttcagataatcgtttgcactgaatctttgaactctgaaaacttcgtataattgttttgaaatgctctggagtttgtgagatttcatccatgcaggtgatggatgaaacattatgaaatgaatgccaccttctccacctaacttgagcagcgcactagctgtgccagtacactgtcctgcttagagcagagcacacgaaagtaattccattttggacagaatgaatgtcatgggcaagtgattttttggaacagattatgtacctaacacacatccatcgacttcacacaaaaccgtggccctaaaattcaatgccgtggagcaacgtgcatgtgcgtgttaatgttgtacaagtacggcgatggaactaacatgctagtagtatttcaacttgtaatcagggtcctaggaaaagtatgagacatcaattaccttttgttgtaggacacaaaagaattacgatgacaccaggaagtacatttgttcgtacaccatgggtggatgaatgtagtattcgtccagatttaaaccctaacattcacaattatttccttggagttagttaagtccaaatcttagttatgaaaatgccagaaatgtaattggctgaaatttattactgaaaaaaatatgtgacctttggtatatatgcatttgttgcacatatttgctgatacaacgagagataagctactcaaatgtatcctcaccctgaaaccaacggttactcttgaggtaccttaatttttgtgacaaaaaatgtctaataataaccctaattactgttgtcccgtcgtatgagtatgataggacaattgatcaaaagcatacggcacgagccactagcatgtactgcgtctactgcttcaaaagcaagagagaccgcaacttttacagactcatcactcatcaattaggacgtacggattactcgtactagtacattagtgctacaagaaatgcattctttttataggacgtaggtagtgtagtacaattgataattactttacagcagcctcggagaaaagaaattaacggtgttcgattagctgaagcaagaaatgcactcctttttttagaactaagaaatgcacccttgatataatttgaaacaaaaccttattgctctccttcttaatgtatttaaggcagaactactgccagagtgctagttacttaaaaaaaaggaatattacattatttgaaaaagtacctaaattttatactaaaattgttaataccttaagatacttaatatctagaggtattaaattttatattaaaaatatggtacgtctcagtacattatcaaatatagtaaaattaaaaaaaaaagctgtaggattctcctctcgttatatacagacgcgcatcagttaatccctgcaggtacagtacaggtatatcatgcgagttgagctacagtaacgcgcagaattcattactaccggaatacacagatcaagataaggagcgagcaattaatgtctctctactacagggtttaacataatgacccaaactgcaactacatcaaccgaatcgtttccagaaaaccatacagagaatttgtaccaccgaagattgtgaagcaagcgaacgtcccggcgacgaacaagccagtaattcgtgcccaacttctatctctcaatcctcacgcacgtgtcggggtccagtagcttcgctagcgttacacaggtgctgtttggatccgaagggctgctattaaatagccctccagaatcttgctatttaggagtattaaac

SEQ ID NO: 22224 - DNA, 12665 bp, Oryza sativa
  unsure (1)..(12665): unsure at all n locations
nnnnnnnnnnnnnnnnnnnnnnnnnnnnnnnnnnnnnnnnnnnnnnnnnnnnnnnnnatcgatctatcgatcggctcgccatttagggtctgttcactttaatgtcaaaaaaaacttatcaaattttgtcattgctaaaaatttgatatagttgtcaaaattttagtatgatttcttatatagttactaaaatttgacagcgaattaaatatagctattctttttagcaacattaccaaaaattagtaagattgaaaatagcttcaaagtgaacaagcccttgctgtctacgctgggcggcttctggtccggtctggtggttggcgtttcccttgccgccattacttgctgatcgatcgccgaggccttcttcttgggttcttcctcctccgtcacacatgctctgcgcccaaggatatgatcgctccgatccaccgcgcgcgccgcggcggccacggcccacggaccacgtgtgcttccgggcacgcggggcgcgtgtcgtttggatcagaattagctgctgcgttattgtaagctcaagatactgaaagaagctatatagccgctagaagttcttcgagcagggccacagctaaaagagagatagagaggagagtgtctggtcaacatcacattttactactccctccgtctcataataggtgacgtttttgactttttatttgcaacgtttgaccattcgttttatttgaaaaattagtacaaatataaaaaaagataagtcatatgtaaagtacttttaataataaagcaaatgacaaacaaaataaataataattttaaaattttttgcataagacgaatgatcaaacattgacaaacaaaaactcaaaaagacaattaatatgggacggaggtagtactaaactactgctccctccatcttaaaatatactcccgccgtccctaaatatttaacgtcgtttactttttttaaacatgtttgaccgttcgttttatttaaaaacttttatgaaatatataaaactatatgtatagataaaagtatatttaacaatgaattgaaaagaattaataattacttaaattttttgaataagacgaatggttaaacatgtttaaaaaggtcaacagtgtcaagtatttagggacggagggagtaatggattttggttgtatctgatatatatactttcttatattttgggttggagtgggaaacccacacttcataaggctattgtttgttttgttatcatatttgtgatgtgcaatagttttttaagccttaggatccacatgttacgcgcttattattttaatcaaatatatttctaagaagtgtggccatcaatttgttaactacacttttacttaggcttacaaaatatgtccaaaagagcgcatacgtttctacgtaaaggccatgagcttagaaaattttctaagatgcacctaagtttgatggtattccacatgagacgaaataggaggagcaaacccctatatagtttgaaaaaagtacgaattaccccccacccctcaactatcgccgtcgactgaattatccccctgaatcacaaaactggacattattcactcccacgcaaaccagacgaattacccccctcgacccaatccgcggtggttttggtctacgtggcgtacacgtggcagtccagtcaatattctatttataaaaaaaatatgggacccacataccatactctttcactcttcctctctcttctctcccactctctgtcagtatatctcattcttcctctctctctcacagtcgcgggtcgcaggtggcggtgaacatggagccgtgacgacgacgaccgcggggcataagggtgacgtggagncggcggcggcggggcacaaggagaccccgccggcgcgggacggacgtacgtaagccacgacgaggagccgaccacacttgcgcgcgaagcaaaagcagcagccgacgccaccgcagagcaaaaccagtaggcgacaccgccgcaggagtacaacgccgtatcggtcgcgttcacctccatggccgtcaacgcatcgtcatcgtcccccttggtcgtcgtccttcactcctccatcgccatcctccactcctcatccctcggcgccgcctccgcgtcacagagtgagagagagagtgtgcgagagagaagagagagaggaagggtatgacatgtgggtcccacattttttttataaatagaatgctgactggactgccacacgtacgccacgtagaccaaaaccaccgcgaattgggtcgaggggggtaattcgtccagtttgcatagttggggtgaagaatgtttagttttatagttaagagggtaattcggttgaccacgatagtttagggagataattcgtacccttttcatatagggtgtgtttggttgcctgcatgaggggtggctcacatcccctcagcagaaatcgatgtgtttcgttgcctgcaccagcatatgagccaagctcggctgatgcaaaaagcgccgcacagccaggctgaggggaaacgcaagaatcggccgtagctcctcagctaggcccggctcatacgggacatttaactatttgccactcttgtgacattgcaattaacgatttgccatgctctgtcaatgacacatggacccttatgtgtttatgacatatgggtaaatagttaaaagccccggctcatacacgcgggggtgcaagcgtgggatgagtggatgcaggcgatgcggaggggtcaaagcatcccctcgcctccctcgtctcatttgttcgctcgcccaccccattggtcgtcgctcggtcgccgtcgtctctgtcgattcccctcttcttcaacggctccgactggcgcccatcagctccacatcgccagatccaactagctagcagccttgtgctcgagctcggacagatccaggaggaagaagaggacgggacgaagaagggcttgacgagaatacccggatctcggcacttgatggaagatgttgctgccgcctccattgtcttcccctcggtcttgctattgccggtgatgtgttcctcgctagccaccactgcacctctgtccttcacaaggtgcgacgggccagatccggtggccatggctccaaaggatctggattcagcggcctcaaactctgacgacggtggtgaacggcgaggcgccagggggaagagccgagaacggcggggcaccaggggaagaatcaagaacggcgagcggcggtctccgtcaagcagcgatgacgacgaggcttcgaggccttcatttctttcattttctttttacttttctgattggaactgtctatccatttgtcggatgatttctaaccaaaaatcactcagattttttctacccttagatttacatccaattgactataaaagagaataactaatacatatctacttacacaatatttttttcaaaattacagtgcacttacatattatatcaactaaatttacaaatgtaattttagttatataggactgtaattttatatttttaaagaaaataataaatacatatttacttacacaatatctttatcaaaattacagtgcacttagatgtcatatcaactaaatttacaaatgtaattttagttatataggattataattttatattttaaagaattatcaaaattacagtgtacttacatgtcatatcaactaaatttacaaatgtaattttagttatatattactataattttatattttaaagaaaataatcaatacatatctacttacacaatatttttatcaaaattacaaaattacaatgtgcttacatatcatatcaacctaatatacacatgtaattttagttatataggactgtaattttgtattttattttttattttatagtttcaaaaatttgtaaagtgaaaagaaccaggcctaccatccgacgcatggtattatccacgtatgcagcctccaccaattattgcataaatcctagcgaggaatcctatggatagaaaaacgtgaaatatcagtaaaaaaaaatcacccgtgagatgtatagcaaaatcgttgctgatttgtttctccctgattagaccgacagtaaaaaaagtccgtgtaatactccgtgctactgtttcgcacagtttgtttccatttttttttctcttgacaattagtactcacatcgcagtaacgtcacgttttgatattacatttgatctaaccaattatatttgatcatatttttttactacaatttaaagtgcatgaacttaagacattattatttctatataattggtaggattatactcttacaatagaaaaaaataattggattcaaagtatatgcgagcaactaaacacaatctcttgcatacaagttttcttatccaaccaaccaaacaacatcttacagaaaccaggtctatctaatacatacaaccaaacactctctattgcatcttactaaccaggccaaactcaacctggatgatgagacatacaagccaggctgaggacactcgagcagccaaacacacccatagtttcctggccacatagatcgtgacctaaacctgagcttgacagttcatcagtcctaacagctaggttggtgcgatctgagtttcagacatgcaaggcttcagtttaccctcaggaacttttattagctacgaacagtgtccgccgcaactctcggcaaccaaccacaaccaagttgcgtcgctgtcacaaaccgcatccaggcagccgcatccaggcagccacccctgccggcggatccgcggattgttgtactgtgtagctagctgcctacacagtacgcccggccggcccggtgtatgacaaatcggacagcagcagccactgaatgggcacgtctacaagtgtagtagggcaggatgtcatattgatcatctgcgatgggatggtccgaggttacattgacggtttttttagtagcaactactacctccatttcataatgtaagggcccctttgaatcaaaggatttatgtaggaatttcataggattcaaatcctatatgaaattttcctatttggccctttgattcaaaggattgaagctttccaaattccatgaaattcctatggaatggcacattgtatgtggattttggaggaaatttagcaagagctccaacctcttggaaaatttcctttgagtctatcactctcatccgattcctgcgtttttcctgcgctccaatcaaacgaccattcatgtgtttttcctgtgttttgcaatcctctgttttacacttcaattcctgtcagaatcctgtgtttttcctattcctccgttttttttaccctgcgattcaaaggggcccttaagtcattctagcatttcccacattcatattaatgttaatgaatctagacatatatatcgatctagattcattaacatcaatattaatgtagaaaatattagaatgacttacattatagaccggagggagtagcaagcacatactacacgagaatagaatagaatccttatttacagtatttacattaggtagaaactagtagaatatatacttgtaactataaaaagttatttcttgaggacctcattattttgtataacttcgtttacgtatgcctttggagaaaataaattttgaagcaacacaaccgtattataggtttgtttatagttggacgaccataccacgtggcacgatgcggtttgaggatgctcctcatgtccaaaaggatttaaatataaaattaaagcttaagagggagttcagtgtaaaagagatccatgtccagcttgtttggagcagcgaaatagcactgatagaggggactagagacacaatcatttggagatggacaagtaccggcaaatacatgacaaaatcggcttacctggcccaattcgccggcaaaaggtggaattaagggcaaccaccatgatttggaaagcatgggcgccgtctaaatgcaagaattttgcatggttattgctgcagaacaaaatttggacaatggatcgattgcaaatcagacagtggccaaattgttacttttgtcaactctgctacagagacctgtaaacaacacaacatttgttcaaggattgtccgttcacaaggaaggtctgggacagagtagccacgagactggagtgcaaccaagcattcccggcgcacaattcagaggagatactgattgaatgatgggaaaagaagacgctgcagcaagacaagagcaaaatgaaaggtatgcgatcactgcacatgctcctctgctgggaagtgtggtgtgaaagaaataggcgagtcttcaagaacgaggaactcttaatgtctcagctgatgatgaaagtgctggacgaagtgcagctatggtctgcttgtggggctaaagacatcgttttttccctttttttggtgattggtgattggctggcttaaatttccaaaaaaaaaagaaatccatgtgttttctttagaaaggtcgtgactcttccctttcatatgttccctagagaagaaccttttcatattgcccctctctcttatcatgcgactaatcctatgtgttgtgtcaccgatgcccacctcctcccattgctggttgcttgtgggtcttcccaagcaaggagcctctctaaccaaagacggtggtgatgacaaccatggcaaggcaaccgttgacggtgctcgtgcagcttgtcatcctcctctttcttcttagatcgctctctctctaagtgcacacgacatagagacatcgccgaaagctagtaggatgtcgtagagaggggaggggatgaacaaacgttcttgaaaattacttcaaattacaacgatcaaattcaatggcccaaaacttcctggtaacaattttagccaagcagagaaagctaatcggaacttttagggttcttccttaagaatttcgaagcagttgtgagttgttgttccaagcatgaagcacccctgtaaacacataataatatagtaggtggctagcagaaacaaaatacaaaaaaaacaagtaaaaataggaagagggcacacgggacaagacaaagggagataaagatttttatgcgaagttcagatcacaaggattctactctctattgagaagctttagagagttgggactgtagtattaaccctttacctcaccaaacaagtatctagaaagaagcctttagcctctaagccaacacccctaggtttcttatgattccaaatgaccgtaaagattcctaatttagataacgtgtttacaccacgacgggatgagatggcggtcgggacttccgacttcatatttcgcttatgctcatacttttcagccaaaacttgaatttttgaactttaaattttgagctaattttggggtttttcatcgaagtttatttttcaacctttacttttagatagctaagaacacgtatataaaagttttattcacaaattactttttgtttccaaatatgccattcgggttattgggccgtttgcgaaatttgtgaagtgaaagctgctatttatttatttacttatttattgagaacgtgaaggggaagttttgctaaggagtaaaggaggagtgtgtgcctcgagaacggtgtaaaagggatctatccggccctgggccgaaaatatctgggctgtagcttttgatgggctaatgtggggtgattaggcttctactgcaattcagtacaagtaaattcagtattactccgtacttaagaggaaaagaagagaagtgaagaggacgaaacggcggtgggctctcgaaacttccgggctccggcgactccgccggccgcgatctcctcctcctcctcctctccggctcttcccggagacgaccaactccctccttcctgtacgctccacccctctccctcgatctactcctctcgctttcgctccagctcgtccagatccggcggacctgacgcgatcgcttgcgcttttccccccttccgactactcgcggttcgatctagtgtctgctggcctgcagtgtgatatgtgtagctggtagctgcttggtctcgcagctctcgctgaagcctagaacatgggtgtggatctcgcggtattttagatggtgttttctttgctcttttttttttgttgattattttttttacgtgggttgattggttcgatcgtgatttcagctatttttggcctcgtagtttgctccggaggatcggatcgtgctaattgccaaattgattcaatggatttggattgtcctgtttgcagggttcggggtgctgattgacgcatttagtgttgtgtgcttgagtaatggcaataggggagtggagttagatgcatttggtcatgtggtgtctaagtcatgtctcatgcatgatgacgcagatgttgtagtacgagcacccgttagtattggaaaaattaggtttcgttcatctaggggagttattaatgtagtatataaatcatggaattgactgttctgggtactaggtgaattaaaaataggatttgaatgttttgcccctgcatttatgaattttcccagtggtaggttatgtttgcgagctgctatgtgacgtgtttaatggtggcattcttattaaaatttgtttagattgaaacaatatatttcgtataaatgaattagggtccaattttttacttgctgttgatacggatttgtgcaatggattagtcatccttagtcaccggaaaatatgtgattctaaaattgccctaagaaatgtgataccgcaaaaatgcaaaatgacatgaaatgcttgggcggtggtgatggtttctttcctggattgcttatttatatgttgactagaaaactaagtatgtactcttatgaagtataaataacacttgaagttggaactacacctgaagcacctttttttcctggcaggttcatttggtattctggtgcagtttgcagtggtttctggccttcttgacaaaatggtgaagctgacaatggtagcacgtgtcactgatggccttccactggcagaagggttggatgatggacgggatcagaaggacgctgacttttacaagcagcaagctaaacttcttttcaaaaacttatcaaaggggcaacatgaagcctcgcggatgtcaattgagactgggccatacttttttcagtatccttatgttctgtgtggtttttttatttccaagcatcgttaatgactgttgaatttgttccattcttttaaatccatgcattatgtgtgatatagcatatctgggtgctaaacatttacatctgaacatgcatagtcattcttttatattgttgatcaagttcgcttgttgcatccatgaaacattacatttcttttctggtgatcaagatttcatcgtatgtaggatagttgtattaatcgcaagtaaacaagaacattggtaaacatttgacgaacctatgtgattgtctaggttaaattaacaatcatacaatagctactctacttttctatagcattcaattattttttagcatcttacaacttgcaagcatgttgtacttatttgatacacttgttgatctcgttattagtatgtgaggccatttatcaaaactaactttaagatcataatcttatttaacctgctacttgcattgtgttctgtcgcgaaaagatggcattcagctgtcagctaatgatattcttgtaatgcattttttagcttctattggtttgctcagttcatcgcagtatgatcttgttgaaccttaattaaaataaacagttacatcattgaggggcgagtatgttatctgacaatgtgtgaccgttcttatccaaagaaacttgcattccagtacctagaagatctgaaaaacgaatttgaaagagtcaatggcagtcaaatcgaaacagctgcaaggccatatgcctttattaagtttggtatgtttttagaatttaattccagcaatattttcatttgtctaagttcaactggttcacaacttattcctctttctacctagacacattcattcagaagactaagaaactttatttggacactagaacccagaggaatcttgcgaaattgaatgatgagctctatgaggtgcatcagattatgactcgcaatgttcaagaagttcttggtgtcggtgaaaagctagaccgtaagtttgcaaatacctcttggttctaacattaccgtatatgtcctgttacaataaaccatcagatttctgtaacatgcatgaatcaggcttactatggaggaccttgtcctttcaattactttcatatatttgttcaaaagcttatttacaataatatcgaattactgacttagtctttctttttaattttcattgcaccttcatttttcttttttgcatttaactgccctgattctgatgtttctaaagatttatacccacctttaccttttcgctttcctttgcatttcattgtgtgataactgatattatggtttgattgaatcaaaatattgctcaatcttgcagaggtcactgaaatgtcaactaggttgacttctgacacaagaatgtatgcagataaggctaaggatctcaatcgccaggtaatccatttacacaattgcatgcactattttttgcagatgcatttgtcagctgagcttgagcatttttcattagaattattagagacatcggtattgatgttactcaaacaagtgaaacaacatttaaaattgtttatggatcaatttcttcagcatgtgctatgcactttaattagcatcaagtatgacattaaaatcgcctttactttcaagatcaaaataagtatagtcactataattggttgttgctgcaacagtaacaaacatctccatgagcctactgttagaagctgcaccctttggctaataaaataaaatgttgttttttatttgtgtttattagttcactatctatgggcagctggtcagtttcatcagattatagaagcacccaaacattattcagttgtgggtggtggctcaggagttctctccatcatttatctgaaggctttccttcagcagcatgtcggttcagaagtcatgactactatacattgtatccacattggcatttcgtagtttgtaacataatgtttgtcatgcgttgcccttaattttaatctgcatttgtctacattttatctacatctttcagcgtctcatttatggtatgcacaaaccttttggatttcaggccttgattcggaagtatgcccccgttgccattgtgatcggtgtagttttgatgctcttttggttgaagaacaagatatggtaactgcaccaaatgaaggaagctgggcctgcgttacaacactggagaaagaaaaacaaaaaaattaggttgattctggatcaatagtgctttggtgacgtgtatcccgtatctgcccattcaagcgagtacttcagctgcccttttaccctcctcctcactacaaagctattcaagtcaattcgttgtagcataggccttatgacggacttgattttgtaaatccttggaactgtacatataagagctctgtagagttgagttttcggtattgggatgggattgtattcttttgcaaactcaactcatgtaagaattcaggctgaatatcgtatactccatatctcttggacttcatgcccatgttgcctaaacgtattatgccctgattagttacattttgagtaattttatggtcaccgaagatgcatgtatggggagttttagattctgagaaatagggatccagctgatgagaatcttgataagctcaatttgcaaccacagcttctgattaattttctggaatttgcaaccatagctttttttatcaaaacgaaaagctgttgtttaagagagctgtagttgctagaaactctcttaagcaagctcttacttgggtaaaaaaattgatacctccgattcctgatttatgtattagggaccgtgaattcactgaccaatgtgccatctacaaaccacttaaaaattaggcttgataagttacgtggaatagtggttcgttccttgcaattccagctatctttgtcgtgcgattgcgtttcgtcttctacggtttcaaccactctttcagagagcaagaaactctggaattgccggcttcaaggattagaatgttttttctttatttcaaaaggatggattagaatgtttctactgctaatcaccatcatctcagcctctgatgatccacagttccacacaacactgtaagtaagtagtatattacaaaggcctaagctcccctatgtgaaaatggtaagccgcccgtgccactccaatcagctgatcattctgcagcagcaacacacacacgccatgacaccaaaccggttgcaacctgcagatgagacgattgccggatcacgaagatgattgatgaagaagaacgcgagaacagaatttgtcgaattcctactgttcgattctaacaagagctaatgtgcagagaaaggaaaaaaaaagaggaagtcaattcgatttgatcagcgaagctgaaccaacaattcgtctcacacctaggatgcggaggaagaggctgctgcggcggtgggatcggattcggcgggagacatctcgtcgtcctcctgctgctg

SEQ ID NO: 22225 - DNA, 768 bp, Oryza sativa
cgaaatatgtggcttgtggaatttttcaaagctctaccgaaaaacttctctcctcgaaaacacaatcttgcaagcggaatttggaggttttaatatcgccgaacccagcaaagcgggggaaaattggatgtaactttttctgtaaatgtccgtggatatattattttcctgatttcgagtccgtatgagaaagttacgcctattttaataaatgacacccgaatgatttttcgatagagctttggaaaattctacaagtcacatattttgtctgtttgagtttattttttctatggttggttcttgtattctcctaagtgtgaaaataaaatatcaaaaaaataaaaataaaaaaaactgcatctctgtgtactgtttaacttatggctatcatttcatgtggttatattttgaattagagattaagtaatttcatatagtggtagagtgcattatgtttaacatgttgatcaaagggttttactaaaggagttatggtctaattttgatgaaggtgcaaagtaggctaagtggtatgctatatttcgttcgagtttaaatttttttttgtggctggttgtatcgtgatcctaagtgcgaaaaaacatccgaaaaaataaaacaaaaataaaaaggttacaactctataagaaacaggaatggaggcgaggggtggtgggggatggggcggcgccagcagccctactctctagggcggcgccagccatgttggcgctctcctcctgccacgtcggttcgcgtgtgcca

SEQ ID NO: 22226 - DNA, 778 bp, Oryza sativa
cttagaatttctgaaagaggcaaaggtatgttcaagaatctttttttctttagctttatattctgttttgtctttctgttaccatgtaattaggtagtctgtagtccattatagttgcggttggctgaagatattttcttctttagctctttcactctgcacactgcatatcacttctgtatgtacaaccagtttgaaacggcagtatgtatatttggatatccaattttatttagacatttgccttttgcagttttgctgcacatacaggcaataactttaatttcttagaacttagtaatccttttggtgcctgacatcacattattgatgctttctcttaaaaattattatatcagtacagttatttttccattcccatgatggatgccatttattttgccacttggatctcatgttttaaatattttgtaccaatctatattgccgatgataaccttattttcttttgttgatttggaacattctagaaattacaggaccaaaatatatccgatgggtactctctgatgaggcggcgattgttgaacgaccgtcttctacttgctgaaagaagctttctgcaagctgatggacttcagggaagaggatggttcaagcatctggtgagccttaagtgggtcagccatgaacccacttataggtcaaaataagcaggtctgcggcttattttggcctataagtggggttccgcgggtagccacttacactcttaagctcccgctattcataagtcataagtcataaccaaatttag

SEQ ID NO: 22227 - DNA, 709 bp, Oryza sativa
tgggccaggtcagtcaatctactaaattaccttcaaaatatcagttgcatctgcaattctgcgcgttgcaaaatcattgcaagaatgagatgtaaattatatgtgatctgaatgtgcaatcgttgttttttgtgatcaggtggaaggcgcattcgtgcaagggatcggcttcttcacgaacgaggagtacacgaccaactccgatgggctggtcatcaacgacggcacgtggacgtacaagatccccaccgtggacaccatccccaagcagttcaacgtcgagctcatcaacagcgcccgcgatcacaagcgcgtcctctcctccaaaggtgaaatcatcgtcttcttcctttgagcactgaaatcgtgaaggaaatcgaaatctgaaactgttttgtgatccatcgtggcagcgtccggtgagccgccgctgctgctggcgtcgtcggtgcactgcgcgatgagggaggcgatcagggcggccaggaaggagttcgccggcgccggcggctcgtcgctgacgttccagatggacgtgccggcgacgatgccgatcgtcaaggagctctgcggcctcgacgtcgtggagagagatctcgagagctttggtgcaaagcctaaagatagtgggttctttggcgtagctttgtataaacaccaacaataatctgtgcctggatttgcggtgatgtgggatatatgtacagaa

SEQ ID NO: 22228 - DNA, 824 bp, Oryza sativa
  unsure (1)..(824): unsure at all n locations
taattacgtaaattttttgaataaggcgaatggtcaaacatgtgagaaaaagtcaacggcgtcatctattaaaaaacggaggtagtagatagatggccaacaagaggatttctagcccagtagcacattagcccaataaaaattatacatataaactttatatttttacatatacactagcaaatatgcccatgtgttgcaccgggtgaatatgaaacaaatattaatgtttaaaatcttgaatttgtacatacattgcaaatacctcgaaattttatacgggaaaatatcaaaacatatctcatattgtatgcgcgcttaggtcgtatctcaaattttctaatacacgcgtgaggcactccaaattttctgaacatattccaattttcacaaatattcacaaacaggggttgtcacagctgtgacttcatcatcccctgcaaaaagaaaaaagaaaaaaaaggtatccgcaataggaaagaaacatgcactttgtagtatcaaaataaaatcactcaaaaatctagaaatggtttactgagtagcccactattttctcgtttgttgtgatgacccggcgcgtcgagcgccaaatctgcatcggtagttcggagtatttgatgttggtgttggttgatttttcacagtgtcacatcaaatgtttgaacacctgcataaagtataaaatataggctaaaaaataactaattgcacatattgtgactaatttgcgagacgaatcttttaagcctaattgctccannnnnnnnnnnnnnnnnnnnnnnnnnnnnnnnnnnnnnnnnnnnnnnnnnnnnnnnnnnnnn

SEQ ID NO: 22229 - DNA, 1504 bp, Oryza sativa
aaggggaggggaggggagaggagaggagagtgagggggagaggaaaggacttagaaaaaaattcgggccatctgccatgtatatatatcacgctaattttcgcaggcgttgcttaagtggtccgcctgattttcgcaggcgccgcttaagtggtccgcttgcggacatcaaatttcaccctgacttatatttttgtagccggtcatttggctctaaacgtcatgtccgcctgcgaaaataagacccttacgttgggaaaaatgctttttctagtagtgcatgtttcatagtttttctgttaatatttaaattaaaaaatgttagccataccttcacaagaaaaaaaaagtcctagcatactttttaattattgacgcgtcaaaattaactttttaagaaggttacattgttatagcggttttgctattttacttacaatagatttttcagctcttttttttatttttcacataggatcttatatcaagattcaggttctctcgccgtctagcgcgtctcctgtcctgcacccgcgcgcgcgggctgtggccacaggaggaggtagaggtcggttgatcgagatggggtcagaggcggcggcggcggcgagggcggtggtggtggcggtgaacggggagaggtacgaggcggtgggggtcgacccgtcgacgacgctgctcgagttcctccgcacgcggacccccgtcaggggccccaagctcggctgcggcgaaggtgagaactaccatctctctccttctcgatcttaattacggctgtttgcttcgatctcttcttctgcttgctcgtcggaatcttgagctatactggtccatccattaattccatgagatttggtgttcgtcggcatgtttatttcgcgaaaagaaattttttcctcgtgtcacatctgatatatcggaaggggttttcggatatgaatgaaaaaactaatttttcataattcgtttggaaaccgcgagacggatcttttgagctaattaactgtcattagcacgtgagttattgtaacacttatggctaatcatgtactaattaggcacaaacgattcgtctcgcgattttctccctaaccatttaattagtttttttaatctatatttaatatttcatgtacctgtccaaagatttgatgggatgttttttaagaaaaaaaatttgaaactaaactaagcctcattcttcctttgttagtctgtccagtttctagtctgtttttttttgacggtcacttgattaagtctgcgtgtagtttttctcgccaggtaaaatctccatgtaattaagtagttctactgtttttattggtgtttcccggatgtggcaataattagtactttttttagcactgtttagctcacctgatcgctgtacatgtcctccgggaagaggaaattaaccgtacgcaagcacatatcatgcagaatatcgtagcaacgaattcacaacaaaccaagaagaaggtgcccagtagcttactgga

SEQ ID NO: 22230 - DNA, 1918 bp, Oryza sativa
ggcgaattcgagctcggtacccactatcaggtagcaagtatatacgcaactactagaacaactaggatgtatagctatcaggtagcatgtatggaatattgtgtctaggagacataacggcagaatatcaaccggatataacacctacataccgtgcatcaaaataattatttctccataaattttcttcatcacaattgtttgtataaattttccaggttgtttgttagctttaaactatacgatattttcttcatacccacaaaaaattaattataacatttttcattatcttaaaaggaggttaacttaatttgtttaaaacaaatatctaacaaattaagtgcaaattaaaaataaggtgattttccttttaagttgaatgtttaggtgctctattttttttaacaaatcctaaaaaaatattattatcaataaatatgttttatttataccataaagctgcccctccttctaattggtttcatacccaggcaatttttacatacatatatatgagtactagaaaaatgactgtgcgttgcaacgggtgaaaactattttaattttattattgttataggtttagttaaagttaaattcactgtggaaattcgcttgaatatatattttcttagaaaatcaggagctgcagttaggagtctgattgtctcaaggcatgcgagtgtattttaaagagatttctatacgactccttttgattttcaaaagtggactaacttaaaaacggagtcaaacacggatatgtatttccaaatgcgaacaaaacttaaaaaccgactcaaacacagataacctacaagtaccggcaaaatcatcttcaatttttataatagtagaaatatatatgagtgaataaagaaaagagatctacataccttattttttatgatatacttaatctgtagtatttatttaaagttctaaaatataaatctctactattataaaaactgaagatgtttccgtggtccgtcatccgtatttgagtcggttttaattttatgttttggttttaatctatatgtcttctcttctctacttttataaaaattgaaaatgtttttaccggtattttggtatgtcatctgtgtatgagtcggtttttaagttattttgcttttgaaaaaaatacatatccatatttgagtcggtttttaagatcgttcacttttggtaatacagaagaaatcatataagaaatttatttaaaaaaacttacatgctaacttgaggtgattggactcctaactccaggccatgattttctaaaaatatatatatccaagcgaactctcgcagtaaattacatcttaactaaaccgtacaacaataataagattaaaataaacttcacccgatgcaacgcaagggtatttttttagtttaatactaatagagtaacagtgagggggtaattatcaatttgacagtacggataaattactaaggatttcttcttttttttttcaggtggatgtggcgcatgcgtggtcgtcgtgtccaagtacgacgccgtcgccgacgaggtgaccgagttctcggcgagctcctgcctgacgctgctcggcagcctgcaccactgcgcggtcaccaccagcgagggcatcggcaactccagggatggcttccacgctgtgcagcggcggctctccggcttccacgcctcacagtgcggcttctgcacgccgggcatgtgcatgtccatctactccgcgctcgccaaggctgacaaggcatccggtcgccccgcgccgccgacggggttctccaagatcaccgccgccgaggcagagaaggccgtctccggcaacctgtgccgctgcactggctacaggcccatcgtcgacgcctgcaagagcttcgccggggacgtcgacctcgaggatcttggcct

SEQ ID NO: 22231 - DNA, 1859 bp, Oryza sativa
  unsure (1)..(1859): unsure at all n locations
agaagttcttaaaggaaaaattggttagtgcaccagtgatacttgaagcagttcgttttttgaaaggtgttgtttcaccagctgaaggcacaacacatcctgaatacagagtcagcttggccgtcagttatctgttcaaattcctgtcttcccttactaatggcttggatgagcctgaaaatgctaatgttcccaatggttcatttactaatggaaccgcaaatggtattgttgattcctcgccagagaagcactcaaatgttgacagctcttatttgccaataaaatcaaggcaagagatggttttctctgatgaatacagacctattggaaaaccgatcgagaaaacgggagctgagctccaagcttctggtacatattctcttatcctaaattcctattctcaatccgagctcacatgttttacttttaattggactttcatagcctgaacatctgaacttgttatgcaggggaggcagtgtatgtcgatgacatctctgctccaaaggattgcctctatggggcatttatctacagcacacaccctcacgctcacataaaaggtgtaaacttcagatcatctttggcttcacagaaggtcatcacagttatcactttaaaggacattcctaccaatggaaaaaatattggatcatgctccccaatgctaggagatgaagcgcttttcgttgatcctgtttctgaatttgctggacagaatattggtgttgtggtacttacatctaaaccaactttcattcaaatgaggcagaactggtaacatgtctgaatattcagaaattttgtgaataaattcgagcttaccatgtcatattgccttgttgtcattcagattgctgaaactcaaaagtatgcctatatggcggcgaagcaatctgtgatcgaatatagtactgaaaatcttcagccaccaattctgacagtagaagacgctgtccagcataacagctacttccaagttcccccatttttagctcctacgccaattggtgagttcaaccaagccatgtctgaagctgatcacaagatcatagatggggaggtatgtacttaacacttttaaaaatagacagagaggttataattgtgtgaacgcatgacttaatatgctagtataatagtagaacaattttgatgcacactatctattgagcagcaggtgctaagaatgaaaggagcaaccaagattattatagttgagagttcctaacaattttaggagaaatacttacacccaatttctatttttttgttacaggtgaaacttgaatcccaatactatttctacatggagacacagacggccttagctatccctgatgaagataactgtataaccctctatgtgtcggcgcaactacctgagattactcaaaatactgttgcgaggtgccttggcattccatatcacaacgtccgtatcatcacgagaagagttggaggaggttttggtggaaaggcaatgaaagcaatacatgtgagcatctgactatgatgatttgcatttgcagaacaattatattcttgaactggtggaatttctcgtctaactctgtagttattcgtactacaatgcatatgcttttgtttaacaattataatagtagtacaatagtatttcataactaaaaatattgtgagaacttaatacatatttcattgttgtgggctattttaaaatgtgaaccaactatcgacggtttaaatgtctgttttgatagcgtcattagcatgaacttagaatttgtttggaatgcagaaagatctagatatgaccagaagtacctgttgtttgannnnnnnnnnnnnnnnnnnnnnnnnnnnnnnnnnnnnnn

SEQ ID NO: 22232 - DNA, 1024 bp, Oryza sativa
gcgaattcgagctcggtaccccatcgcgtctactctctcagtggacacgaacgccatcaggaggaagaacctccatgacttcgagagcctcaaggtgttttacgggaatagcgccggtgatccttcgacgtacagcctcgtcaccatcttcgacaagctggcgtcgtcgccggagtaccagcagagggccgccgtggtcgagcatttcaacgccggcagcaggtcgactctagcggggcactcttgcgtgccgatcacctacgacgtgaggctccggccatctccggggaaggtgtccatcatgaacgacggctccatcgccgtcgaggtcggcggcgtcgagatcgggcaggggctgtggacgaaagtgaagcagatgacagcgttcgcgctgggccagctctgcgatgatggcggcgagggcctcctcgacaaggtccgtgtcatccaggccgacaccctgagcatgatccagggaggcttcaccggcgggagcacgacctccgagactagctgcgaggctgttcggaagtcgtgcgccgccctcgtggagaggttgaagcccatcaaggagaaggctggcacgctaccatggaaatccttgattgcccaggtgaggatagcaatatagcatccttgtaaattcttgtttgagttttctcgtccttaaaaaaactaataactttttcagtaaactgcaagcatcagtaaagaaaatattgttttctgaaagatcattgtgtctgacagcattgtaaatttacaaatttgtgatggcatttgctcgttctcgctttcaggcaagcatggcgagcgtgaagctgacagagcacgcgtactggacgcctgaccccacgttcactagctacttgaactatggagctgcaattagtgaggtacacactaaagatacccagatacaaattacaacagaagctctgaaaatgcatttgccgaagccaatttgctgagcttgatctccttctcaaagctaatgcattgtccatccaaaatctgcacatga

SEQ ID NO: 22233 - DNA, 1344 bp, Oryza sativa
  unsure (1)..(1344): unsure at all n locations
nnnnnnnnnnnnnnnnnnnnnnnnnnnnnnnnnnnnnnnnnnnnnnnnnnnnncttggttgcactccagtctcgtggttactctgtcccagaccttccttgtgaacggacaatccttgaacaaatgttgtgttgtttacaggtctctgtagcagagttgacaaaagtaacaatttggccactgtctgatttgcaatcgatccattgtccaaattttgttctgcagcaataaccatgcaaaattcttgcatttagacggcgcccatgctttccaaatcatggtggttgcccttaattccaccttttgccggcgaattgggccaggtaagccgattttgtcatgtatttgccggtacttgtccatctccaaatgattgtgtctctagtcccctctatcagtgctatttcgctgctccaaacaagctggacatggatctcttttacactgaactccctcttaagctttaattttatatttaaatccttttggacatgaggagcatcctcaaaccgcatcgtgccacgtggtatgaggtttccggtttccccaaaaaaccccttttttaaatttttaacaaacctataatacggttgtgttgcttcaaaatttattttctccaaaggcatacgtaaacgaagttatacaaaataatgaggtcctcaagaaataactttttatagttacaagtatatattctactagtttctacctaatgtaaatactgtaaataaggattctattctattctcgtgtagtatgtgcttgctactccctccggtctataatgtaagtcattctaatattttctacattaatattgatgttaatgaatctagatcgatatatatgtctagattcattaacattaatatgaatgtgggaaatgctagaatgacttaagggcccctttgaatcgcagggtaaaaaaaacggaggaataggaaaaacacaggattctgacaggaattgaagtgtaaaacagaggattgcaaaacacaggaaaaacacatgaatggtcgtttgattggagcgcaggaaaaacgcaggaatcggatgagagtgatagactcaaaggaaattttccaagaggttggagctcttgctaaatttcctccaaaatccacatacaatgtgccattccataggaatttcatggaatttggaaagcttcaatcctttgaatcaaagggccaaataggaaaatttcatataggatttgaatcctatgaaattcctacataaatcctttgattcaaaggggcccttacattatgaaatggagnnnnnnnnnnnnnnnnnnnnnnnnnnnnnnnnnnnnnnnnnnnnnnnnnnnnnnnnnnnnnn

SEQ ID NO: 22234 - DNA, 671 bp, Oryza sativa
  unsure (1)..(671): unsure at all n locations
nnnnnnnnnnnnnnnnnnnnnnnnnnnnnnnnnnnnnnnnnnnnnnnnnnnnnnncctaaacttattgtgcacgcagagatcctcgcgttattgttttattatttaaatacattatgttttcttaattgtgaagctttttaattcatcgaaaagacatataagattacccatgtgtgtagagtttaaattacaatccacaggtaccacctaggtttatattcatctcagtattccataagtcgtagagctacaaaccaatgaaatcaaattaactaactgttctgttttttttaaaaaaaaaactactcttatgcagtataaaaactactagaatacaaaagcaatcttaaaaaacatatatactggaaggtgagatataacttgtgcgtgtgtgtatgttgtgcggggaataaaaaatgaataacaggagttaaaagacttagaatgagatttactgatttaatttgcaatatcaacaattcaaattaagcatcggaaacttccgcgtacctgtcagacattgtacgccgcaatttccaaacccccattttccaaaaaanaaaacccccccaccctataaacagcttctctctgcatagcagcatagtgcatatgcaattaggttgtccagcaaaaataagacaattattcagttacatactactgagaa

SEQ ID NO: 22235 - DNA, 1357 bp, Oryza sativa
taaaaaaaattaaaatccggttcctatataaaaaatctgcccatgtgataatactccttccgtttcatattataagtcgttcgattttttttaagttaaacttctttaggtttgatcaagtttataaaaaatatattagtattttcaatataagacaaacatatgataaaaatacagttaatgaaactaatttgatattttaaatgttattaaatttatctataaactttgtcaaacttaacaaaaatttgactaggaaaaaaaatcaaatgacttataatgtgaaacgaatagagtagttttttttaaacgaaaggcacaacacaccaattcatcgaatatagaaggagagctttatttacaagtaaaaataaagcgagaaaaaaatatttatagacaaggcagccgcctaaggcaagaactctgctaggtgtttggcttccgccaaagcgccaatgtccaagattttgactcttccttaatgttcgcaataaggaccaatgagaatagtttcttgttccgaaagattctctggtttcactcctttcatacttcccaagaggttaggagaattagggatatggtccctttcttaggtacaccctggcatgttgctagatttttcatcagttctaaactgtggtcacttacgttcagtttgtccacctcatggggtcacagactatctagttgacaatcgcttcccaaattgtccttatgtatgtgcaatccaccattaggtgaagagaggtttcatctgtgcatcagcataatggataactaccattgttctgccagtctcgaatcaccggtctatctgatgtccatactctattctgaataattagccacgtgaaggtttcatggagcctagggtttccgaaataagtggtcgtagtttattttgaacgacccaaagaattatgcctagtaggttgaggtggtggtgtattccccatagttcatgagatttcaagagatatcgtgggtctcgtccagggttagtgtgacatgttgaattgccatccacaggatgacctgctggtcaagttcccttaatttagacctgtgctatttccattcaaatttgtttctaaaatcacatttgattttagacactgtactttgatttgtgtttgccaaatggccggatttctttggaccccggcgacgcgactggatcctttcggtgggccgccggcccggatggtcgatcgtatgatgattgatgaatgttgtgttgccaccgggatcgagcatggccggcgttcgtggcgacgacgacgacccggcctaaaatgtcaaatcaagaacgagtctcacacaagcttggaacaacccgaacggaaatatttgt

SEQ ID NO: 22236 - DNA, 1206 bp, Oryza sativa
cgatcgtatgatgattgatgaatgttgtgttgccacggggatcgagcatggccggcgttcgtggcgacgacgacgacccggcctaaaatgtcaaatcaagaacgagtctcacacaagcttggaacaacccgaacggaaatatttgtctcgtgccgtgcatctacgtagcccgatgattccaaggcaaacgaatcaacaaaatttggagccaatatgggcatgcgactatgaagtgccgccgttggcctgctcctgtttatgcttccgctgttccgcacacatgtacaagtccatttagagatagacctggccatgccattagtaactaatatatatattatgtactccctccgttttaggttataagacgttttgactttggtcaaaatcaagctgccttaagtttaaacaagtttataaaaaaatagtaatattttaaacctaagataaatttattataaaaatataatcaattattgattcgatgaaactaatttagtattataaatattactatatttgtatgtaaatttagtcaaacttaaaacagtttgactttaatcaaagttaaaacacattataacttaaaacgaagggagtactatattaatccaagtgattagtgtactaagcctctatccgtctataaatacatgcaaaagcctctgaacttgccaagccagtgaaactgagcacacaataatctgcagctcgagataagatttgccccctgcaaagtcatctctagctagcttggaacacataatctgcgatcgatcgatggcttccaagcaaatgctcgctgtcgccgccgccgccgtcgccctcgccgtgctcctcccggcgcgcggcgccgccgccacggagcacatggtgggcgacggcaatggctggatcctcgggttcgactacgccgcatgggccgccaccaagcagtttagggtcggcgacacgctaggtaacggaaaagcctcgtcgccgccgtcgttgtcgccgtcggcggcggcggcggcgtgcacacgatcgattctttctcggcgcgcgacaagctagaaactgacggtcgcggcgtgcagtgttcaggtacaagggcaccaaccacacggtggtggaggtgggcggcgcggacttcaaagcgtacaacaagacggcgagcgcgaacgagtggagctccggcgaggatcgcgtcgcgctcgacaaggaggg

SEQ ID NO: 22237 - DNA, 1610 bp, Oryza sativa
  unsure (1)..(1610): unsure at all n locations
tcggcagcctgcaccactgcgcggtcaccacaagcgagggcatcggcaactccaggaatggcttccacgctgtgcagcggcggctctccggcttccacgcctcacagtgcggcttctgcacgccgggcatgtgcatgtccatctactccgcgctcgccaaggctgacaaggcatccggtcgccccgcgccgccgacggggttctccaagatcaccgccgccgaggcagagaaggccgtctccggcaacctgtgccgctgcactggctacaggcccatcgtcgacgcctgcaagagcttcgccgcggacgtcgacctcgaggatcttggcctcaacgccttctggaagaaaggcgtcgacgacgagcacgctgacatcaacaagctgcctgcatactccggtggcgccgccgtctgtacgttcccggagttcctcaagtcggagataaggtcgtccatgggtcaagcgaatggtgacacttcggcggtggtggtcaccggcgacggctggttccaccccaagagcgtcgaggagttccacaggttgtttgactctaacctgttcgatgaaaggtctgtgaagattgtggcatcgaacaccggctccggagtgtacaaggatcaagacctccatgacaagtacatcaacatctcgcagattccggaactctcagccatcaatagaagcagcaagggcgtagagatcggagctgtcgtgtctatctcccaagccatcgacatactgtcggatggaggcgcggtgtttagaaagatcgctgatcacctgagcaaagtggcctcgccgttcgtccggaacacggcgaccattggaggcaacatcatcatggcgcagaggttgtctttctcgtcggacatcgcaactgttcttctcgctgcaggatcaactgtcaccatccaggtggccgccaagaggatgtgcatcactctggaggagttcttgaagcagcctccatgtgattccaggacattgctggtcagcatctctatcccggattggggttcagatgatggcatcacctttcagacgtttcgtgcggctcctcgtccacttggcaatgctgtgtcatatgttaattctgcattcttggcaagaagttcagtggatggatcatcagggagccatctcattgaggatgtttgcttggcattcggcccctttggggccgagcacgccatcagagctagggaggttgagaagttcttgaagggaaaattggttagtgcaccagtgatacttgaagcagttcgtcttctgaaaggtgttgtttcaccagctgaaggcacaacacatcctgaatacagagtcagcttggccgtcagttatctgttcagattcctgacttcccttactaatggcttggatgagcctgaaaatgctaatgttcccaatggttcatttactaatggaaccgcaaacggtagcgctaattcctctccggagaagcactcaaatgttgacagctctgatttgccaataaaatcaaggcaagagatggttttctctgatgaatacaaacctgttggaaaaccgatcgagaaaacgggagctnnnnnnnnnnnnnnnnnnnnnnnnnnnnnnnnnnnnnnnnnn

SEQ ID NO: 22238 - DNA, 246 bp, Oryza sativa
cctatcatcccctctctccccttcctcttctctctatccctctctctcccctgagaatggcgagcggcggcgggcggcgcagtgaggcggctggcggcgggtggagcgcgacgacgaccactgtagcgtctctgaagaccacgcgctgctcaactggctcgtcgtcggcgcggcgctcgtcggcgacatgtcctggtggctgctcaacactcaacagcatgaactaccagctctggacactgatgg

SEQ ID NO: 22239 - DNA, 609 bp, Oryza sativa
ctgagcctgcggaacaactcgctgggcggcgccgtgccggcgtccgtgggtcgcatggagtcgctgaggtcgctggtgctcgcgtcaacaacctgacggggaacctgccggacatgagcggcctcaccaacctccaggtgatcgacgtcggcgacaactggctcggcccggcgttcccggcgctggggcggaaggtggtcacggtggtgctcagccggaacaggttcaccggcggcctccccggcgagatcacctccttctacctgctcgagcggctcgacgtgtcgtggaaccgcttcgtcggcccgttcatgccggcgctgctgtccctgccggccatccgctacctcaacgtcgccggcaacaggttcaccggcgtgctctccgacaaggttgcctgcggcgacaatctccagttcgtcgacctgtcctccaacctcctcaccggcagcgagccggcctgcctgaggcccgacaagaagccggcgacggtggtgctcgtcaatgccaattgcctcgaggccaccggcggagacgcgtcgcagcacccgtcgtcgttctgccagaacccaggccttgccggggggataactcacggcggcaggtgag

SEQ ID NO: 22240 - DNA, 3286 bp, Oryza sativa
  unsure (1)..(3286): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagttgaagaaatcctggacccatcatagtcataggtatgaagtgcagcttgtttctttgttttccttgcatgcatgtccagtaattgttctgtttgctgctcctagattctgcaagttatatatatacgtatgtatatactaatgcatctggggataaagcgagcatacattttctgttggacactatacatgaatgtaggtgacatagaatgatttatatatccactgtccaacaagaaaagtgagttggtttatatatctactttccaagatgatagcaaaaatgcaattagagttttgcaaactttgtaatcagagaaacaaccaatcacatcctgtgtgattaccctttggtttgctttgcttggagtgtaattagggatatatgtggattagggatacccttgcagtataggcaacaaactcaatgtatacactatgtggattagggatatgtatgttaatataaaactaacagaggaaaaagctactgtgttgcagtatagacaacaaagctactgtgacaatataaaattagcagaggaatacattccctttcttactcttaatatacatcggccggctattcgccggcccggcgaaaaaaaaaattagcagaggaaaaagattagttagaatggactttgacaaaaaaaaaggggagtttagcgtgaaatccttttacaaagctattaaaatgcaggcggtagcctctgatataacaggaatgtataaaaaggtgtggaaaattaaggtcccattgaagattagaactttcatttggttaatgataaaaaaacagcatcctgaccaaagataacttgaggaaaaggggattgaagaaaggaaacgataattgtcaattctgtggaaaaaaaaaagaaacgatacagcagttattttttgaatgtcctatggcaagattcaattgaaatgtggtgatttgtgctttcaatttaaaaccagttaaagatctgaagcatatgctttgggttgatgggcactgaatggtgatacaatgacatagctattgttagttggaattgctgctattctttgggcaatttggaaggccagaaatattgcttgttttaaccaaatacttcccattgatcccactgaaattattttatgtgcttgtaattggatttcaacttggtctgttttacagatgtcggaggaaagacagaatgttgctgtaagctacaaatctcagtatggttggaggatgactctgcaaaggttggagtatgtatgacaaagcgcgaagaaaaagctttcaaggaaagggtttctgaagtttttattggtttgaacagatcctggaaatgaattcatatggatggggagctatatcagttgtagaagttctttttttccttaagttttctgtgtttgtcagtttagcctggtagtgatagactgatagatcctgatgatgtagctgtgtgttagtttgaacgattttctgtttttaagctttttgttcgatgccctggaactgtccaggcatgagtgaccttgtagaaactttcacatttcttttaatagaaatggaggggtattgcccttttgataaagaaaaagggatataatatgttgggctggtattcctgttgatttcaattattctttttatagggcaagcaagggttaaatatggtaaaggtcaagtagttgctttgttagctgtcgtgacttgaagcttatgattgattttttttgacgcaaatcgaaatattctgtttgacgcaatgattgatttgaaatgatgtgttttttagcaacaaattccttttcaaacttttgactttggtttttcgtgtattttctctacagatgcagtggaagatgattgaatgtcttcctggaacatgtgcaagaaattgttaatcatctgcacccctcaaggactgagtgttggttaaaagtagttgttccctgcctccctgggagttagggctttagtagagtttagcgttactagttctcaggaggaatgatgtccagtgcctttcgttaagagttgtgtagaaactgaggtggtcgagtaatcttctctgctgagcgttttcgttttttagctggagtacccagcctaaacttggtttccctttaaagctggcaatacaagctgactctgtttccgtttaaagctgccaatacaaagctgactccgttcaagttttcaaacccaattgggtttgaaaacttgaacatcgaacaactgaacatttgcatcatgattttagcagctatcagttggcatttgtggactgagtgagatgattttgtctttgaaaatatcctttttaaaccacctatgcaagtgatacattagatttcttttctacagcgatggaagtctttgcagagaggagaagaccggagcaggttagaagttagaacaactagttgaagaattcctgctaaagtattgcttcaaaaaaaaaaaaagaatcctgctgaagatgagagttgagacatgccgacgtgcggcccgtagatatctaatactactagttctcttttgtttagatcctactatttgagactgatgatgtctggacttgtgtgtggtactcccttcgtcccataaaaattgcatttctagctccaaggctttgtcccacaaaaattgtatttctagccatgtgaggcccaaccaattgattcatctatataagttttcttccatcccacataatttgggctgctaatgcttgtaattttattaagtatgctaattatatgtgttaattctctcaaattctttttaatcatttgtatatatggaatgtgtgcatgtagtgggttcattaaataaggttatcatggtcattttccaatcctactattttgtcctaaattagctagaaatgcaatttttatgggacggaggtagtaactgggttttttgggattgggcctttttttttttggggggggggtagatgctagttaggaggtggtcttttgcaagggctgctcctttttcctttacgccttgatcacttaattcagggaggagatttattccgcacctcgatattggag

SEQ ID NO: 22241 - DNA, 16555 bp, Oryza sativa
actggtttgatgctttggtagatgctagttaggaggtggtcttttgcaagggctgttcctttttcctttaggccttgttcacttaattcagggaggagatttattccgtacctcgatattgtagtatagaattattccccctcaatctcctccaaaccgaaaaaagcctcagaggtattcctcgaaatgacgtgtccacgtgtgtgtaactgtgtatgtctaaactctaaagcttgttcggcagcaacagaaaatttcctagggagattcaccccagaggggggtttgggtttctcccgccacccaatccccttccagttcccctccaccatgggatgtttgtttggatcaaggggattggtgggataattcctaactaaacattaaaatttgaacacttcacacaaggcttaaagatacgctacaggaaatttcatgatattgtacagaattttcaaaatccatttttcttgagaaatcaaaatccaaaggccttgtccgtttccttgggtttcaatccccaaggggaatctatccagggagggagtgagtgaatccctcccatatcactcaatcccattggggtttgaatcccttgcatgatcctaatccctctcctaaatcccatgttcgttttgactgggatttcatacaaaacaaagcagcagtatactagttgcgtttgagctatttgtatgcatcagatcatgaaaaacattaagaaaaagaaagcctgttctgtacactgcaagtaagcactgctgaatcaaaagagctcaaaaacatggttgtcaccgtagcataaacggcaagtgatgtcacatgtgtccactcactacaatcagtaaatcacataaacaatgatgaattcatcaattttactcatgtcttcaggccatcttcatgccatcacctcagcataagaaatcttgctggggctttgcatgatggcagattgccagactccctgcaacacataatgaattcgaagacaaattagaagggtgaaagccccctaccaaatatatgcagaagatatctcgatcatcattatacagctgtgttcgtttcagcccactcccaacccctctccctcgttatccgcgtgcacgcttttcaaactactaaacggtgcgttttttgcaaaaagtttatatatgaaagttgcttaaaaaattaaaattaatccatttttgaaaaaaatagctaatacttaattaatcacacactaatggaccgctccattttccgtgcggggagatgggttcccaaccccagtaaccgaacacagcctgaaaaagaaaggaaagttcttgatttcagcgggtaaattttatgttcaaagagaatcaatagcatacaggaaaaacaatagctcgtattactaaagatgcatgctaactactcaagagtaacccccccccccccccccccccccgcggaggcagtgacaaaagtatgaaatatagtggttaaatatagccaagggataaacattaaattgagcatataaacatcacatatcatatacttgttgcccttagctgagctgacggctctaatgaacttcaaaaatccatatttgactttggttgtactgcgtatacttgcatatgtcactataattacaagttgatacatgtatgcattccttgtcagactctgctatctagcttgatcaatcagcatgcctagcttgtgcatagaatagaaaagttggattcatcaacactctattcagcaatagatgcataatgaataaaatccgttcaaaatgacagtccaaccgagtctgacaaacgagtgattgtagcttgcaactgtattctggaatcaactacaagtgaaaatcaaaatatctgaacgacagtagttgtgcgcgcttgtgcaacaaaaggagtatcacggaccaaccttttcccttctaagtttattggccatgagtaaaattaaagcaagaaaatctacaaacgaaacttatgtgcatcgtactatgctaaataccgaatatcgcgaattcagagttcagagaagaacacaagaaacatagtgtgtatagtgaatgcagcttgacagagatgtcaatatgactgaatgaaagcaatcttttatgttcttgtgttgcggttacaaactgtttatgctctgaggccaataaaattgtagcagtaaatctttttgctacgttttacaacatttttgctccttccatggttacttcagtagttcaattcatggattgctgatgatccatagctcatctgacacacaactataccactttagtttttaggaatgctacgatgggctcataaagtccaggaatcatccgaatatgacacacaattatgacactactatgctagatactggaatttcagagttcaaatttctgaccaagaacacaagaagaagaagaaaaaaaacagcaccaagaactgcaactcaggcctcccactcctccaattcattgcaagctatacctccttatcctttccgctcactcctcctcctgtttggtgctcgccaccgaccgccgccgccacgcgtgaggtggggatttaatggcatcaaggaaccctaaccataggacgaaggagagatgaggggagtagagatttaccggcgagaacgtggtcaccaaaggggactgccgccggaggggggggcatcgcggcgccgtcgccttcgtgtccgagtcgcgcggccgctacagccaccactgcgtcgccctgagcgctcgcaccccgtcgcgggggtttcttgaattcttcccacacgtcttgagtgggaagacgccgggatgggcctggttagaatcccgaccaggctgaaccgaacaccattttttctgtgggcctggattaattccgtgtgggggatgatggaaaaagtacaccgaaggtccctcaacttgtcatcgaattacaaaatcatcctccaaccgcaaaaccagatataggacatccttcaacttacaaaaccgttcactttaggtccttcggtggttttgaccccggtttcgtccgatgtggtggttgagtcagcatgggacccacgtgggccccacatgtcagggtgtacagtcagcacctttcttccccccttttcccccttcctcatctctctctctctcttcccctttacaggatgcccgccgggtggggagctcgtcggggcaaggtgggagaggacatccggcgggccggtgatgcggcggcggtgtcgtcgacgatgcgggagaagggagagcgtcaccggctcaccgcgcgtgcgacctcggggtcgagccgtcagagaggctcgggcggtggcggcgaggacgccaaggcgcgggactccgggtggcggcggcggcgtacgacgcgccgcgtgtgccggtttgggaccgattagaggagcagagaggattagggccaggccgtcatctcccgacgacggcggcgaggcaaaggaagggtggcgcggcgaggagggctcgacgaagaagatgaggagcgtgacgctgcaggaggccatggcggggctcccggagcacggcgacagccgcgtgaggtacagcgacgcgtggcggcgggcaaacgagggcggcgaaggcgagcccgcagcagcggggctaaggaaacagcggagacgcggttgaggagtggacggcgacgggcgggagcaggccgacggcggcaagggagttgggcgcgacatcaagcgatgcagtggaaggcgtcggcggtgagccgcctcgtccccgctgctcatcgtcgtcggtggaaggcgtcggtggtgagccggagatctctcgacgccgccatcgctgtcgcctaaccccgccgccaccgccgctgcccactcctacgccattcccttgacggggaagcgagggaacgaggaagaagatgagcgtggcgctgcaggaggacatggcggggttcccggaggtacggtcgtggtgcctccctcctcctctccgctctgctctgccagccaccgcgcgctcgcaggccgcctccgccctccgccacgcacttgcccgccgcgccctcacacgatgcctccgccggcccccgctcgctgctacccgttgctactcccctgcggcagagagaataaaataaagaagagacagagctactcccctgctcagctccgcgtcactgccatcgccgcccccgccgctgcggcgtcgctggtcgccgaaaatcctctcccgccacgccccatgtccccatcggtctcctccccacccgtcggccgatctacgagagaaaagtgagagacagaagaggaagggagagaaggggaaagaaggaggtgctgactgtacagcctgacatgtggggcctacgtgggtcccacgctgactcagccgccacgtcgaacgaaatcggggttaaaaccaccgaaggatctaaagtgaacggttttgtaagttgagggatgtcctatatctggttttgcggttggaggatgattttgtaattcgatgacaagttgagggaccttcggtgtacttcatggggttccagcccaatcccggccgttcccggcccaaccgaacaaggcgaagagtaaatcatgtccagctgtgcgcggcgccgcacgtttctttctagtattgggattagggtgagagacgagggctctaggagaggtggcggacacacgaacggctccgatcggctggggctgtcagatcggagggctgacgcaaggggagagagaactgttgcactgtagctatgtggaggcctctcgtgagccttgcaccgttcgcaggaaaactagaggtttaactagaaaggacctcgcgcattgccgcgggaagctggaaaacactgtttgagcatataatcatatgattatatgtacagaattcaccaactcgtaatatgtatagacataagaaaaaaaaatcagcatatcgcttgagattacataatggcagaaccaagtcaacttcatcgtgattacaaaatagtagaaccaccaactcaacttcaggtagatcccagttacaatatagacccatgttaaaatgacaatagtagcacacaactattacaagctcagattcctttttaagttaacatacgtagcagatagtaaaccacatgcatcaaaccataaactctactaaaagaaagtcatgaaaaaaggcgatcaattatatatgtagaaattcaaataatctgggacaaactaaccattatttaatcaacaaaagagtggttgaatcaaataaaatatgctagttagacttagtttccaagccaatgggtgtgtaaaatatactgcagaatatatatggcctgtcaagttaagtttgaaatattttctcgtacacaattgaaagcaacaattgtaacgatagaaatccaacaaaacaactccaactcattctcaaccaatacaattaactaaaaacctaaactgctatattattgtcatggtataccaaacgtaaattagaaaaattttaaaatatcataatccctttatgtcgaaatgcaatttaaatcttaagatataaatgcaatggtaatataatatggttagaggtaacaaccaccatggcatttgtgtagatcaaaagctcgtgtatcagtaacatccccaacaaacatttgacaatgacaacggtaagaaaaatagaacatacgcagaccattatttatcttgaactgaagatcaatgcaccgaatggaaatattgccaatataagcacctgatgaaatttgaacagaatcaatccatcatttgggagaaaacgttttactaaaatggacatgtgagacctaatcaatcctataactataaacaaccaattcactaaaaaaatattttcatgtgtcaaaaacttcattagtaatatccaatagacgaagaccctatttcatactccgatggataatatttggaatggattgacaatattttatgaaatggcaacagcaaaggtaacaccagatgcagatgtgtggcttactatttactactggaaagtaaatgaatatgtgagtaaaagtataccattggaagtcttatgctggacaagattatgcaaaacaaataaactaatgtcatcaggatacattttttacatgcctgtgcagtggttgcaatgtctaagcatggcacttctaataaaatggatagaaatgatcagttgtgtcataaagtaaatgagaggaccgttcatagcatgtgtgatcttgtccttattatgagccaacaaaataaaattttgaatgtagcgtagcatgctacacatgatatcgtccaagaagggcatgagatatgctatgcaagcataaagtaaggcatgaagagccaacagcttaaaagttgcactgggacataccaattggactggtatatagacactgtggcattgatcgccttgaagacaaacggaaatatgtagcgaactcatcatcgctagctagtagaggtgcacctgccaaaacaggtgtgtataacttataagcttttggaattggagaaaacaatacacagatcacagaactggaggcctttacacatggcactcaagagtcaagacaatagagcactaacttggaaccaagctagcagagatgactcagttgtgcgtacgatatcgatatcggtttggcgatggtcttccagaatgtgcaggcattggttaaagcagtacaccaatcacggctgaagcaagaaacaggaaggaatcacatctagacatgcccacaaagaaaaggcaaacattgaaaggcagttcaagcattgaatctcaagccaccctatcattatgttttcgaagaaatgggtgattgagtatgaaactaagggattagttcacaattaagctgaggtatcagctgtacaactaaaaaaaaatgtgtgccatgccaacgtaggaagggggaaaacaaagaaagaacttggtatgtagaagcaaagttggcatgcatattagaatgcagataacagatcaacacaaagagtgattaacagatcaacacaaagagtgatagatataagtgttaaaatcaattaagtgacagtattaaggagaacacatggcagattgcattatggttaagacaactgtggtgagttcagaaaagaattgatcaaaatgctggcatcaaaaggcagcagcaaagaagttgtatagactataatagtgtgaaattccttctccctaggatggaaagagcagttgatcaccctaactatctagtaagcactccaatgacaaaacaaactgtacaccagatgggtgtaatagactactaaatatttgtagatgatgaagatccttttcaagtgttgcttcaatgcaaatttgtgtctaatggctcaagttgtgctgaaataacgtaggcaaacattcccaaaactacagctggttcaattttgcataacaaagtagcattcaccatggtgggaatctgagaaggaaaaggaaacaggaacatacagttatttctggtttcaatagtagccattatattcatggaaggtagaccccaaaacctgtaagacttcaaaactataaagattgtcagaaggttatcagcttatcatcagaagtaatgctcgagtgatgaggtgaaaaaaatcttgaaagtcaaaacagggattcacaatttcccactaaaaatattatgtattacgagaaagctcaattggaacgtggcaccttccgctgtaattcttcagtaaaggagaatcaaaaggaatctaataaaggttaatggaaggaatgcacagatcaagtccatacatgatacatcaaatccggctaatcgagtgcatggctcaaagtccatacttaatagatcatgactacaccaggacccactcatgcatggagatatcgaatcttacacggtaaaatggaggcagtgttaaccttgaactgaataaaagcaaggtaaaccggagcatgcagatcgttgccaaaggaggggaaagcaagggcgctgctgccgatcttcttggacgccacctcagacctgcacacagtgctcatggagaagaaagggagccaagggcgccgctgctatagaaaggcgacgaaagaagccgtggcggcggaagatgcggctgtgcgagcgatttctgcgacgagagacgaggatcgaacatggcacgacgatttctgtgagggaggatggggatcgaccatggcggatgggaggggatcgatcttggcgatgtagtggcgtgcttgcgtggactggaagagatgacaggataaacacggaatggaagaggaagaaacaggggcaaaatgggaaagagggcaggcagtccgcacggacggccagattgcgcacagagctcatgatcagaccaacgacaatggtagactgtagctgggaacagtgtaacagtagcatgggcaaattgtaggtaggattattatgttctatagattaacataccacaaccggctgacggccagcgccataaattaacatatcagtactaagaacagatgatagaacaagtgtaacagctaacaaagtgttcccacataaaagaccaagatgtgtgtcaactactattagcttccctttcaaaatttccctttcaaaatggtcaccagcagcctcccttccaaattgctacagttgcccaacagtcccaatccacctccagattgcagtcccttcatacctgtcaaacaaaataagaacatagacttagatgaataatagtactatgctatgttgagttgttgattgaacatagacttcacacatattcaacaattatgaattgaatggttcaagtgaaccagaatttggaagcagtgtaattaccaaaccagttgcagggccgaactgataacagcctgacatactttgggatacaactgagcttagcacatctctgtcataaagagtatcatgagggaggtaacttatgaaatcagagccaccgacgactggcgccaaactgcatgcagaagggaggggtgcagacgacacgattctcccacagctcatgtcaacctgaagtaagtagtaagcaccgactgggaaggcgatcccatcccgatcttggttgaactcgcctaacatgaagtagatgatatgttcctctagcgagctcaggatggggtacattggtgtcatactcatcggcaggtttgcattacaaaattcttgttgattccacaactcctttagactgatctcatattctttcacccaagtgttactcttcagcagcagcctccataatgtcacatagcgatccccgggattgatgtactcaaggaatccatcgatggagatgaatcggatggatcccccagcataacccatggtgcgataaacttctggtgctgccacctgccctgtgtaccggacatcagcttgatatcccataggaagattgatgaagctgaagtccacccgatcaaccttgtcggagagtaggtcatcacaagagcaaaacagtacgccgcacaggagatccgcccaaaaaccatgtccctcaaacgagaaagtcaggtcggctacgaacgagctctcatcgtccagccactggttgggtaggttggccgtcttggtcagctcccacggcgaagaggacgacgaaggccacaggagaaggacatcttgccagttgatgtcgttgtcgccgtcgtcttctccaccggcgaactccaccttcttggccttgcccaggaagacgtcttctccggtgagaacgtcttcctcgtctccagtgagaacgtcttcctcagcgaactccggcatcttccccttgcccttggcgtcgtccccgccggaacttggcgtcgtcctcgccggcgaacttgggcatcttggccatgagaaccagtgcgtacgactggtcattatagccggggtggcggcgcgcgatgagaagtcgtgtggtacggctgacctcacagcaggaaggttcacaagggatcatggagagcaccttgccaattgtgtcatagatgatgtaggcgctacaaggagcttgaggcaggtcagatgtgaaaaccacaatgttcttgtcgacggcgtggacgaagggaaacaatctctctccactgctgctctctcctcctctcagggagaaagaggagagttttggggcatcggcgatgcgcgcttccagatccagacaccacaccaacgattcggcgtcgaagccggcttggacgttgtcgcccaaggcatcgaacccccacgcgtgacggcttttggtagccaagcgcaggcaccgcaagggtggtctctgatctgcgtaggcggcggcgtcacggctcgcgtcgccgtccagcacggaccaggaagggaaaagcggatacatggtggtggagaaggcgacgtagggcaggcagaagccgtcggcgaacgcaagggcaaggggggattgggaagagggatcgatctcgtcgtctcgatctgtaagcgccgtcggaatcgtcggatgaaggacgacacggatcgatgtgattaattagacggcggatgcgtagctacaacaaacacaatgcgagaatacggcgtggattgcctgttttggttcgagaacggcactccagagactccgcgggtgccacgctggtgggtgcgggtcagattgtataagttagcgtgggaatttttttaaacaaatttcttatacgattcattctgtattatcaaaagtgagcgatcttcagaaccgacttaaatacggatatgtatttctaaaagcaaacgaacttaaaaaccgacttatacacggatgacgtaccaaaataccggcaaaaacatcttctatctatctatctattatattactagtaaaatgcccgtgcttcgctacgggtaaaaagaacgtttaaatgtaataaatatttcaagaacggatataaaacactgtcccattttgatatactcatattgtcataacgcgctctctatcaactctcacatggcaagcgcatgatattatttacaaaattgagatggtgcttggactgtaaaatatcgtgttttgcggatgacggaaagaaaataattacttacttaaaattattgatttttgaattatccgttattgttcgtatattgtctgcattatgcaccacacacaatatccgtggatccacatagttgcctcgtgttgcaatagataaaaactaaattaaatttatgttgacgtaaaaattaaactatatatcataattatgaaagctaatggcatagccaaattatgaaaatcagtgttattattttttcaatgggagtattgttttccatttataaatcacattgtcaaatatcgaaaaaaataagaagcagattagacgtagagaaaaaaaacagaaataaaaactatggaagcagagtgacagggaagggataagaaagcagcagcagagcagtctcggacctctcggttcttccattctcaatttatctctatacacgatactctgttcttatcctcccatctcactctcttagacactggcagggacatgtaaaaaaaccgctccccatcactttccccatttctcctcctgctcagctgctctcgatgaatccgccgtcttcctttttctgctctttcctcttggttttctctcctctcatctgctgctctccctcctcgaccacccaccgacggcgccactccctctccgccgctccccctccttgtccctccaccgagcccaccggcgatggatccaactcccccgaactcgctggcgatggatcggccttctctgagcttgccgacgacagatccacctcccctgagctcggtccagccgtcgtcggcgttgggtggcgaatcagtcgacgccgatagcagatcgagctccccaacggtggattgagctgccacaacggtgcagttcggtgccgagcggattggggcggctttggcctttaggcggagggagtggtcgaagacggggggaggctgagcgagtcgtggatgccggatccggtgggtttttcttgtctcgtgatgtcctccatgatcactatttggtctgattggtgtttgttttgttggatttctcaggatctggtacagtggacgaatgtctggctcgacgtcccgttggtgcttcttctggtcgtccagtcggctctcaaggcctggctgcggcccgccgagtttgagagctcgcctgccccgtgcctgccagtgactgatgtccttgattcgccgtcagttccagccactgacgcctatggtaattttcatttttaagataatatatcatgttattcatgtgaaatcttgggatcatcttgcattggagcaattctgtttttgaaatgggggaattgcggaacaccagtgtatttccatgctgattaatttggaacatagcatagtgaacaaggtgacaggtggttatcttgatcttaaactgtctccaactcttcattgaatgtttctcagatgaattgattcatttaattcattaaagccacaggcatatgctgaccactgcatttcttgtacaatgttgaacaggtacatggagttggctcactgagttgatgaggctttgtggttcatggcagctgatggactcactatggatcaccctattatgacaacagaattctggacatcacatgagtgccttcttcttccctatgagcaagcattacctgaaaacattagagtgaaactccctcacctcatacgtgctgttcatgttgctgtccagatagtaacatgggttaccgacccgatgcatggtaacacaatgaaggctccttgtggcctcaagactcgctcctttgctacttttcagtatttgcttgttcctattacttctcagtagtatgtaactgaataattgtcttatttttgctggacaacctaattgcatatgcactatgctgctatgcagagagaagctgtttatagggtgtttgatggttgattgcggcgtacaatgtctgacaggtacgcggaagtttccgatgcttaatttgaattgttgatattgcaaattaaatcagtaaatctcattctaagtcttttaactcctgttattcattttttattccccgcacaacatacacacacgcacaagttatatctcaccttccagtatatatgttttttaagattgcttttgtattctagtagtttttatactgcataagagtagttttttttttaaaaaaaacagaacagttagttaatttgatttcattggtttgtagctctacgacttatggaatactgagatgaatataaacctaggtggtacctgtggattgtaatttaaactctacacacatgggtaatcttatatgtcttttcgatgaattaaaaagcttcacaattaagaaaacataatgtatttaaataataaaacaataacgcgaggatctctgcgtgcacaataagtttaggccattaagaatagaatgactgatctacatgatatataatagatttcaaggttctatcacaaagcagaattccatcaagtttatagtgacaaaacactaacttttgaaacattaacaaagttcaggagatcaaaactcaaccaaaaatagcaaaattagaagagacctttaggtgttctatctaaaagaatagcatgcaaagtatatttatctagcaagatattgattaggagattatgtactggtaaaaacaaataattagtttacattatgttaaataattagtttacttgcttgattctcaagtaatttatctctctgaccagaaggtctgcatgatgtgtctgttctagctggaaggccatattggtgtatgagaatctgtcaaatccctatggaatagcgggaactctccttcatgtccaagtctcgcagtcctatcttccgaagccggtaagcattctgcttccattcctacttttccaggcagctttcctagagcctattccttacgtaaaaaatgacctctcgtggtcctactctgtctattcgtttaagccagctgtgcttttcattttcttttatctttccgcgagggcctctgctttcctttctatccctttatttctgggggcattctaaggttttcatgatgatctactctgtggtgctcaattatattactgattgatgtcttacgtttttacagctgtttttgttcgttttattgagctgcaggagattagatcacttcattattttgacactaatatgatattccaacattgaatggtatcctattgtgctaatcattttcctatgttgattcctgtagaagtttattttcaatggcggacatgaactttgggagtggagaagcatatggtaggtgttttgcgctgccgccagttggaaatatgtaagttttacggtctctcaacctcaactccttcctgcttgtttgtgttgcatgatgtttcatggtctgcactgttcagtggatgtggtcatatggatagtcaacctctaaatgatactactactcgtactgaagtaagtacttctagcttgtgtggacactaagatctatactattatgtgggtgtggatgttcaaccactaaatgatacttatcatactgatttgtgcaaacattgataatacctctaaactgcacttagttagctgtgattttgagtgccaccacgcaatcatggaagcaatctcagaacaacttgatatggatgcatgatgcatatgtattgagtattttgcatgccactgtttgtctttatttcatattagaattgcatatagtgtagtagttgttcttgctcctactacatttgacctggcagagttgatgcaaagttggatcattctaaaaaaaattaatctggttctaaccttttcatttgtgtgtatgttaagagtgaaaaataattgctgccaatgcttgctatatgtaattgattttgtctgaatttactcaataatttaggtaaaaggtgggaaagtagtgagcaggaagtagaagaataatttacaaattccagtctatgagaggagacgaataattaaatatccagattcaattgtgattgttccaaaagttatgccaaaaaataaatacaattcttaatatgtgcatcattaagggctaaagaattacctgcgtccatcataaacgtagatttagtatcacgttgaaccagaaattgctcactttgaaaaaaataacaaatttgggggcatatattagtgccgagtgagagattgctcagtatccacaccaaattttgggtgcatatgagtcttatttgtgatatgtgatttcagttttttgtataggttgataagatgtttgtattctacttggacatgtaatttcaatagttggattctgtatgtaattcggtatgtaatttctatcattggactgtgtgcaatttttgggccatctaattgttcccgactctatttggcctttgtaatttctgagtcatgtatttgtatcctactaaatttgtgcttcaacccaatcggatggaaaaaaagaaaaccacggtaaaaaaaaccggacatccgaaaaaaaacagggtagaaaaccgcaaaaaaaaaccggatagaaaaaatcaacgaaaaaacggaccaggaaaccgtgaaaaaaccggacggcccagaaaaaccggacagaaaaaacgacgaaaaaaaaccgggttagaaaaccacgaaaaaaccggatggcaaaaaaaccgcgtgtgcgttcaggaaaccgccgacggacgaaaaaacctcacggaagccttacgaatttttttattaggtatagatgcagatattatattatattattaaaacagctttcaaagaagtcaccacgttccctgtgagggctagaaatttccacattaatcggagaaaaggaaaaatgtgagtccaagtagaaatacattttaaaaattattgaaattcagaattaaaataagcaatattgagataagagtccatataagaaccaaatacgagattaatcaaaatttggaataaaataaaataaaatttaaaattagaaaagaaaaggagattccaagtaggaatacgatttaaaaataattgaaattcgaaattaaaaataagaaatattgagagaagagtcgatataataacccaatacgagattaattaatattcagaataaaaataaaaataaaatccaaaattagcaaaaagaaattcccacattaatcggagaaaatgaaaaaggagagttgaagtagaaatataatttaaaaattactgaaattcagaattaaaataagtaatattgagagaagagtccatataagaacccagtacgagattaatcaaaattcggaataaaaataaaataaaatccgaaattagaaaagaaaaggagagtcaatgtaggaatacgatttaaaaataattgaaattcggaattaaaaataaggaatattgaaagaagagtcgatataataacccaatacgagattaattaatatttagaataaaataaaaataaaatccaaaattagcaaaaataaaagaagagttcaaagtaggaatacaatttaaaatttactgaaattcggaattaaaaataagcaatattgaaaaaagaatccatataagaa

SEQ ID NO: 22242 - DNA, 3482 bp, Oryza sativa
ttaaaaatggagggagtatctattatatactaaaactctaaaagtccattaaatttacactaaaaatttttagtattttttagtacctctcaaatactacaaaatttatctttcaaaaagacatatttatagtaccaaagttatgacgtaccgttccttgttggaatccaaaatgcacagttgagagattcctgatctcagacagccaccacaccagctcaacaagaagggctcctgccaaagtgccaaaccctcagcgcggaagacaatgcaatcatagtccatacatcgacgagccgcggcacaaggccgaagagcaagcctcgggagacagataagctcgacgcgcgagaaccagcactgcacgatctggagcgccacgagccgcgaccgcggcgcgtcgatcctcagcgcggcgtcgcgatcggcatcttttgcacccgcacagcgacagcgtccgcagactccggcagcattgcctcgatgatcaccacctacggcgacgacgacggctcggcggtgaagagggaacaggttgtgcagggtgaggctcgcgacgcggccgaacagctccggccgcgcgcggcgaggaacgacgtcaaccggcgcgcgtatagtacagcgcctggtcgcgctcctcgcacctggtcatcgcgatcgcggtgtgtagctcgagctccaggagctcgacgcggacgcggcgggtgtcgatggcgtcgccgaccacaaatgcgttgatccgtgtcgtcccacatccaacgagacgctaaccgattcggtctccctccctcctccgttccgttcagtcacctgtgaaatataaaaataaaaaataaatcgggatgtgccccgtctcctactagtaccgcgcaactacaaaagaaataaacccgcaacaagaaaagaaaagaaaaaaaaccctcgctgccgccgccgccgccttaggtcgtccacacaacggtgggtggccaggtggggcgccgccgcctacgcaattaccttggttgattcgccggattcacgatcatgtctcggacttcgactcctccttcctggtgtttgctactccaaaaagtacactgctccgactacatcgacggcgactacgcgaagaagcaagggcttttgagcctggatctgctatgcgaaagcaagcgggcttggggattcgacgacagcgacttggtcgatggtatcgacaccgaatcgatgatggagtacgtcaaggtccaagtgcgcgtcaccgatgcaccaaatctgtccttcctcacgatgacgctgggaggagacgaggaggagaaggccgtcttccccatcctccatgccatggacaggaatttacttgtgttcgacctcagctttcctgacaagatcgatggtgtctacctcatctacgatacaattggcaagaccctctccatgatcccggcgctatctagcctatctagccctgatgggatggcccataccactcaagttctcatcgcgcgccgtcatgctgctgttgatgatggttcctatgctctagcccttctgggcaagatgggggtggttgacaagccgggagagatgcctgtgatcagctggccagatgttatctaccaatggcggccatcatcgtcgatctcaccgtggaagctgatcaagaatgccaaccttccccaacagtggatggcggacaagagtgcgttctcagctgatatggccttctcctttgaggggcatgccttctgggtggatctgatacacggcgtcttgttctgctcttgcgctgacctgctctctgacgacgtcaaggatgtagactttgactccatcgatcttcctctagattgcctcaagttcaccccgcatagctggacaatggcagagcgtcaagcatatcgtaccgttggctgcactggaaactccatcaagttgatctctatgcacttcagcggatgcgtcaaacgtggtgcccccaaggtgaccgtatggcggctggaggtgtatgctaagatttgggtgaaggagcatgtcctaaatcttaagacattgtggacacaacctgcattcttggctgctaatttacccatggacatggcggccatgtatcctgtgctgagtatgcacgaggagcatgtcatttgctttatgctttggcgagtatgatctcagtgcctcaggagttgtcctacccagcaatgtgcgacatttccttcgtgtcgatatgcttagtgccacgcttgtctcttccgcacccattccttcggcttacagctatgccccagttgttgtgccttccgacctcacaagctatatccctcctactgcagctgttgccttccctactgttgctcctactgtctccaccgccgccattgccactgttgtctccccacctaatgtccctgcctcccctgctagtaatgcctttgccttacctgataaagccccgtaagtagaaaagttgttgaatgtgcatgataaagccccgtaagtaaaaaaaaattgcaagacttctatgtgcaaatgaaggaattaaatttgaaaatatacattgttttttaatattttgcgtttatatacatgtatgtaaaatatttgcataaatatacctcctccgcaagcggtgccgcgcttccattctgcgggaccgacggtcgtgcagcacggccgtgcgacaccgctcgctcccgcagtccgggagagcggcagcgtggtggagggcggctgcactcggtgctgaggcggtcgcacggcgcctatgcgcgggaccaaccctgtcgcgcggaaccatggcacgcagcaccgggccgtcccgtcccgtgcgtgcacgtgtcgcggccgacacgccccatgcaagcatcacctgtcaagcacccatggtcgcatgcaggcagttgagccagtcaaaccccacaatacatagtccctagcttaagggatttattaagccaaattaatctgtcattagcaaatgtttactgtagcccaacattgttaaatcatggagtaattaggtttaaaagattcgtctcgcaaattagtcacagtctgtgcaattagttattttttagcttatatttaataatttatgtaggtgttcaaacgtttgatgtaacatggtgaaaaatgttagggtgggatttaaacaggcctagggtgtgttcgctagtataggttcccaactaggaatacgcggaaaacggagcggtccattagcgcatgattaataaagtattagctaaatttttttaaaaaatagattaatttgaattttttaagcaactttcgcataaaaattttttaaaaaacacaccgtttagctgtttgaaaagcgtgcgagtgaaaaatgagagagatgggttggaaaatggaggtgccgaacacacccctaagctagtgcctgggatttgactgggtcaactgcatgcatgcgtgctcgacatgtgatgcttgcatggcacgtcaaccgcgacacgcgcacacgcgggacggga

SEQ ID NO: 22243 - DNA, 4503 bp, Oryza sativa
tcggtcccgcgttcccatcctacggagaaggtatatttgaggtatatttgtgcaaatgttttacatgcatgtatataaacgcaaaatattgaaaaacaatgtatattttcaaatttaattccaaatcttcatcggatggctgcagatgcaattgtagattttgggccagatgtaacagccattcgactgaaatgaggtccatctatatttgaagagaaaagatgggtctaattagggaaaagaagaaaatctgatgctagtgttggctggcataaactaaaatcatatttggggacggggatgttacttcaaatcttacttatgtttccctgacttatatgttatgatgccgccatgtgtccaaaaaaaatttatcactggtagcctggtagtttctccctttctctgaatgtggtttattagctgacttatgctgaatatgatgcttccaggttaccaaaccaacatttgcaagattcaattagtactagctgctagctagtttatatgtgaaagtaagtttggttatctgaaattttattttcattcagtgaattgttcctcgctttccactcacaatgtttactatcaaatagtctttgaaagtacgctgagttgtctgaaattttgatttcagtgagttgtgcactgctttcttctcacagatttcgtcagatgcttcattgcttgaggagcttaagttcgccttgctctgcagctttcagttagagactattgaagccatgaatcgattacaccctgttcgggtcgagtcgtcccactctctccgcgccgtcaaaaccttggaaccacatgctccgccgcctccgcgctcatatgctccatctgtgctccccgtggccgcagtctcgccatcatcgccgccgagcaccggcattttttttagcaactgaacgcgaattaatcccagctgcggtagcgcgagacgccatgcctggtcgccggagatgaacacccggccgaaatccgccgacgactccgacagccaggggtcgccggtcgccacgacctggtcacgcaccaaggacatgacggtcgccgcgtcgccgtgggcagcggggaggcggtatatcggcggagaggacgacggcgggaagctcgtatgtacccactgccgtggaagtagacgagcaccgggagattctgcttctccccagcgacggcggcctgtggcttgtacgcccgaagcttgaggccgcggccggcgtcgtagacgacgtccttccactggacggcggacagcgggggtggcgcaactccggtaccggagggagggtgttctagtcctcgaagcggaccaccgtgccgtcgctcaagagctggaggttagggccgcagtcctcgacgacgtacggcgccggcgtggaggatgccgtcgccatggccggtgaggtcgactcagtcatctcagtttgatttgaagctaaatacagtcatacagaggacgaatcgaatcgattaccctgcagcttggagaaatcatcacttcgggtgctaatatacaatgagctgattaattaggcacgacaataatatgcggggcgctgtcgcagcacgttgatatactaatatggagtagtttgtatattaatcgaagctaagctctagaaattaattgcttgcgcctatacgaatgtgaagttgcttgatagccactgcatttttcgttctgtgatctgacctctcctgtaatatgttgactattgagctttcactaaagggaggagtcgtcaaccatgtagcctaccctctccgttccaaaaataaaccaatcctagctatgtatctgaactgaacatgtgtgtccagtttcgtagctagggtttgtttttattggaacagagtattatgttgaaagattattctaaaattttgagggaatatcttttcattgtttatatgacacttaaataggtattttttaaaaaaaattaataaaataaattaatatatgattgatcacttcataaacatggaagttaaaatttaagttttacatgttagaacgaaaaaaaattgtaaatatattttaactagctgtaatttcattttttttaacttgtaagaatcaaaatttaacttgcatattttgtagagtgatctatcacatgttagtatatttttttaatattttaaaagtaagtttataactatttaagtgacgtatacataacgaagaacgagagtttaaaatttattctgagcctgtgccttctaagtaacagttgttcgtagcgaacttgcgtcaacgaccatccaaaatgggcaatgcaaaaagatcttgcaacactaatcaggcgcagatcttagtggcaacgacggcatgtgctgcacttgacgcattcatacagatctggtgctcgacacgccggttcatcacaacagacgagaaaatagtgggctactccgtagtggcggagccaaaaatttaactatatagggtcgattacttctagtttgtattctagtgtaattatttctctgttttttctgaatttatacataaaaatcaagttttataagagcgtttaaacaagctgtggagtcagcagatagattatgcgtgatccgccactgctactcggtaggagtacagtcgtacactactcacatcgcatgacgatgaaaagtcaaatcaccaaatcaaaattgcagtggtcaacaagcaacttcgcatccgtaggtgccaagcaattatcatgaatctgtcgaaattagccctcggcaactattcaacgaaatccacgtgcttcgccacccaatcgtctcacacttgcatcaaagttctaatcgattactactactagctactcctgctacaaatagtaccggaaagctcattcccagctgtagtggagccgaggagtcgattacagcatgagtcaaactgagctgcctgagtccacttcgccaagcgagagctcgccggccatggcgtccaccacgccggcgccgtacgtcgtcgaggactgcggccctaacctccagctcttcagcgacggcacggtgatccgcttcgaggactacaacatcctccctccgccggtcttgcctcccgcgctgtccaccgtccagtggaaggacgtcgtctacgacgccggccgcggcctcaagctgcgggtgtacaggccaccggcggctaccgtcgccggcgagaagctcccggtgctcgtctacttccacggcggcgggtacttcatcggcagcttcgagatggataacttccacgcgtgctgcctccgcctcgcccacgagcttcccgccgtcgtcctctccgccgactaccgcctcgcccccgagcaccgccttcccgccgcccacgacgacgcggcgaccgccatgtcctgggtgcgcgaccaggccgtggcgagcggggacgccgccgacccatggctcgcggagtcggcggatttcggccgggtgttcgtctccggcgactcggccggcgcgggcatcgtccaccacgtcgccctccgcctcgggtcgggccagatcgccgtcgacccggcgcgcgtcgcggggtgcgcgctgctgttcccgtacttcggcggcgaggagaggacgaggtcggaggcggagtacccgccggggccgttcctgacgctgcccttctccgaccaggggtggcgcctcgcgctgccgcggggcgccacgagggaccacccgctggccaacccgttcgggccggagagcccggcgatggacgccgtcgcgctgccgccgctgctcgtggtggtcgcccagctcgacctgctgcgcgaccgcgacgtggactacgccgcgaggctgagggcgatggggaagcaagtggagatggtggagttcgaggggcagcaccacgggttcttcgccgtcgagccgttaggcgacgccgggagcgagctggtcccggtcgtgaggcgcttcgtttacgggaacggtggtgacgctcgcggcggcgtcgccggcgtgttcaagtaaattcagccgaccagacaccgatcgctttttgtggcattgcgtcagctgccacgtgacagcatgagacacgccccagttcccaccatgtgatacacggccacggcccaccttggaagcctattggacattggattttaactaggcccactcatatacgacttgtaccaaaccaatcttctcaaaaagaaaaggaataagttcactcttggtccctctatttgtcacccagtctgattttatcccatgatcgcaaaactgggtacgacagatcctccaacttacgaaaccgtttaaaaaagtccctcggcagaatctgacactggttttggctgaagtggcgcttacgtggctattttaactcggtcttcatacgatgtggcattgacgtggcgtttacgtggcaattcgatctaaaaaataataaaatctatgggacccacatgtcagtttcacatatacaataataaaaatggtggggcccacatggaccccacctatcatcccctctctccccttcctctt

SEQ ID NO: 22244 - DNA, 16229 bp, Oryza sativa
cggtagccgcccctatgcgctgcccgccgctgctcaccattttcaggggagagagagaggggggtagggagaagagaaaggatagaggggatagagagagagaggtgatgacaggtgggatccacgtgggccccaccatttttttattagtgtgtgttacactgacatgtgggtcccatatattttattatttttggatcgaattgccacgtaagcgccacgtcaatgccacatcggatgaagaccgagtcaaaatagccacgtaagcgccacctcagccaaaaccgggtcaaatactgccgagggaccttatttaaatggttttgtaagttggggaacctgttgtacccggttttacgatcgagggatgaaaatcagactgggcgacaaatagagggacccaaagtgaacttattccaaaagaaaaataagatgaattgtatgattgctgttttttcttttcaatgacgaatttgaaattccacatgccatttgaattgttccctaccatttgtgcatttgcgagagaggagtatgacaggtgggtcccatattttttataaataaaatgctgactggactaccacgcgtacgccacgtaggacaaaactgctctggattgagtcgagggggggtaatttgtctggtattgaaagtttaagggtgaacgatgtcttttttgggtttaggggggtaattcagtcgatcgcgatagttcagggggaggggggttaattcgtactttttcttaaccactaatccatttgagatgcattgctggagaaaggggcatcggtcccggttgataaactcctatagtcccggttattcggtcgaggggggtaatttgtttggtattgaaagtttaggggcgaacgatgtctttttcgggtttaggggaataattcggttgatcgcggtagttcggggggaggggggttaattcgtactttttcttaactactaatccatttgagatgcaccgctggagaaaagggcatcggtccccgttgataaccccctatagtcccggttatgcaaccggaatcacgaatccgggactaaagatgccccatctttagtcccgggtgaaataaccgggattaaaaattataccaaccgggactaaagatggacccaggtcaggtccggttgctagttcttttttcttttttttcccattgttttaaacattgaatattgatttcactccatccccgaatcatccccagatcgtgaaatcccaaatcgatcatcacagatcagagaacaaaaggatatcttcaaatcctcaaatcgatcgtctccaaatacatcacaaattctaaaaaaaatacatcacaagttctaagaaaatcatcacaaatacatcacatatttacatcacacacaaatcaaatacatctaagatccgaatcataaattctcaaaaaaaaaatccgccatccaccaccctccgctggcctcgctcgatctgctctcgtcgatagaggaggaataggaaggagaggataagagagaggaggaataggaaggagaggataaggataaaggagaggaatgggaagatgagcaatttgggaggataagtcctagggattatatactgtgtatggtttttttacccactgggactaaagattaattttcaatcctaaaaatgcttggccccctgacagtctcggtcagaaataggaaggagagtgtaagagagaggaggaataggatcacctaggactaaagatcacctagggccgacagagttttaaaccgagataaaaaaaatcatatttagttccggtttctattcaaaccgggactattatgttttttgtccacccaacaaagatggtttatccagtagtgatgactaataggggaatgactagaatggatgcggagggagaatgattgttgccgagcaaccaaacaaagccttctggatagaagccatgttgctgttgagtggatgggcacataaccgaggaatcggtgccagagagcccttgagtccatgttgttgtcgagtgaatggcacatgagccgatgaatcagtcatagcccttgagtcggctacccgtgcgattcctctcttgacttcgcgtgtgggttctcctgtgcgaaaaggctaatggtcagcccatttcctttttggcccactcggttttggcctttccttttttttactaggccttgtttaattccaaaattttttttgtcaaaaacgtcacatcaaatatttaacacatgtatagggcattaaatgtgggaaaaaatcaattgcacaattcgtatgtaaattgtgagatgaatcttttaagcctaattacaccatgatttgacaatgtgatgctacagtaaatatttgccaaggacggattaattaggcttaataaattcgcctcgcagtttacatgtgaaatctgtaatttgttttgctattagtccacgtttaatacttcaaatatgtgtccatatacttcaaaaactttacacccaaagaactaaacacaccctaatcattttataggcttatggtcacttagctttctttattcggcagatcgagtataaattgagcctttttgttttcctactaggccatttcttatcatcccacacgtattttttgccttgtctatttttctaatttattttaaaaaattgattgaagttatatgtacatgttgtacgtacaaagttatatatgtatatgtaaaaatataaagtttatatgtataattttttattgggctaatgtgctactgggccagaaatcctcttgttggccattttaaaaaaaagagaaaaggaggcgtagagcaccggaaaagctaatacgcgcgagccggcggtgcgcgtttcgggcccagaaggcccagcgtcgctgtgctggcgcgcgtgcgtctcctccactttttttttaccttttttttttccttttttcccacttttttcggttttttatctagcatgttttgagttcgaaagttttaaagttttgagttgaaaattttcaaatctgaacttgaaagtttttaaatcccgacttgaaagttttcaaatctcaagttgaaagttttcaaatctcgatgaaaagtttcaaaattttcaaatcttagatttgaaagttttcaaaatctcaacttgaaagttttcaaatctcgagttgaaagttttcaaatctcaaattgaaagtttttaaaattttcaaatctggacttgaaagttttcgaatctgagtagaaagttttcaaatttcaaggtgaaagttttcaaatctgagttgaaagtttttaaaatttgaaacttaaatcgaaagtttttagatctaacttaaaaaaaatttcaatatgttagtaaaaaaatctctagaatctttcctaattactatcattagtgttaagtacattaactaatatagttacttaagactaaatggagggaggaatactcgctgctgacgcgcacacgccaactagcaacctccgtagatcacacccgtattggttttgtccatgccttattttttcgtttccaattgtgcgtcccttgtgcgtgattgaccgtggattagaccacccctctcctgtgttgttcttgggccaaagctggcgtggcacccatgttatcaacctgggtccggaatgcaaatatgataaatgtatatggtgattaaataaaactatagggttaccttaaatttattgtaaaactttagtaactaatactaataaaagtgatgagtgaaattaactcaattaaaaaagcggcatatgctctgttgctcaccttagcactggacactggtaggtgtgaagcaaacgtcagtggtaaagttggtatcagttggactccgttgtttatacgtcggtgctcgtccttttctgttcttcttcaatctgatttgcttaggtgtggaaccaacaccaaacctttaaatctactgctctactttttttttaacaactgtactatttgctggcatccgttaaaagagcaaactggaattgtttacacgtccctctagtctcatggttccagttctagtatactagagaatctgaacactactccctccgtccaaaaaaaaaaaaaggcaaacgttgggtttccgtgtctaactttgactgttcgtcttatatgaaatttttttataattcgtatttttattgttgttagataataaaacatgattaatattttatgcgtgacttatctttttaattttttttataattttttcaactaagacggacagtcaaacgttgaatacggaaaccagggtttatctttttttgggacggatggagtacgttataacccatgtggtcaataaaattgataataatctcaaaggatatccaaatcctatatactttcatagagttgaagaaaaagtttatacatgtaccataacccctcagcgtgatgtcttcgaatgatcaatccatagtctaatgtgtatagccttttttctatgattgatcaaggccacaaatctctttcatttgcaccttatttccatctctgccaaacaatattcccgtggcaaatgcccggaattttatccaataatactataaaaagtaaagagcacttgccacaattccactatccatatggcaaattgtttggagtagccgccttcggatgagatcaaggatacactacctacattcccgaacaaaaataaaaggaacaatatactccatggtgaactgctagatagccaccaggaatccacgatgcgacagcctatccatccatcgccaaccaaagcgcccgatggagcatcctctcactctcccgatcacgcaccagaatttccacgcggctgcaaacatgcaactctccggacgcgatgcgccccatcgctgtccaccgctcgatctatcaatctttcggcggcacacgccggaaaggcgagctgccggcgacggccagggccccctcgacacggccaccaccacaaccgaacaccctgttccgagccggtgaaaaaaaacgccaaaaaaccccacgtagcgcactagcgtctgtagctgcgccactgccaccgccaccgccaccgctggccaaagccaatccaagcttcccgttccgcccccgtaaaaaaaggcgttccaagcggcggcgtacttatcgaaatggagcttgggcccccctcctcaacacggtgcgaatgcccgcattaactagagcgctgcgctgtgcactgctcgctgcacgggtggcactcgcacgcgagaaagcacgccgcgcattcgcctctcacggcgaaatgctgtcgcagcccgccgcggcgctggctcgcttgccccccgcgtcggtgcgcgtcctcgtcgggttcggggcggcgctgctcgtctcgctcgtcgtcctccaccgccgcccctcctcaaggggggcggcgggcggcggcggcccccggaagtacgacccggccgcgcggttcctggccctgtccgagggggcgaacgcgaccatcgccgccgacctgcgggcgctcaccgcggggccgcacctcgcggggacgggcgcggcggccggcgccgccgcgcgggtgctctcggggttccgcgccgcggggctccgaaccctaacgcgggagtacacgccgctgctctcgtacccggggcacgcctccctcgcgctgctccgcgccgaccggaccctcctcgcgcacctgtccctcgacgagccggcggaagtcgggagccgcctcgtgcggccgtaccacgcgtacgccccgtccgacggggccgtcgcggaggcggtgttcgtcaacctcggccgcgaggaggactacctcacgctggagcggctcggggtgagcgtccgcggccgcgtcgcggtggcgatccgaggaggaggctaccgcggcggggtggtgcgccgcgccccgaaaaggagcgccgctgccgttctcattgccggccacgcggacggcggggtcgagaggggcacggtaatcctcggaggccccggcgacccgctcacccccgggtgggccgccacggccggggcggagcgcctggatttcgaccacgaggatgttaagcggcggtttccggccatcccatctatgccggtgtcgggcaagacggcttcggctatcatacggacactaggtggcccggctttgccggcggattggcagaccggagttggactcccggtggatgtcggcggcgttggacctggtcccactctggtcaacttcacatatcaggtataaaatacaaatcgcctggaggattgtctatctatgattactcgcttagagacaaggacgctgggtacgtttgcagggaaacaggaatcaaagccatggaccgctcctttgacctatcttgactgggttttccagtgataggctgttgccattttgttttcaacttaagagagacgtctgtgctgaatggggaaagagtcatcgtagtagtccatgttgtaaactgccgtgttgagattctggataagctcctaaattgtttgagctgtaaaagatgtcactacatttgcagtttgattaggaagcacagtaaccatttccttgtccgcttgactattttggtttcagtggacagtggtcctagcacctgttgttttattagcccttttttatatctgtggtagtgtgtacaaaactacaaatagcattatgcttgatgttgagcgtattgaccagcctttgctcctttgtagtgcatattggttaaacttagttagattattattgttacagatttatacagaatgagaaatattattgtgggcatactgagctatgagcaccaaatcattgagcacttgtgacgtaagttttgcaagtggtatgcttttatggctccctttgttatgttgctgtaggcctatttgtcattattctgtgttgtttctatatgctggatctgttgtcatgtctctcaattggatgagctatatatattggacaaataaagcattgcataatagctgtccgtgcttgtcctccaggcaagttagtgtttcaggatgcatcttttcttttgcacagttttgcatatttgtataactggcagatgagactatgttttagagttaagtacaatcaagaccataatggttttctcttatatcttatttaaggaggacaggaagatgggcatgatacaggatatttttgctattattaaagggtacgaagaacctgatcgttacgttatccttggtaaccaccgagatgcatggacctatggagcagttgaccctaacagcgggacatctgcgcttcttgatattgctcggcgtcttggaataatgctgcagtcaggctggacaccacggaggaccatcattctttgtagttgggatgccgaagagtttggaatggtgagttcatattaaagaaaattgagaatatgttgctgaacaccatgtgaaaaaggaaaccatgcagatgcccccacaccctaacattttcaaagtaacatatatggcatttgcattttatgaaaggaaccccacaaaaaaatcatatatagttggcatgttcgtagctatccttttgaatgaacttttctggttgatttgattcatctgtcacagttctcaaagatctcatttatttgtgtcccgtttatttcttttctacattttgaaggttcttttttccagatcggatcaactgaatgggtcgaagagaacctcgaagatctgcaatcgaaagctgtagcttacttaaatgttgattgtgcggtgcaaggaattgggctttttgctggttctaccccccagttggacaacctcttggtcgatgttacaagacaggtagagattaatgtgtttccattgcatttttctatgagcttgggttttcatttagaaacctcagtccactcagctatttataccaaattttagaattgttctgaagtgaagttatgtttattcattcagaactttttgcttctaggtaaaagatccagatgttgaaggaaaaacagtccatgatacatggaataaaatgaccggaggcatcaatgtaagatctcgaaggtttaaacatgcttttctatatacatattgagatgtactcaatccaggttgtcactagctgttctaaactggtttaaagtcaaacatcacttttataatagccatctagtggtcacactttgtacactacagggttggtaactttgaattatctatgccgacaactaatcttctgcatagtgagttactgagttggttgttcttttgttttgagtttttagtagggtaaggtatgcagttctacattgggtgcagttgctccaagtgcagggggcaggcccatatagatctcagttcctagagtgagacatcccccacacaagatatacttacgagatgtgctaatctggtgtcgtcgaatctttgttgtagtcgacagtctacatgacaactatacaaaaatgaaagtgaaaattactacttgctatgcactgatcttatacttctgacgtgagcaattccttctttctttttttcaaatccttacaaaacaggtaatataaatacatgaaattgttatttagataaagatatatcgatattggtttagtagaacgcatcagtggcacaaagaacgaaccaaaaataatagtaataaaagataacgataacttcatgtttcataacttcaccttatataggcatctagccctcaccaccttcatgggctaacgcaggcccctggctgtggcccaggtggcctggggcctgaaagtgaaaacctattcatagaaactagccaaatacaggctgggccaacccggaattaagcccctgaccaccttaaagctagttgggggtggcacctccaagataaccctctaattattaggactatcacatagtatgaattaactaattacttggtatctggctggttgatctttcaaaattgtttcgctgaaattctttgtcagaatttttgaaaaaccttctgaatgaaatatggtcaacaatttatccatcagcaatgattagttggcatgaacagctaattttgtaacatctggaatgactcccactcatttttgtgtcaagcccacgtcataattactccaagcactccaaatgatggcttccataaataccatggaaagctccaaaccttacaaaatgtcatttgctttccacgacaatcagatttaccatttaagggcgatacctttatgtagaaaaaatttccgttctgttgaagttgacatggctgtaccagttgaaggtgcatgtgaaagtcagctgtatcggttgcagagaataatcgctactcggttgtctccatcaagttgagcatgcaaggtctggatcccacatgcaatcttagtgctagtcaaaattcacactttctacatagaattgtggaataagataataaccaaattgtgtcgatggatattccagttccaataaattaggctacaaactacctgtacctggttatacattttttgtgttgcatactgttacatattaagaatatgcagtccgggtttatcactggactaactttggtcaaggagcatcaaggtgtgatgcatcacccagttgctcactcaacaactgtctcaagtcccactgtccctttgaaactcttgtttccgaccatgcaattagatgccttggcccattgcttctcaaggcctcaaccacatactaagtgctatacaacttggtccctaccatgttaacccagccaggacgtctgaaataattgtcctaactggcgcggggaaaacctcacctatatcaggcacatgtatgtcccactttcccatgcctatttaccagcgggtgcacaaatacaatgtagattgatgaggtacctatgatgtgtatgattaaaatcatgtgtatgtgtgaagtgtagaactgtaaattaggcaactaatttccacagccagttcacgtgtccatgacactccatctgtcttgttccctgtcttcaatgaacaaactgcttattgtggtcctccttgctgtagtaccttccatcacctcacttgtgtgcctgaagggtgagtttctggcgcaggaggccaagcattctgccagacgcccgaggagccattccatctacttcactctgattttgtctaaacttttttattgtgctgtaaattaattactatcgcttgctaccgtaagtgaaaaaaaattctggttatgatcttttgagcgtctaactcatatatatgttctgattatttactgacaatgaattcgcagatagaaagacttgccagaactgattctgactttgctccatttctacatcatgctgggatcccctgtatggatttatactatggaaaaggtattttaagcatgcaatcacgtctttctgtttattattgttaaattaacttataactttccttttccttctccaatatagcatgtaatatacggagaaaaagacttgctttttttgctcaaaaaataaactgtttttttctcaaaagagagaacagtatatgttttctaagcagaggacattaatgcaaccccattttttaggatcgttactgcttgctcattttttaaaatattttgttgagctatgtgatttaattttgtacatctctcaatcgtttcctggttccaagataaagttagaagagacaaaatatttccccatcaccccactttctagagagaatgcaggacatcatctaactggtctaatacgcagaatttcctggatatcatacggctcttgactcgtatcattggatggaaaagcatggtgatccactgtttcttcgtcacgtggctagtaagtagcagtaatgatcttttaaaatgattctgaaagggagaaaatgtgcaataccttacaaactacaattttgcttgttcaaattactgttaacttgaatgcactggtacaagaccagtcaattattataaaaattctatggactatcccatatagaactagacataaggtcgcagctgagtttggtatttttgtgctttaaaatatgttgtacacatctcttataatactcatcatgctcatttactttggctcaacagttgtggagatttggggactactggcccttcgattagcagatgaccctgtgctgccttttgattatcaaacatacgcttcccagttgcaggtacatcgattctttcagaattagcacaagcatttaacattttcatatgattggcatttatcatcctgaaggactgtacgtgtatgtttatgtagcatattcaatttttgcttatgcaatgggagcttgacccaaaaacagggttttgctcaaaacaacattgtaattgacaattttgaatgcacatatgctcaatctagttgaactgaactttagaacacaaatataagtcacgcatgatgaccaacttcatgggttcatagatcatattagagtaggggtatatttccttttcccacagcatcatggtctcatcttctgatgtacattttgaacttgcaatgtcgcaggagcatgcaaatgcattctctagtatgatggaaaatagcaaatgggttcatttgctgaatagatccattgaagatctttctgatgcaggcttagaatttctgaaagaggcaaaggtatgttcaagaatctttttttcttttgctttatattctgttttgtctttctgtttccatgtaattaggtagtctgtagtccattatagttgcggttggctgaagatattttcttctttagctctttcactctgcacactgcatatcacttctgtatgtacaaccagtttgaaacggcagtatgtatatttggatatccaattttatttagacatttgccttttgcagttttgctgcacatacaggcaataactttaatttcttagaacttagtaatccttttggtgcctgacatcacattattgatgctttctcttaaaaattattatatcagtacagttatttttccattcccatgatggatgccatttattttgccacttggatctcatgttttaaatattttgtaccaatctatattgccgatgataaccttattttcttttgttgatttggaacattctagaaattacaggaccaaaatatatccgatgggtactctctgatgaggcggcgattgttgaacgaccgtcttctacttgctgaaagaagctttctgcaagctgatggacttcagggaagaggatggttcaagcatctggtgagccttaagtgggtcagccatgaacccacttataggtcaaaataagcaggtctgcggcttattttggcctataagtgggtttcgcgggttagccacttacactcttaagcctcccgctattcataagtcataagtcataaccaaatttagaaaaaaaaaatgttgtgcgtgaccacgcttttatatttcttgctagatgtactcgcctccggaggactacgaaagcaagctctcgtttttccctggggtggcggacgccatctcccggtcgagcaatcgaagcgcgaaagaacagcaggcggcggtgcggcatgaggtgcggaaaatctctagggcaatccaaagagcagctgatgttcttagaggcgaattcagtaataggaacgaatctttatactctagcctttctgtggctccataaaaactgtgtataaataaaatcgattggggtttgagaaatgaaatcttgttcctgtgcgaaggtggttttatattgcgtttcttgacactactctttttagagggcattatgcttaattaaaacaagaagccaggattgcaatctgaacagcaacaacagaaattaggaagtctgatggaagtctaagctaagtttgaagaaactaggatcgcagctattatttgcaccggcaaaccaactattcctagcacctcaatttagtctttgttttttcataacagaaaagaaaaggagaccaatagcactttggaaaaccagtgcatgttaaaccgcccaccaactaccagggtttttaaaccgccgagcccggagttaaccgcgtagtaaggcaaaccctgccaaccacacctcaaaccccccttaaaaaaaacctagagctcatattagctagtactccctccatcctaaaatatttgacgccgttgactttttaaaaaatgtttgatcgttcgtcttattaaaaaattaattaattattaattcttttcctatcatttgatttattgttaaatatacttttatgtatacatatagttttacatatttcacaaaagtttttgaataagacaaacggtcaaacatgtttaaaaaaatcaacggcgtcaaacatttagtgaaagagggagggagtactttactgtacaccacgttcatattgctgtgagctcaaattaaatggaataaatataataacgaaaatcctaccagctacccacaaacggtagccggcaggaacagcccaaacctgcctgaaatggaaccgcgaaaaaaacggaaacgtgggtagcgcgcgcgcgcgctcgcgctcgcgcatctgctcatgccgttgcttagtattctttctcgtgcaattattcaactaatcacaaataattatagcgttaattttttcccatgcaaaatactccaactagccgttgccacacttccatgtagagacgaatccaccgtctcctctcctctcgtacgcacatacatagagccggccatggatttgccaaatcccaatctccccatgcaaaatcttgccaagatccacgagatcctgaaccaaatctccatctcccctccgtgagatctcccggtagatcatgtcccccggtgaggaggacgtggaagccagcagcgacagcggcggctccgcgacaaggcgttgcgccgcgtgcaagttcctgcgcaggcggtgctcccgcgactgcgtcctcgcgccccacttcccggcttccgatccccacagatacgcctgcgttcagcgtgtcttcggcgccggcaacaccgccagaatgctccaggtgatcactgatcactactactagtagctagctataccacacatactaccacactcatatttctaaacggaaattacacgagctggtatgttttttcttttttttgagcgtggtatgttttttcactaaaataattttaccattattaataaaaaaaataccaatgtaaatctagcagtatttcgaggtatcaaaatttctcttttcactatcacttggtagtgtgcgtgcgttggtttacgtcttctatgcaattgaaaaaaaaacatatggggctatattggtgtcactagctcactcactgtacaccttattcagttagaagttggcacgtgatcgaagttgttacttgttagtgataaaattgttgatgtgtagtgtaattggggaaagtgaattcatccctcgagaggatatcccgtcgtttcacatatgtcacataaatagttattaaaaaatatgaaaaaaatttagtaacatagattaatgtgaaatatatcactccacaaacatacaagtttaaattcaacttttacaagttgtaacaaaaacaacaaatatagttgtaaatgtgcgataactattttcaatttaatttgttatttttgttgcaacttatagaaattgaatttggttttgcatatttgtggagtgatatattttatattaatctatattgtcaatttttttttaaattatttaataactatttagatgacatgcaaacatgtcctctcgagagatgaaaatccacgtcctaataattgggctgcaaattggaacagagctatactccatatgttaatttcgcagtgatgcgcgtctcaattctatcgttgtattgcgtgcagcaactgccggtgcaggagcgcgggcgggcggcggactctatggcggcggaggcgtaccggcgggtgcaggacccggtgtacggctgcgccggcgtcatcaaccgcctccaggaccagatccgcgccgcccagtgcgagctcgcttggacccacgcgcagatcgccatgcacagcgccgccgccgcccacgcgcgtacgacccttccgccggggcagcgagacggcggcggcggcggcgcaccgtcgacgcagcaggctacgacgtctgccgcgtggcagctggaagacttcgcatctgaattctcgtttccttgattggcttcacaacacgtcgactgatgagcgatgagacagaaatctgtaacatcttcatgtaataaaactgcatttcattctcagattcagagtggcctgaaatttggcgccgcggtggagaacgctgcacacgccatctcgtccgttggatgaaaaatcaacggctctaattaacctattttaacaaacggcacgtcaagcgcccgataatatctaggttcggtccgacccaacaacgaccgatcccatctaaaaaagaatggcattatttttcctttttatcggcattttggaaaaaaataaactccctttcatttggatagccatgagacaagatagaacattaccatcaatatgattttatttttccaaaaaaaaaaaacacttttcttctgtacatatataccacatcaacacaaatccaggcacagattattgttggtgtttatacaaagctacgccaaagaacccactatctctaggctttggcagcaaagctctcgagatctctctccacgacgtcgaggccgcagagctccttgacgatcggcatcgtcgccggcacgtccatctggaacgtcagcgacgagccgccggcgccggcgaactccttcctggccgccctgatcgcctccctcatcgcgcagtgcaccgacgacgccagcagcagcggcggctcaccggacgctgccacgatggatcacaaaacagtttcagatttcgatttccttcacgatttcagtgctcaaaggaagaagacgatgatttcacctttggaggagaggacgcgcttgtgatcgcgggcgctgttgatgagctcgacgttgaactgcttggggatggtgtccacggtggggatcttgtacgtccacgtgccgtcgttgatgaccagcccatcggagttggtcgtgtactcctcgttcgtgaagaagccgatcccttgcacgaatgcgccttccacctgatcacaaaaaacaacgattgcacattcagatcacatataatttacatctcattcttgcaatgattttgcaacgcgcagaattgcagatgc

SEQ ID NO: 22245 - DNA, 15945 bp, Oryza sativa
  unsure (1)..(15945): unsure at all n locations
ttttttttttagcgctcgaagctattttcgcagtcggacgtgttgcccgcctgcgaaaatcaactattttcacaggtgttgaggtgcaggcggatggcttgtccgcctgcgaaaatatgatttggccgcttgcgaaaagcctttttctagtagcgaggataccgtggcaacaagataaattatgagttaatcgttattttccatgatttagatatgttctgagcggatgtgacgacgggccagacatgatgtgaggaggctgagcgtgactaagctggtcagaggctagagtagcacatacgcttagggcctgtttagttcgcgaaaagaaaattttgggtgttatatcggacgcttgatcggatgtggaaagaggtttttggacacgaatgaaaaaactaatttcatgactcgcctggaaaccgtgaaacgaatcttttgagcctaattaattcgtcattagtacatgtgggttattgtagcacttatggctaatcatggactaattaggctcaaaagattcatctcgtgatttcccctctaactgtgcaattagtttttttaatttatctatatttaatactccatgtatccaaatattcgatatgatgtttttaaaaataaaaatgggaactaaacaaggcattacttaccttcgggtctctgtatgctatcgtactagttagttcaactgtatactaaacttttctgctaaagtattattattttttttccagtatgtcttaaatgtctttttatgctctagagttaagtcctctttcttttttcttttttttatgcccgctatatctcgcttcagtccgacccaacaccgaccgatcccatctaaaaaagaatggcattttttttgttccttttcatttggatagcatgactccatgagacatgatagaacaataccatccatatgattttatttttcccaaaaaaacaccttttgttctgtacatatataccacatcaacacaaatccaggcgcagattattgttggtgtttatacaaagctaagccaaagaacccttctatctctaggctttggcagcaaagctctcgagatatctctccacgacgtcaaggccgcagagctccttgacgatcggcatcgtcgccggcacgtccatctggaacgtcagcggcgagcctccggcgccggcgaactccttcctggccgccctgatcgcctccctcatcgcgcagtgcaccgacgacgccagcagcagcggcggctcaccggacgctgcatgccatgaaggacagcaacaatatcagaattcagatttgagaaaaaaaaaaggagcaaacgaagaagagattttcacctttggaggagaggacgcgcttgtgatcgcgggcgctgttgatgagctcgacgttgaactgcttggggatggtgtccacggtggggatcttgtacgtccacgtgccgtcgttgatgaccagcccatcggagttggtcgtgtactcctcgttcgtgaagaagccgatcccttgcacgaatgcgccttccacctgatcacaaaaaacaacgattgcacattcagatcacatataatttacatctcattcttgcaatgattttgcaacgcgcagaattgcagatgcaactgatattttgaaggtaatttagtagattgactgacctggcccaagtccacagcaggattcaggctctgcccacagtcgtacacgaggtcgctcctcaggatggtggtttctcccgtcagcacatcgacttccacctggagtgttcatgtgcagattttggatggacaatgcattagctttgagaaggagatcaagctcagcaaattggctcggcaaatgcattttcagagcttctgttgtaatttgtatctgggtatctttagtgtgtacctcactaattgcagctccatagttcaagtagctagtgaacgtggggtcaggcgtccagtacgcgtgctctgtcagcttcacactcgccatgcttgcctgaaagcgagaacgagcaaatgccatcacaaatttgtaaatttacaacgctgtcagacacaatgatctttcagaaaacaagatttccttactgatgcttgcagtttactgaaaaagttattactccctccgtttcacaatataagtcatattagcatttcccacattcatattgatgttaatgaatttagacaaatatatctatctagatttattaatattaatatgaatatggacaatgttaaaatgacttacattgtgaaacggaggaagtagtttttttaaggacgagaaaactcaaacaagaatttacctgggcaataagggatttccatggtggcgtgccagccttctctttgatgggcttcaacctctccacgagggcggcgcacgacttccgaacagcctcgcagctagtctcggaggtcgtgctcccaccggtgaagcctccctggatcatgctcagggtgtcggcctggatgacacggaccttgtcgatgaggccctcgccgccatcatcgcagagctggcccagcgcgaacgctgtcatctgcttcactttcgtccacagcccctgcccgatctcgacgccgccgacctcaacggcgatggagccgtcgttcatgatggacaccttccccggagttggccggagcctcacgtcgtaggtgatcggcacgcaagaaatgccccgcttcttccacctgttgccggcgttgaagtgctcgaccatggcggccctctgctggtactccggcgacgaggccagcttgtcgaagatggtgacgagactgtacgtcgaaggatcaccggcgctattcccataaaacaccttgaggctctcgaagtcatggaggttcttcctcctgatggcgttcgtgtccactgagagagtggacgcgatgtgttcgacgatggcctcggcgatgaacgagccctgcgcgtcgccgggagcccgcatcgccgacttcgacgagacgttcgtcttgcagaccttgatgtcgaaggagagagccccccagttgtacttcttcagagccccgacaatggcgactggcaacaccgggctgcaatccggcgatattccgcagttcattccaagatcaacgtgcagacccgtgatcttgccgtcggacttgaaaccgacggagtactttaccttcatcggatgccgccctcccgccatgatcatgtctgtcttgcgatcgaggtacattcgaaccggacgccgcagcttgaatgcggcgacagcacatgcagcggcaacctgtcaagcaacaggtacttctggtcatatcaagatcattctgcattccaaacagtttgtaatttcaagctaatgacgttatcaaacagagatttaaaccgtccatggttggttcacattctaaaatagcctacaacaatgaaatatgtattaagttctcacaatatttttagttatgaaatactattgtactactattataattgttaaacaaaagcatatgcattgtagtacgaataactacagagttagacgagaaattccaccagttcaagaatataattgttctgcaaatgcaaatcatcatagtcagatgctcacatgtattgctttcattgcctttccaccaaaacctcctccaactcttctcgtgatgatacggacattgtgatatggaatgccaaggcacctcgcaacagtattttgagtaatctcaggtagttgcgccgacacatagagggttatacagttatcttcatcagggatagctaaggccgtctgtgtctccatgtagaaatagtactgggattcaagtttcacctgtaacaaaaaaatagaaatcgggtgtaagtatctctcgtaaagttgtcaggaactctgactataataatcttctacgatcttggttactcctttctttcttagcacctgctgttcaatagataatgcgcatcaaaattgttctactactaaactaattcctccgtttcacaatgtaagtcattctagcatttcccacatccatattgatggtaatgaatctagacatatatatctatctagattcattagcattaatatgaatatggaaaatactagaatgacttacattgtgaaacggagggagtacctaattaagtcatgagttcaggagactataacttctgtatctattatattcaaagtgtttaagtacatacctccccatctatgatcttgtgatcagcttcagacatagcttggttgaagtcaccaattggcgtaggagctaaaaatgggggaactgggaagtagctgttatgctggacagcatcttctattgtcagaattggtggctgaagattttcggtactatattcgatcacagcttgcttcgccgccatataggcatacttttgtgtttcagcaatctgaatgatagcaaggcaatatgacatggtaagctcgaatttattcacaaaatttctaaatattcagacatattactagttatgcctcatctgaaagaaagttcaggtggtttagatgtaagtaccacaacaccaatattctggccggcaaattcagaaacaggatgaacgaaaagcgcttcatctccaagcattgggaagcatgatccaatattttctccaccggtaggaatgtcctttgcagtgataactgtgatgaccttctgtgaagccaaagatgatctgaagtttatatcttttatgtgagcgtgagggtgtgtgctatagataaatgctccatagaggcaatccttcggagcagggatgtcatcaacatacactgcctctcctgcatatcaagttcagatgttcaggctatgaaaatccaagcctctaagatgctctaacatgggtagcacgaatttagattgtagtattcgaaatagtaattaaaagtaaaacatgtgagtttggattgataataggaatttatgatgagagagtatgtaccagaagcttggagctctgctccggttttctcgatcggctttccaacaggtttgtattcatcagagaaaaccatctcttgccttgattttattggcaaatcagagctgtcaacatttgagtgcttctccggagaggaattagcgctaccgtttgcggttccattagtacatgaaccattgggaacattagcattttcaggctcatccaagccattagcaagggaagtcaggaatctgaacagataactgacggccaagctgactctgtattcaggatgtgttgtgccttcagctggtgaaacaacacctttaagaagacgaactgcttcaagtatcactggtgcactaaccaattttcccttcaagaactcctcaacctccctagctctgatggcgtgcttggccccaaaggcgccaaatgccaagcaaacatcctcaatgagatggctccctgatgatccatccactgaacttcttgccaagaatgcagaattaacatatgacacagcattgccaagtggacgaggagccgcacgaaacgactgaaaggtgatgccatcatctgaaccccaatccgggatagagatgctgaccagcaatgtcctggaatcacatggaggctgcttcaagaactcctccagagtgatgcacatcctcttggcggccacctggatggtgacagttgatcctgcagcgagaagaaccgttgcgatgtccgacgggaaagacaacctctgcgccatgatgatgttgcctccaatggtcgccgtgttctggacgaacgacgaggccactttgctcaggtgatcggcaatctttctgaacactgcgcctccatccgacaatatctcaatggctttggagatagacacgacagctccgatctcgacgcccttgctgcttctattgatggctgagagttccagaatctgcgagatgttgatgtacttgtcatggaggtcttgatccttgtacactccggagccggtgttcgatgccacaatcttcacagacctttcgtcgaacaggttagagtcaaacaacctgtggaactcctcgacgctcttggggtggaaccagccgtctccggtgaccgccaccgccggagcgccaccattcgcttgacccatggatgaccttatctccgacttgaggaactccgggaacgtacagacggcggcgccaccagagtatgcaggcagcttgccgacgtcagcgcgctcgtcgtcggcgcctttcttccagaaggcgttgaggccaaggtcctcgaggtcgacgtcggcggcgaagctcttgcacgcgtcgacgatgggcctgtagccggtgcagcggcacaggttgccggagacggccttctcggcctcagcggcggtgagcttggagaaccccggcggcggcgagggacgggacgagcacctgtcggccttggcgagcgcggagtagatggacatgcacatgcccggggtgcagaagccgcactgcgaggcgtggaagccggagagccgccgctgcacggcgtggaagccatccctggagttgccgatgccctcgctggtggtgaccgcgcagtggtgcaggctgccgagcagcgtcaggcaggagctcgccgagaactcggtcacctcgtcggcgacggcgtcgtacttggaaacgacgaccacgcatgcgccgcatccacctgaaaaaaaaaatgatatcctcagtaagttattcgtactgtctaattgataattaccatcactgttacttagtacagtagaaatccttaggtctactgattgcaactgcttgtattgcgcactgttgctgatgcagaaacatcatctgattactgatgaactgtcatgtcagtcactgatgaggtgtctgttaacttttgtgaattcaaagaaaatcattttctcattatctcaggaaaagcattgtggaaaacggaccactcagctttatggattaaatttaaggagaaaagctggaagtatccagaattgagaactgttatagtagttgcatatatacttgctacctgatagtgatacctatagaaaaaggacaaaagaaaaacaaaaaaaaaaaacaatttgcaggcggaaagctggatgattcgttttagaattgagatggcgctgtcgctagctacttcgctccaacaactgcaaataacacgataatccagtaagctactgggcaccttcttcttggtttgttctaattaatttattgctacactattctgcgcgatatgtacttacgtacagttaatttcctcttcctggaggacatgttttgtagtactccactagttttctcatgctgtgaaatactgtacatcagcacaatactagtgtactccagcgatcaggtgagctaaatggtgctaaaaaaaacagtactaattctgtggccacatccggaaaacaccaaataaaacagtaatagtactacttaactatacatggagattttacctggcgagaaaaactacacgcagactcaatcacttgaccgtcaaaacagactagaaactggacagactaagaaaggaatgaacaaatggaatggatttgaccagtatagctcaagattcccacgagaaaggagaagaagatcgagaagggagagagatggcagcgccgacatgcatggtggtggtagctctcaccttcgccgcagccgagcttggggccccggacgggggtccgcgtgcggaggaactcgagcagcgtcgtcgacgggtcgacccccaccgcctcgtacctctccccgttcaccgtcaccaccaccggcctcgccgccgccgcctctgaccccatctcgatcgatcgatcgacctcttcctcctcgtgtgacgagacggcgagagacgacgggagctattgccccccacaaacttgggctttggttgctctcgccgcttttgggttttgtttatactcggcgtcaacaggagtggccgcctagtggagtactcctccactggagtgggggcgcagcatgcgcgtgcgtgcgtactcgctgacgccgctgtacttattattagcgtttggttaatacactactaagtcaaactttaccacggttaactacggcatcgttcgttcgggtagactggggagattgagtctcgttttccacgcgtacgctttttaaactactaaacagtacgttttttcaaaaaaaaattataggaaagttactttaaaaaaatcatattaatctatttttgaaatttaaaatagttaatactcaattaatcatgagctaatggctcacctcgttttgtgtatctttctaatctttttaatcctcttctcctcgaacacaccctacgtctatgtttttttaaactctactacgtctatacacgtctatattgttcccccgttttaggttataagaccattttaactttgattaaagtcaaactgtttaaattttaactaagtttatagaaaaaataataatatttataatactaaattagttttatcaaatcaataattgaatatattttcataataaatttgacttgagttaaaaacattactatttttctctacaaacttgatcaaagttaaagcaatttgtcaaaacatcttgtaacctgaaacggacggagtgtatactagtgttagataagttcgattaatttgaatagttattggttgaaactaaccacaattataacaaggtattgatctttcaatagtagatttgtagtttaaatcttacagaattttccatcaagggatatatttgttttgaatgaaataaaaaaagacaatatatcaaaaatcataaattaaaaaaacagttatatttaagtgcactgtaactgtaaattgggtcttcaggaacatgaatcttgatgtgcaagatcctatatatggatgaaaggtaaaaaagcaggagcccaaaaaatctattgtaagtgaaatagcaaaaccattacgacaatatagcctttttaacaagttagttttcacgcgtcaatgatttaaaaagtgtgctagtattttctttttcctgttaaggtatggctaataatttcattttaattaatatttttattaacaaatggtgaccatgtatggatgggaactaacagcccctatcccccaaagtccaacgcctgcgtgatgctaccgtactactacgggcctgtttggtaaagcttcaactcctaaatttagcttcaggagttgggtctggagtggagttgtggagctgccgaaacccatttccatctctctagttcattttgtgacagaattccacccagctccgctcccattttagatggagctgaaactgtttggctgaacaccaattgtagaagaggtggagctaggggtgggcattcggtctaaccgaaaagttcggttcggttcctcgatcttttggaaaatttggtcttccgaatcataagaccgaccggtgttcaagaaaactcaagaccgaacacttcggtcttcggttagttcggttcggttcggtcttggtcatagaccaaactaaccataacaacagtttaaacagcaaaaaaaattaatcacaaaaaaaatactccatacaagatcgatgaatcgaagcaactcggataaagaactacaatatgatgccactagagcatgattcagaaaaaagaagaagcaaatcaaaacaaatcgatcttgccatgacttggatcccgtcgatccacctgaagctctagatcccgttgatctcccatggtcgctttcatcctcgaccggcctcctcagccatctaggtctccggcgcagcagggtcatcggagggagcacgatttcttccgccatgacaggtgaaagggcggtgccgaggcggaggcgtcctggctggaggcggcgccgacacggtggaggttggaggcggagggtggaagcggtgcagtggaggcagaggccgagcggcggtgagcgcgaacgcgtggtggatggggaggaatgcagcgttgaggagggggtgaggggcgtgacgcgtgaggcaagcagtgagagatagggtaggattagggtttatgttactgggcttattgggcctcgtaggcatgtttggccacaattcgattatctcggttaatttggttaaccgagcccaatgaccgaaatacccgaaataaatttggtcttttgatggctgagaccaaactactaatcgaatttctcggcctcggtcttttcggttcgattcttcggttcggtctaattatgcccacctctaggtgaagctggagctgcgtcaaacagactctacatcacttgccctggtttagtttactctctccggtgactgctgcgtgttggtggcatgcagcgagcaatggccgcgtttattttagcaggggatgagcaatgtgggtggcatgcagagagcaagattggtgaggatgagacgcgagaggagcagcgacttctccggtgacgacgacaaccacgtgagggccgggctggccgcttgctagtcgccctaacatgtggtcgaggtgcgatattattgttactcctatactgtacggtctagcaccgatttattcgtcgtaatcaacagtcaacactcaacactatcagggtgctactaatgatttttccggaagtgtttacatatgtactcacgccgttccaaaatataagcatttttagcatagtgacaagtcaaacatttttaaatttgaccactaatagcaaaaaaaaatcaatcatgtaaattaatggtattagatttatcattaaacaaactatcataacatacaactctttttatttaaacaacttacttttatagatattgttggtcaaagtaacatctcagagactatatcagagtaaaaaatacttatattttgggacggagggagaatgttcctactatatcggttttacacttaactttactaatgcgttgtcgacagatttttcgtggccgtatcaataagattcttttactgttggatctgtgcttacgatgggatgtgggcttgggaaaagcagtttttattttactgttggatctgtgcggttgtgtgcatgggaaaaacagttggatatatgtgtgaaagtttcacagtgaaaccaaaatcgcatgcacagatagtggattgatcttgatcttgataccttataatcgaacaagcttgtttcttccactaaaagttacatgctctctccgtttcacaacgtaagtcattttagcatttttcatatttatagtgatattaatgaatttagacatatatatctatctagattcattaataccaatataaatatggaaaatgctaaaatgacttacatcgtgaaacagaggaaatacaccatagctaggttatgtagttattgcacacgacttatatatacttgaagttacatacgaaatacacttgagttacatttataattatatttaaattgtaatttaattataaaataattacataaagttacatttaaataattttagggataattttctatcaaaagttatatactccctctatcccatataagtatttttggaccctgacacggtttacgagatgctactttgatcaataatatttataaaagtaagatattttaaataaaaagagttgcatattatgatagtttatttaatgataaaactagtaacatcaattttacataattgatcttttctctattaatggttaaattaaaaatatttgatttgtcaccgtgctaaaaatgcttatattctaagatactcctatatgacttctatttatatatacatataaggacatcttgcacgacgtggctatacgtctacacatctccttatctccaagaaaccaatcccatgtcactatgcggcggtcatcgtcatcgatagctatggggaaacttttttaaacactcattggatttcacctgtttctcgtacgtcaactaattaaatagctatagaagttttttaaaaaataataaaataaattaatatataatatatcacttcacaaaagcatgatcgaattcaactttggaagtgttcggcaggccggctgcaacggctgtggctgcgcacggtgagttcgtgccgcagccgtagccccggcagccgaacataccatttacaagttataacaaaaataataaatttaactatgaatatatatatactagttaaagtttaatttataacttgtagaaggcaaatttaaatttacatatttgtaaagtgatatattatatattaatttacatgcttgtatatcttatacgtttgggaattggcttgtgggtgttaggaaaaagaatcaaaaaacttattcttgttgaagcttccgctgtatgttgggctctttggcttagtagaaatgacatggttttttataaaacaccatcaaaatcctatttgtaggtgcttttcagggcaacgtattggcttcggggatgagctcaattacaaaggcatgatgaagatatgaaactaataaatgataaatgtcgtaaactttgagacgacaattatgcatctatttgccaacttcggatggagattctctaatagaatttagtagttagggattgttttcttctattggtgtctattagtttgtgtttgcttagttttgtttctgctatcgtgaattttctgtgtgagttttgtaataattggatgtagctttttaagtaaataccaagatgttacatttcattattaaaaaaatattatatattaatttatcttattattttctttaaaaatatttataatcatttagtttgtatgtaagaaacggatagatattccccgagagaatactcccttcgtactcgtaaaggaagtcgtttaggacagcaacacggtctccaaaatataactttgaccttttgtttctataaaaatatttattaaaaagtgatatatgtatacttttaaaaagtatttttcaagacaaatctattcatataatttttatatttctcaaactcaacaatttgagagttattaataatttatatttctaaggtttgacttaaatattattttaaacgactttttttacgagtacggaggaatagaatcatatccctaactccctatctagggaggcacatgcatacggcggcgatcgagagcggtccaacgcccaccatatctgctccgccacccgccacgtctagctagccgccacacgtccagctcacgtatgagctgagtaaagcgtcgcgtcgcgtcgcgctcgccacggcacatgccccaggcccgatcatcgggcgcgcgcgacatggacggcgacgcgcgcgtcctcgttcgtgggagcaggaggaccgagcgaaaaagccaaggcaaagaagaaaaagaaagcgagcgccacaggaaagcaatccggagccgagcggtagctagcgtccggaagaagcgattcccatggtcctaactaaaccagctggtccgaaccgaaccagccctcagaaaatggtccctggagtttgaaaacctctgaccacaggtaaaattcggctaaatttcgtccaaaatgataaatttagtttgatttattttttgaacttagaccggttataagatcataataaaccatccggtaaacttatatagtctaactttacaaaaaccgagcagtttccatccgtgtaacacgtaccggtcctaatcatacataactttagtatctatagtaagagtaaggtcaataagggcatgcccaacgcaaaccatacccttgattgctatgtgggccaaagccacaaaaacgatctcatccccccaatggaagcaataccttcagatggaccattttcaaattaaagctgcacaacagattaattgaacaggagcttcatgctacacaacgcggtgccacagcctaaacctagcttcagagcggcgcctcgcgtgagggtgtgcagagcgatcagtgggttcgcacctcctcgcaggcgcgtggtcctcgccactttttggccccgcgtctgacgtgtgcgcctaggggtacgctccacgtactcgcgttgggcatgccctaagagagcctattgctagctcaaaaaaaaggccgtgtaatctatagtaagcagcgcagctaatatctacaatagaaatactttaacacacatattttattctgtttgtgggacccactatattctcctatctcatccctctttctccctcctacccctttccgttatgtattcttctcttcttttcttaaccgatgagggtaaacggtgatggctgtctgacggacgcaggtgacggcagtggctggggtggatgacgatggcagtccggtggacgcatgagatggcggcaacctggttggatgagggcggtcgggcgacaaaaaaggcacacaacggcggcccagcgtacgcgaacgatggtagcggcccgacaaacacgtgcgacatgggtgtccaccgcggatgagtgcaagggccgtggaggaaggcagcaacggcagcagccgctggagatgtggtcgacgccgcggcggacgagggcagtggccgtggaggatgtaggaggttgtggcccgacggacgaagggggtgaccatgagggaaggaggcgacgacagcggccgtgatggacaggggcggccatggcagcggcagcagacaagggcggccatgggaacggcggctgcggacgaggatggcgaactccagcgacgacaacaactagtcaaccacggcgagaaaggttacgggcttgtggtgatgagggtttgagcaaggtcgcgacatctgagtatgagtgggccccactatcttgggccacgtctagagccgagcgactaattagttgtccgttcattctgtctcatcccctctctcctccagctcattaaaaaacaatctgacgtggagtccttatcacacactattaattttactggatttttcacattttggtccttttaaaaaacttatttagcaaataaacccctgaaaaaacttatcctagaaataatcctttttggggcgccagagtggctggcgccgtccccctgtcgacgtggcggtgcgatgctgaggtggctagggggagcgcactagagtggctggcgcccccccacccccgaaattttttatttttgttttatttgtttgatatttttttcacgcttaaggacacacaagaacataccatagaaaaattgaactcaaatggacgtaatatgtgacctgtagaatttttcctctcctctcctctctctccgaactatgcataggagagagatgtgcaacttttttatttttattttatttttttgatatttttttcacacttaggaactcacaagaaccaaccatataaaaaataaactcaaacggacgaaatatgtggcttgtggaatttttcaaagctctaccgaaaaacttctctcctcgaaaacacaatcttgcaagcggaatttggaggttttaatatcgccgaacccagcaaagcgggggaaaattggatgtaactttttctgtaaatgtccgtggatatattattttcctgatttcgagtccgtatgagaaagttacgcctattttaataaatgacacccgaatgatttttcgatagagctttggaaaattctacaagtcacatattttgtctgtttgagtttattttttctatggttggttcttgtattctcctaagtgtgaaaataaaatatcaaaaaaataaaaataaaaaaaactgcatctctgtgtactgtttaacttatggctatcatttcatgtggttatattttgaattagagattaagtaatttcatatagtggtagagtgcattatgtttaacatgttgatcaaagggttttactaaagagttatggtctaattttgatgaaggtgcaaagtaggctaagtggtatgccatatttcgttcgagtttaaatttttttaaagtggctggttgtatcgtgatcctaagtgcgaaannnnnnnnnnnnnnnnnnnnnnnnnnnnnnnnnnnnnnnnnnnnnnnnnnnnnnn

SEQ ID NO: 22246 - DNA, 1541 bp, Oryza sativa
gcgccgtcccgttggacgacggcgccagccactctggcgccccaaaaaggaccatttctgggataagtttttctaggggtctatttgtgaaataagttttttaaaaagaccaaaatgtgaaaaatccagattaattttacctgctctaagaaaattctatctgacgtggagtccttatcacacactattaattttacctgctctaagaaagttctatcaagttgaaggaaaccatcatcaaactctacggatgtaggctatgtttagttcacgccaaaattggaagtttggttgaaattgaaacgatatgacggaaaagttagggtgtgtttagttggggaaaaggagatttttgagtgtcacatcggacgtttgaccagatatcggaaggggttttcggacacgaatgaaaaaactaatttcagaattcgcctggaaaccgcgagacgaatcttttgagactaattaagctgtcgttagcacatgtgggttactgtagcacttatggctaatcacagactaattaggcttaaaagattcgtctcgcgatttcccccataactgtgcaattagtttttctttttatctatatttaatgcttcatacatatgtccaaagattcgatgtgatgtttttgggaaaaaattttggggaactaaacaggcccttaggtggtgtttggatccagagacttaactttagtccctatatctagacactaatttagagtattaaatatagactatttacaaaactaattacataaatgaaagctaatttgcaagataaatattttaagcctaattaatctataattagagaatgtttactgtagcatcacatagactaatcatggattaattaggctcaatagattcgtctcgcgaattagttcaagattatggatgagttttattaatagcctacgtttaatatttataattagtatccaaacattcgatgtgatagagacttaaaagttttagtcacatctaaataggacgttagaagtttatgtgcaccgaaaaattttgatgtgatgaaaaagatagaagtttgaaaaaatattttgaaactaaacacgtggtaatctccaaatgatttttcactgccatgactggatcacactttacgatgccagcagagtgttgacgagaatgctccttgatgtcctggatgacgcacctccacgaagaccaagatgtatttaggaccagcagatttgacttgcggctttgttcgttgctacctgagtcgcctccttaattaagatggcgtgggggcttacccaaaaacggatcgcagaaaagtaccctatagtttgtttcattttcatacttatggattatcaagaaattttatatccaaatcccatatgtcatgtctaatatgtggccatcaatttattagcgatatactccctatttggctaggttgggtaagcatgtgtgagtgtgtgaggtgattggccattcaaacaggcttaaatcttcaagtctgaggtgattggtgatccataattcaacttggcgtaactcgtg

SEQ ID NO: 22247 - DNA, 3528 bp, Oryza sativa
  unsure (1)..(3528): unsure at all n locations
nnnnnnnnnnnnnnnnnnnnnnnnnnnnnnnnnnnnnnncattcgatgtgatagagacttaaaagttttagtcacatctaaataggacgttagaagtttatgtgcaccgaaaaattttgatgtgatgaaaaagatagaagtttgaaaaaatattttgaaactaaacacggtggtaatctccaaatgatttttcactgccatgactggatcacactttacgatgccagcagagtgttgacgagaatgctccttgatgtcctggatgacgcacctccacgaagaccaagatgtatttaggaccagcagatttgacttgcggctttgttcgttgctacctgagtcgcctccttaattaagatggcgtgggggcttacccaaaaacggatcgcagaaaagtaccctatagtttgtttcattttcatacttatggattatcaagaaattttatatccaaatcccatatgtcatgtctaatatgtggccatcaatttattagcgatatactccgtatttggctaggttgggtaagcatgtgtgagtgtgtgaggtgattggccatccaaacaggctcaactctccaagtctgaggtgattggtgatcgataattcaactgggcgtaactcgtgacagttactactgtactatatttttgctatcttaattacaccaattgaagtgccgccagctagattaaggagacttcttggttcttaccactttattaaaaagctaacaatttagagagccatagtagtatttaacagtgctttatggcagtaattgatgccaatctaattagagtaagtttaatagcacagccaactactggctctaaatcatctatagctaatctaataatccattcatacaataattaactataaaaatatactacacaattaatacccgatcccacatctcatacacacgtaacgtcttatagtacgtgttacagttaggtataaatttgtagcccgctttttttctctcttctattttcttatcgatacgtggttatagttggtttatataatgctattgtactgcaattgtacctgctgttaggatgagttgtcgagtttttcaaagcaatcatgtttaaagtgaaagcaatcgtgttattcgtttctggaagcacgatggcgttgcaggatcgaatttgactttggagcccgggaccgatcgagagagttgatgaaccagaataccttgccagttgctgcccgaatagagacaagttggaccaacgacccatcccgatcagattgtcaagctcgatatctttgtctaattggattgatttccattatcgaagagaaacaaatttaaaggctttgtctaattgatataagtacatccgacctgagtaactttattatattatattgatgatattgaccccagcaatagccaatcatgtaagttctgaaaatctagctagctcgtttgaattggagtagatcacagtgcaaacaataaaatatgtttgctagttatttctaccgataactacgacaagataaaatatatttttttcgtgaacgctacgacaagataaaatacatggacacgaaaccctcaacgttgggctgtttcttcaaatgagataagattgctggcccatacacgtggtggatgaatatggaccggcaaatcttatttcaactggtagcagcagaaaaggcctattactgtggatgagtcatcaggcaaaggtagtaacattaccatgcataatcgcatatgattttcatacatatactggttttttttcaaaaagaaaaatacttttcttcttcatgcatcaacaaacgagccagcagtccctaaagtttctctgtaggattagtttagtccctaaccttttaaatggtccaaaaaaatccttaacatttgtcataagacctagaatagtccttgggtccactaaaatcatcatatggatatgttatgtcatcattcatgcaaaatctatgatgaattgtccaatttacctttacgtatatcatagaaaaataaatataagggtgaattagacataaccatatgaaaaaatatacttcttttttcacccttttaaggtatatttttgctcttatatataccatatatattttttaaatttttccttttgttttttattttctatcatatagattttgcataggaaggtgacatggcatgtctatgtgacgattttagtggaaccagagactatattagcccacatgacaaatttaaaggacttgtttggataatatgaaagattaaggactaaaataacccaggagcgaaactttagagaccatattagctattctcccttaatgttgcaagcgaagccaatgaaccatcatcatctatctctaggctttggcagtaaagctctcgagatacctctcgacgacgtcgaggccgcagagctccttgacggccggcatcgtcgccggcacgtccatctggaaagtcatcgccgagccgccggcgccggcgaactccttcctggccgccctgattgatcgcctccctcatcgcgcagtgcaccgacgacgccagcagcggcggcggcttcaccggacgctgccaagatggatcgcaaaacagtttcagatttcgagttcctttacgatttcattgctcatgcgtttgagaaaaaggatcaaaggaagaagacgatgatttcacctttggaggagaggacgcgcttgtgaacgcgggcgctgttgatgagctcgacgttgaactgcttggggatggtgtccacggtggggatcttgtacgtccacgtgctgtcgtggatgaccagcccatcggagttggtcgcgtactcctcgttcgtgaagaagccgatcccttgcacgaatgcgccttccacctaaccaagatcaacaacattcagtttatacatatttagtattacctgtccaacaaaaaaatatttagtatttacattcacttttgcaatgatatgcaatattgggaaaaatcccctcatttttgtatgccatttaaattatcatcaaaaagtttaaaataaattaacataatatatcattattaggtatgtcattccataaagatgcaaagtttcaaatggacttacacaaatagaaacaaaaataacatattcgactacgaatattgaatttgaacatgcattttttgtgaaataatacatcacatatggttcaatcttgtcaattatctatctattatattattaagacagctttgagaggagacactacgttcgctgtgggggctagaaattcccatgttaatcaaagaaaaaaaaatctacaccattagattgtgatgggtccaaattatgacgattgagatttaatacaaatctatataaaagttttgatttggaaccctttacaattcaaaatatgatacaagcacgtgttcgtgttggcaggaaacagtcatggtacattagttttcctttcctaattaactaaagnnnnnnnnnnnnnnnnnnnnnnnnnnnnnnnnnnnnnnnnnnnnnnnnnnnnnnnnnn

SEQ ID NO: 22248 - DNA, 8732 bp, Oryza sativa
caaaaaaatatttagtatttacattcactttgccaaatatatgcaatattgggaaaaatcccctcatttttgtatgccatttaaattatcatcaaaaagtttaaaataaattaacataatatatcattattaggtatgtcatcccataaagatgcaaagtttcaaatggacttacacaaatagaaacaaaaataacatattcgactacgaatattgaatttgaacatgcattttttgtgaaataatacatcacatatggttcaatcttgtcaattatctatctattatattattaagacagctttgagaggagacactacgttcgctgtgggggctagaaattcccatgttaatcaaagaaaaaaaaatctacaccattagattgtgatgggtccaaattatgacgattgagatttaatacaaatctatataaaagttttgatttggaaccctttacaattcaaaatatgatacaagcacgtgttcgtgttggcaggaaacagtcatggtacattagttttcctttcctaattaactaaagcatgaaaaggaacaacaatatataggaaaaagaacaacaataggtaggcaaaattttgaatagttccgattcccatcgtgacttgactcccatggttatgtccgattcccagtttcccattgttactgtgtatgacccaacaaaatactaggcaacaataaaataatcaccccttctagcattgcaatcggtaaaacagaatgggcttgactgtaggaaaatattatatgtaggctcagcatttttttgtaggatataggctgaattcgtcctaatcacctagcttcaagatgaacatcgatcaaaatgagcggcccacaaccagcgtgccgccaccacatcagtaccgatattatacaaagaaatcctccacaaaactcagctaaaatataaccaaatttaagagcatcgaagatacagagaatattgaaaaaatatgtcacttccaatacatattaaaattatggacttaagacttaaattttaggcccatacaccgaattgagtgcatttgaaataaaaaataaaataaattccgataattgaaaataattataagagttcgagtagaaacaaaatatataaataactaaaatataagaatgaagtatatggattttttttaaaaaaatagttcatctacaacacaacggtgacaaatgagaataaaaagggaagagacaacaagcccaatgaaccccaaatagaatcccaatgatgattagaggagggacgacaagcgtgccattaagcagcatggtgacacggtcatggtggttggcgggacttttagaaatttaaaaaataaattccaatgataattttgtacggttttaaaaatcccaattccaataaagaggggaggcagcgggtggggtgtaaaggagtacagtgatgccgtttgacgggacttttggaaattataaaaacgaaacccaacgagacaattaactctaaaaaatataagatccagattttaaaagttctcaggaggataaatagaagccatggtaaatctatatggagtaacgattgatatgacttttaaaaactataaaattataaacccatggatgataaaggtcggcctttcaaaaccctaaaacaacgagaaaactacttaacaaattttaagtaaaatcatgtatagaaaaaattttatatggatgctagccgtgcaattatgtgggtcaccacgttcgctgtggggctagaaattcccacattaatcagagaaaaagaaaaaaagagtccaactagaaatacagtttaaaaataactgtaatttggaaataaaaataggcaagagtccttataagaacccaatacgagattaattaatattcggtataaaaaataaaaaaatctgaaattagcaaaaaaggaaaagaagagttcgactagaaatacaatttaaaaattactaaaattcggaattaaaattaagcaatattgaaagaacggtccatataaaaacccaatacgagattgttaaaattcggaataaaaaaaataaaaaacacgaaagtagaaaaagaaaagaaaagaaaagttcaagttggaatacaatttaaaattaaccaaaattcggaattaaatataagcaatattgaaataagagtacacataagaacccaattcaaaattaattaaaattcgaaataaaaataaaataaaatccgaaattagacaaattaaaaaaatttcaagtaggaatacaattttgaaacaactaaaattgaaaataaaaaataataatattaaaagaacacaatacgatattaattaaaattcaaaacaaaaataaaataaattctgaaattagaaaaagaaaactaagatttcaacaaggaatacaatttataaataactaaaattggtgataaaatataaaactaccgaaagaaaagaccatctaaaacacatgatgagattaattaagtaacatgcctataaatgattagagtagtggtggttgataggaaatttaaaaactattaataaaacaccaaatagaatcctaatggcgattaaaaggagtgacgacgggcaggccgtgaagtaaccgggcaaggtggtcggcaggactttcataaagtaaaaacataaacctcgatgataatcatattcgattttttaaaatctcagtgaatataaaaagaagaggcagccggcgggtcgtaaaggagtacagtgacagtgccgccgacagttggcgggacttctagaaagtaaataatgaattccaacgatagttatgttcgatttttagaaacccaatgaaaataaaaagtaggcagcggaagggctgtagagtagtatagtagcagcgtttgacgggatttctacaaattatatatatatataaaagaaacccaatgagacaataacctttaaaaactaccaggtccattttttaaaggttcaggacttctaatagtaaaaaaacccaatgataattatgttcgattttaaaatctcaatgacaataaactagggaggcgatgggccaacgtataggagtacagtggcaaagctgctaatggtttggcaggacttacagaaagtaaaaaatgaacccagaaagataattatatttgtttttaaaatcccaatgacaataaagagaagaggtagtggacgggccgtagaggagtataatggcagcgtttgacgcgacttctagaaattataaaaacgaaacccaataaactctaaaaactatacaatccaatttgtaaaggttctaaggaaaataaatagaaacagtggtagatcgagtaggcaaataaaaagaagaaaatgacataagtaagtggtagcaactggtgtgactgttaacaagaacttaagacaatgagatatctatttaataaattttaagtaaaatcatattaaaaaaatatataattttattatgggtgctagccgcgcaattgcgcgggccacccagctagttaataccatatccagtaaaaaacgataataaaacccgaatccctcaacgctggaccatttcttcaaatgaaaaaggaaaaagtatactttgactccctcaactatgacccgagtatgattcataacctccaaccacaaaaccaggtatatcgactcctccaactatcaaaactggtgcaaaccatatccatgagtggttttggaagcggttttagctgacgtggcgcctacgtgacagtgttgacccggtcttcgtcacacgtgtcgttaacgtgtcgcttacgtggcattttagagtaaaaacaaaagaacaaaaatacgtgggactgacatgtcatttacacagaaaaatagtgggacccaccgacatgtgggcgccacaagtcatctcgtgtgccgacaggacaagccaacggagacggaaggccagcgaaggccatcggtgccccggtggccaataagagatgacttattgcctcgaccgccagcgaaggccatcgatatacccggtttcgtggttggagaatataaatcatactcggccaatagttgagggagtcaaagtatactttttccaatgaaaaaatgattgccggcccaaagcccacgccaactggcagcagtaggcccatcaccttggaaaagccgggagatagatgggctgggcttcactcgatcaaccgaaaactactgtgattttcgtctcaaaaaacaaggaaaaaaacttggtggattcttgcatgaactcgtcaaaatcccaagccaagccaactccgtcgtcgcggcgtcgctcacatcgatggcaccgcaagccgcgcgtcttttctcaatcacaacctgagccagtgatgctatatatatgtagacatgaacacgatcgatcgaacagcgtggtttgttcactgattctcagtgaagcatcgatccccaagctgatccgttgcggccaatggcttctcgtaggatcacgctcgagttggcggccgtcgtggtcgtcgtcgccgccgccgtggccggttcactcccggcgacgaccgcgtcggcgacggcgtaccgggtcggcgacgactccggctgggacaacggcgtcgactacgacgcttgggctcacggcaagaggttcaaggtcggcgacacgctaggtaataatcaaattgagcatcagtttctcctaaatttctagctcaaataattcaggcagacatatgtacgagctcatcaatggcgtgatcgatgtgagatgtagagttcttgtacgcggagggcgcgcacaacgtggtggtggtggaggacgaggggagcttcgaggcgtgcgtggcgccggcgaacgcgccgacgctgagctccggcgacgacacggtggcgctgaaccaggcagggcggtggctcttcatctgcagcttcgacggacactgccagtccggcatgaagctcgccgtcgccgtcacccactagctggtgttggtgtcatactctcagtcacgtcagaatggctagctcactctcaaataaaaagcaaccatgcatgaatgatgaatcaggctcgggaaacacttttaatcacctaggtggagatccacccatttattatatgtcaactaaatgggtatgaaaaaattcaaaaaatttgacaagatagattcatatgcaatatatcactccacaaacatgcaagttcaaattcgacttttacaagtctctactactttaaaaaataagaagtacttccatcgtccgtaaaaaaaccgtgcgaaaaaaccggacgaaaaaaagagtccgatccaaaaaaaaagagaaaaaaaccgggagaaaaaaaaagtagagtccgattccctacatccctataaaaaggaaaaaaaactttccgtacaaaaacaatccgattcctgtattgtactcccgtaaataaaaatcctgagtccgagatccgcacagctcctctccgtttcaatatataccatgataaaaatacatcttggtggaaaaaaaattcatgtgccgaattgaagatctgtttacgaaaacggaacctacaggacgagagcattccgtttttgtatgattttattttttgggtttgcacttgagtccctgtaattttttatttatatttgagtccctgtaatcttgcaataaggtatttgaggttatttttttattaaacaaaataaaaaaaggtgagaacaaaagaagaaaagtacataaaaagaaaaagaaaagccgcacctaaaaaaatctctactattataaaaaataaaaattgaagatgtttccttggtatgttattcgtatttgagtcggttttaattttatgttttagatttaacctatatatacctaataaataaataataaatcggtatccctatctctatcactgctcttctctatctttatctctatctctactacttaaaaaataagtgcttccatcgtccgtcaaaaaaaccgagcgaaaaaatcgggcgaaataaagaggcagatccaaaaaaaggagaaaaaaacgtcctatccgaaaaaacggagcgaaaaaaaacaaaaaaaacctggcgaaaaaaaccgagggaaaaaaaccgggcgaaaaaaagagtccgatcaaataacggagaaaaaaaccgggaggaaaaaaaggtccgatcaaacaaacggagcgaaaaaatggaaaaaaaacaaatttgtccgatccaaaaaatacgaggcaaaaaacagaaaaaaacgaaacgaatcggtaaaaaaagggcgaaaaaaatttaaaaaactgtccgattccaaataaaaagaaattatatgtgacacggtaaaaaaatcgaccagaccgaaaaaataaaaaaattccaatcaaaaaaaggggcggagaaaaaacaaacatgtacgatcaaaaaaagccaaaaaaaaaggaaaaaaatcgaaacgaatccgactccatcgactcggtaaaaaaaagggtgaaaaaaatatataaaaaaagtccgattcaaaataaaaagaaactatatgtgacgcggtaaaaaaaatggaatcctatttatatctagaaaggttcgacactataagaaagtggtgaaaaaaacctttcggtaaaaaaatgcactaaaaaataaaaagggcggaaaaagtctaatttatattcgtcgttttagtagtctgtttatatctcttctttatctctaatctaatctaatctaactatttaaatagagaagtttctaccgtatattaaaaaagaaataaatgcgtgagaaaataaaaacggtttaaaaaatgcgtgaggaaaaaatgtcagaaaaaagcataaaagaaaacgcgctagaaaaaagttccatagtccgtaaaaaaacacacgagaaaaaaatatttccatcgtctataaaaaagaaaaaagaagcatacgtggaaaaaaactattagaaaaaagcgctaaattgatagacacgtggtcggataggatccatcgacttttttccatctcctacacggcttttgtttcgtcatctattctcctgtattggagaccctgcacatcttcgtaggcaattatcatactatttttgtgaagtatagctactattcttgataatatattatatgaaataatcttagaaaataaacatattttaattgttatatagagaagagtggacagggactctattttgtgtagacttgaccatacgaggcaatgtaggatttgattggttgcaagaataagattaaaagaatattttagattatatgcatgttgtcatatgaataatccaattattttaggtaaagcaaacatcgtaaggttgccatcatcgaggttgggctattacatttaagatgttccaattttctgattgtcatcgacatggttatgcatgaaaaacgtatattatcgttacgtttttttcacccgttgcaacgcacgggcatgtttgctagttgtatcaaaaataacaaatcaaactctgattagtataggtatattcacaattaaatttgttatttttgttacaacttataaaagttgaattttaagttgcatgtttgtatagtgatatattatatatcaatctatcttgtaaattgttttaaaatttttttatgatcatttagttgacatgcacttaataagtggacatccgctcaagtgtttagaatccaccttcatcaggctcgtatagtcttgttcagtttcaggccttcatgaaaagttcagaaatgcgcagttcaagcagcatctagcagaatttatagagtgaaagagcataaaggcattggttgtaaccgctcaagtacgtactgtactttggtcatagatatttggcgttttgtactctcgttgactaaaaaagatatttggcgttttaattaataatccttggcagcgctcctttggaacaaaagaatgttgatttgagatttctacactactatggaatgactccattcaggggattttttgtggagttctaagattaggttagatctcatggaaaacaagcatctatccgaacaaacggtttcaataatttgccgcattttagaattcctaaggatttaactgtacatatcaccttaatttctacgttttttatgtctctatgtgttttttttcctacgttgcccatgagccaaagcccacaacaagatttttcacacaaatcagttcaatttcaacgaaaatcctttgaaattcaaaagttccaaacaaggcacactaccatgggacaatctacatacacagacaatctcaagatatattggctcagtctttcgaatatgctcataagggtaatgtgtgcatgtgtatttataagggtgagtacgtgcgcattatgagcacctggacgtctgcatttgtactatgttttaaaaaaagataagaacgacaaacttttattttcaaatctgagcaagaaaagatggtaggacaccccagatcatcagtattataagcagacaatgagacgaatagtggtagtttcgttaaccgaatgaaattaatcatcaacaacacgagaaataaaaacaacgaaatcgcatctaacatgcacgcacagtataacacaccaacgacacgaagaaaaaataacactacgaaaatgcactcactgatgactgacacgatcaaattaaagtgctcgactatgggtactagaaaatgttgaagctagagcgcgagcatggccgcggccgccgcggtcaccgccgccgccgccgccgcgtgcgcgacgcgcgcgcgcgcctt

SEQ ID NO: 22249 - DNA, 817 bp, Oryza sativa
  unsure (1)..(817): unsure at all n locations
tctcaaacgcagatgcaagaaaatcaatgtttgattggccaacaaggtttaagacaataaagggagtagccaaagaacttttttatctccaccaagattcaagattaacagtagttcacagggatctcaaagctagcaacaaattgctggatgctgacatgagccccaaggtatcagattttggcatggcaatgatttttggtagtgcccaacaacaagcaaatactaaccgattagttggaacatagtgagtaatttcatacgtaaattgtacttaagtttaataatcttcactgaaaactaaatcaattgtgtttctttctgggaaatgattcatcaaacagtggttacatgtcacctgaatatgcattggaaggcacttgttcggtgaagtcatatattagcttcggtgtgttacttttgaaaattgtttctggcttaaagatcagccatccacaccgaatcacagactttctcaatctcatagctttcgtaagttctgcaaaatgttcaaagtctcaaaatttattttaacttttgtgcaattaggctttgtttggcaaatgggattgggaaataatatctcaccctctaaagggcaatattgcatcctaaccatccattcttcacacctcatttaatcctagccattcatccatttccattttctaatcccacctcccatatcccatttgccaaacacaccgtaaagaattatatccttttttttatttattcaggcatggagttcatggannnnnnnnnnnnnnnnnnnnnnnnnnnnnnnnnnnnnnnnnnnnnnnnnnnnnnnnnnnnn

SEQ ID NO: 22250 - DNA, 282 bp, Oryza sativa
tccagaaaatctgggccattcatttgggccacgtcagctagcggcgtggggagaaaaccgcgggcaggtttgagctttggcccgccgtttcgccggcgtaaccagcggcgccgcccaccgcaccgcgccgctacaagtacggcaaccgcggccccttcctctcccttcacttcaccgagaaatgcgaagagcttagcggcggcggcgatgagcgtgaggttggcgggtcgcgtgggcggcgctcgggtggctccatcgccggcgccggcgccggcagggaaa

SEQ ID NO: 22251 - DNA, 1374 bp, Oryza sativa
aggcatctaagcttttgttgggcaagtattcataaatcaatattttttcttctccgcgagtacagcaaccaagaagcttaactaggtttctgtgtggcaacttggcaattagaatcacttcattctgaactcctctaatacttggccagaactcttgcttagccttttcactgcaatctcagtaccaccttacaatgttgcctgccaaggtgcatatcatttaaacaaataaaatgggcataagttaatagagcacgtatatcctacaaactatctaccaatataagaattatcattaccttgtaaaaattgccaaaaccttctcgcccgagaatattggaatcagcacaatattggggtgcaacagaaatttctctaaagcttataacagggaaattctaccttttttttgccccaagtaccttctgaaacactcaaagctctttgcatttgtctttttgaaatctcctagttttcttgttgcccgataagaataggttgcaatgcttaaaaaaaacttgtgaattcaccaggacaacatgagtacatgactgttaaaaagtgaagtggctaatgcaactgcagttagacaacatggagagaaaaaaaaaggataagcggatcagaatataactaaaaactccgcttcacctttgcagttgcagatccatacaagccatagacataagagcatcagcaagcttgacacaacaggcagtactatttccattatcctccatttgctctttccgaaattaattcctggtgagaatcaggatttcaaaatatttttttaaaaggatttcaaaatatctactatgagaaaatttaaacatcaagaatttttatttattaacataataaacatttaccatgaaaaatatattattccaatttccatcctctggcaattgcttgtgggggttcgaattaaagtcaagaggacacaaatgttaattaataagtaatatccacatagtttcttttgtatgtcttcatgagaacagaccttggtttcagaataaacaacttgatcatgcctttttttctctcttcctgcagccatttagtgatatgcccgaagtgaccaacatcaaggtagaggagaacatccaatacaaatttcacacaccaactacattttatcctacctacaactggactggcaagccggagatataaattctcaccattttcaccaagctttgctgtgtcaataagctctcccatccatagcaagcactggggtggaagtaaacttgttgaattggtgtaagcataagctgtgcacgaacagttcctactgcataacactgtgcactcctcaaagcttataccactgatgtacacgaacttatctggcaatttcatgcc

SEQ ID NO: 22252 - DNA, 1600 bp, Oryza sativa
  unsure (1)..(1600): unsure at all n locations
nnnnnnnnnnnnnnnnnnnnnnnnnnnnnnnnnnnnnnnnnnnnnnnnnnnnnnnnnnnnnnnnnnntcttgtatacttttgctgaattaaacatcgcagggaaagaagaatccttgtactgaccaagagtcagtaaaatcattccttgggctagtgaggcatgcaaaagagatgaaaattgataggtaatgccataaagatatcactttactttaagctttgacttttgccttgatcctgctcataagggttaagcggctgattaacttatttaatatttgccataaacccccaaacttgcaatcaatcaatactgaactcttttaatgaaccttaagtagttgaataattacctcttcaaatctgtttgtccttcctcccagtctaaaacatgatttcccttttatacctcattcaaacacaacagaagactacaatgtaatgtgcacatgaatgtttcagctggcatatcatgttgaggatgcgagctacaaaagaaggtccatgtgatccaatcgcccccttagagttgcctcattcattacatgcatttcaccgtgtgtcaagtagtgattccctcaatatggtaagacaatctgtccagtttttctaagttactatgtttcttgttgacgaaaattgttatatgtcaagacccaagtggcattgaatttaattcatttcctcaattggtctttttttttccccttcaggaaggttaccacacattccgtggaggattttggaattactttagtatgggtaaggctttgtctgttcatggccacttccagttatggaccctaaacagtctgatggtttggtttctagtttaccgtggaacttgatgttgcatgctagtttgtgctatgaagatgcaggcacctgctggttccatgtacggcaagtactgtgggactcatgatcactactgtcgtagtttattatatttggaaaaaagatcccaagtttcttcaagaacctagagcatatattgattcaatgactcagaaattcaaattttcatacgtgatgatctttgcaggtatggatgcagaaatttcttacggatttcattctgaaaggaagaaaaatccagagaaattcaaaaaccagctgacaaatcaggtatattatattcttattattgtgcattgtgatgatttcttttgtactgtttcgctgtgctgcagattctgaattactcgtaagtttaaaattgttccaactgaactgcctctttatttggcaggcagagacttgagacgtacaattgaccttatttagattctctatgtgctcaacacccatttcttatgtcttcctgtgggatcttactatacagaacttttatgagctatgagaagtgaggaagtgtcgaatgggaccaatacccattgcatgttactggaattcttaactgtagttgttacaaaatattgcacttacatctctagttctgtcaaattgattcctaaatatgtaatccttgatagctaatatacctgtaaatatgtgaaatttacttctatattgatttagataaatgtccctctagtcaatttcaatctggctgaatgacttaactttgccaggtgt

SEQ ID NO: 22253 - DNA, 3204 bp, Oryza sativa
  unsure (1)..(3204): unsure at all n locations
attctctatgtgctcaacacccatttcttatgtcttcctgtgggatcttactatacagaacttttatgagctatgagaagtgaggaagtgtcgaatgggaccaatacccattgcatgttactggaattcttaactgtagttgttacaaaatattgcacttacatctctagttctgtcaaattgattcctaaatatgtaatccttgatagctaatatacctgtaaatatgtgaaatttacttctatattgatttagataaatgtccctctagtcaatttcaatctggctgaatgacttaactttgccaggtgttaatccatttaatctatacagggtacatatgctaaggttggacttaaacaaggatggttttgtgcttctttaagtcatccatcttcaaggtagcttgttgatttatcattaacatatttcatggtatacctgttgtgctagttgtatacttgtattgtgttatctttgcagtcaaggtgtctctaatttaatattataccacctaactcctataaatatctgtgagtaatgtggagagagaagttatagggagtatacccactccagcatttttgggggtgttcaaatgtacattgcatttacaaactacaccaatcaattcatttgtgcccttttttgttccttcatattagcaccatccttgcagtttatagattcagtccacaaaatttattgtcaaagcttaaacctgtacttggcaatgttaaatttgaaatttggtgtaatcaatttgtgtgcgttcaagttgtttccttcttttcgttttggttgtaaggttgagtgcttcatttccaggaatattgctcaacttgcaagtgtgaaaatcatgaaaagagccggtagccactggcaagaacttaacattcaccacaggtaaacattgttcattccttttgttgtactatgaattattttttcccccgtgtactgttatttgagcctactagtatgatatgatacaagaaagcttctcatttgcacttggaatattttgcttatactgtttcttttttgggatacgcaaaaggcttgcgtatcttttctattaagattggaagcagtatacattactttgaaagctgtaaaaagaactgaatcgaaaagaaaagaaaacagaagagaagaaaaactcggatatactgtttcagttttgcttccttgcaagttacaatatgttccttggatttcttgcttgcacatgttggcaacatttctgatttatgttctgcttgttgatggaggatgctaccataatctatgagcaaagttgtgacctgtgtactactgcctcttgcagcattcgatcaatcgtctgtctcaacctgcctagtttctctggaggtctgaatccttggggcacacctggcacaaggaaagtagaagaggtgagtttacatgcactacgcttgtcattcaacacgtgaatttcgcattgtagctattcacagattatttactggaaatcttcagaggaactaataatcaaacctctgtcttgaaaaaacaaaatctacagagggagctgacggcaccttttgtcgatgatagacttattgaggttgttggattccgtgatgcctggcacggacttgtcttgctggccccaaatggacatggtacccgccttgcgcaggtatgaagtatatgtaaaagtgcttccattttgtccatttgacatcccagaactgaaaaccacttctttcccattgtgccgtagtcataattttctacgtcaagaactagaactagtatagtcctctccattcaagcttatgtggacatccttcaaaatcaggcccaaaggatccgtttcgagttccacaaaggcgcagcagagcacaccttcatgaggatcgatggggagccatggaagcagcccctcccaaaagatgacgacaccgttgttgtggagatctcccaccttggtcaggtcaccatgcttgccaacgagccctgcaagtcgaagagcgtccatgacgaccaatcctcccacgcacaacacagcggccatggcaacaacgacgacgacaaggacagcatggaggacgaagatgagtgggaggatggcaggaggaagtttggtgccgcaaatacattcaagatccctgacgaggttgacattgctcacctcagctgaactcagaattggtatcttttctaggttgcattcttgatgttcataatcttcttcagtaaagtgatttttgtcttcgattccttcaacattataagagtggaatttagtaattcgttcactgcaaaatttggaatgtatagaccataggtttggaacatctatagtagaacccaagttggtaacatttctgatttcttgtttattgttcagcagaaatttgtgttattttgggaagaaaataaagttattaaactgttgatatttatttttctagattgtatatttgtgtaccatttgaaatgtgttcaaattcaaatgtggtgagaagataatgactcatgcttatgtttatatccccccccccccggttccaatgtataaggcctatatttttttacacgatattcagtaacatactttgacaatccatttatttcatgttatgtttttaacaaatatgaagttactatcacatgaaagtacattgaaatgtgaatttagtgatataacacgcataatacttagcatatatatggtttatattattattagtaaaaaaattactgagtttaattttccataaaaagatgacgccctataatttgggatggagggagtaagttataagccaaaatttaaattttagaactcaattttgaattttgttttttgttttttcattgtagtttattttacactatctgcttttaattgctaataacatatataaagaaactttactcagaaatgattttttttatttgatattaagcgattcgaatattaatcatacgagtaagagaaacaagaatttttttgggaaatattattattttaatgaaaaatcgcaaaaatggtggtcatcgaagatttttcactaaaataggggcctgtcgaactgcggtagtttttattgttctttgctagttgtagtttttatttgtttcttaaaatatttggattaatgaggtannnnnnnnnnnnnnnnnnnnnnnnnnnnnnnnnnnnnnnnnnnnnnnnnnnnnnnnnnnnnn

SEQ ID NO: 22254 - DNA, 2385 bp, Oryza sativa
ttcttaaagtgggtatgcccaaaatataaatataaaacttttcttcactttgatctaacaatataagggcagttaatggtcaaatttcacatggagaagttaaaattgtcagttattaagaatctgagtgagtaatgaactataagaaatcgcctgatatgatgcatgcatcctggaaacttgttgcatgttggctttcttaattagttcccagccacatggttggaataaccatgaccctttttttaatcaatgattcagactcctggattggattaattgagtggataaggagcaaagttgtgggagactggcaggcctgtatgtagctatgataaaaccagtggctgcaggccatggtttccaggataccaggggcaatttgttggttgcatgattaatgcgcgtccgtttctaacacaaacggtttaattaccttcaattgctgttctttacagattgtttggctttgtttgcatccagagaagtcattgtggtggttacaaatatgcttcaacattttccacattgtctttgccaaatttgtgtatttgccgtctgcttgactgcaaaagctgaccagaagaatgcaggccatccacaatcaggttaatgaaaactgtatctctgtaattaaacatgactagaaacatatttcagaactattttttctataaaagatcagcttctaattccgagtaaagatgttcatcgatgttacaaaatgtttttaagagtggcaaagagaaaaatgccaaaaagatttcaaccaatgcacaacaagtttgattctacatttgagttttcaagcacgctgtgctacgccgagaggccgtgcttccttccttccaagcattttacagtatactacttcgtttaacaaggcacacaagctaccttggcttctttgaagaacagctatgctcacatatctgcgacagaccaaaggtaggcctcttgctccgttgcttgcttctcgttcttcagcttaaacatatccttctcaaatcctgtgaaatcacgggaatgctttgtaagtgataagagaccagactacaagatgcaaaacaaacttctaatggacacaatctgatgcctgaaccactaatattggccagaaagttgcacaagttgtccaaattcatgtatagtaccaatctaccagagaacatagtgaaactgcgaggacatgatggaccaagaaaagagaacgtgaacatgtttcaagtttctattcccttgcacagccttcccccctattataaaaccaggtccacccaatcgtttgcagacacaaccctctggttttgaatattagggtagagaaaaatatatcttgcttgaaattggataatggacattctgctgggtctattcaataagataaaaaaagagaccgtaacaaacagcttcactgttaatccgcattatttcaacagttttttatcaggttgtcactgcagttgttgacttatccattgtgtgatactccctccattccaaattgatctacatatagtttttttttagattattcctaattgatcatcatatttgtgttcattcattaaatctattcgttatttgtgcattggagtaaatggacattgatgcatgcatctatgcacataagtatttataacccacatgcaatatcttgatttactattggctaggaaatagtggggatggtacatgcatcgagtttgttgctagagtaaatatagtatgagtgagttattagtttttcttggtcttggtgtacctatgaaatatgtagatcaatttggaatggagggagtaaacggtaagctaatctttttgtcattccaagcaacatgatgttaaataacaagaaaagaaaattgggaatgaatttggaaagcacataccattgctgcgatccactccgtcccaatgacgaccaggctttatgccgtagcggtttggaggaggatctacaccacgcttcagccagctgtgactaggtatattttggggaacaatgaagccagattctttcatcttttcatcatctcccaagtcctccagaaggaggtctgtatcattcctctgcaacatatgtacacataaatcagcaattagccaggtgaaggtgttcaagggttcaactgaaccactcaaaatcaaaagtggcagctaccttgacaagatgagccataggatcaccccaccggattctgttttttagcatggtgtcgagctcaggatcatccctacatgcaaaacaagttcaaattataaatatttgcaatgaatgtttccacaccttcacagttgacaaagaaataaacatatttaataaacacacacacacacacacacacacacacacagagatacagtgaggagagggagggggat

SEQ ID NO: 22255 - DNA, 1577 bp, Oryza sativa
  unsure (1)..(1577): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttgttccagaggttcgtgacactgtccagatttgtaaattacatcaagcacaaatatgttagtcgctataagtttgtaaataatgcttatgcaacataataaatacaatgtccctattttattctaagttgtctagaaagatctgaaatcttaaattgtctcgtaagtgaaaaagtggttgcatgtaagagaatataaagaaggaacaatgttagaaaattgatttcgctgacctgttctttttctgcattgattccagccagctttgtttccccaatcccaattgactcctctgcttgcttctctttacgcatttcaccactggtagctcgtaaagtctcagctgaacaccaaaacttcatgatactcttggctaggattctagcaattgatttctgtttcctttgaatgtttgcttcctcaaatgttgctcgaccacttaaggcaatccagtggcacatctgggaagctgctgcacttttccacaggcgctcctttaaatagaaaacgtgatgttacataatatctttgaatatgtaaatacagtaaaagaaatgttacacgacaagataaaaaacttgcagcctgcatgagaacaagaattgattattaagatcactttagagaatacctgcataaattcatttgccatccaagccatctcctccaggacaaattcccagtgactctttggcttcttctccaaagaaatattgcagagagatcgttcaccagctttcttgatattgacctgagaagtatttattaactttcttctcagaaaagcagtatcagaaaagtatatattctaagtgtacctctattaatcgtgcccttctaaggatagtatcttcatgttccttcttggcaacagtagaatcttcgcattccttcttttccatcattggaatattttcaccagttttattaacatcattgtcagggttcattaatgacacagaactaggcacgttcttcatgagcaaaccagacgccacggtaacagaatccaacttatcagcaatattagaatcaggagaacatttattattttttttcaaattagaacatgctttcttatcgactttgtcaagaccagaagtagcaagattccctgtatccttttgtgcatcaaccatcttgttatggacatcacgtcatctttggcataaatggtattgctgacttctggttgaacagaattagaaacgccatcaacaactgtgggcatgtcaccaccttctggttgaccatctttgtttccatccttgtcagaaggtatagcatcacctaaatcttcatcagacaccttccctgataagttctcactttttccaggatgttcatcaacggtcttagacacatctgcacatggtatatccgcttcattttattcaaactgggcatttctacctcagaggaaggaacagaactcttg

SEQ ID NO: 22256 - DNA, 1200 bp, Oryza sativa
  unsure (1)..(1200): unsure at all n locations
nnnnnnnnnnnnnnnnnnnnnnnnnnnnnnnnnnnnnnnnnnnnnnnnnnnnnnnnnnnnnnnnnntgattagaacagctgaaatactgtaacttataacaaatactcctactatccataatcaacttttgtttggagtttatgagttgtttagttgtcagccacagttaaatacaactaaggttacgcaagttgtagtatataaaagtatgatgaataaattgctagcagcaaaagttagtaaaaaattaaatcaataatatatgggacatgttattgaaaaagtatgataaaccacacaaccaaatataaaaagagttcctttgaaacacatgattgataaaacggagcaataaaaaaaggattatgcaagaatcaacgtgcaaaacatatgattatgaaacacaaaaaataaagaaatgatcgcttaattggatcgaaaaaaagatgtaggaattgtataggacagatgaactcataaaactactttttatgagattggacctcgtattaaaaatcctaaaaaatttatatgaatcgagacattcctcagaaatttcatagaattcaattagttttcaattcttcgtttcaaattatccaataggaaaaacatcctatacaaaattttaatatttttgttcaaatccacataagagaagcatgaccataaaccaaacaatcacttataaacctttaatagatcctctactgcttatgggaaagcaagttagattttgcagtgaaactgactgtgtttagttcagatcaacattgaaagtttgtttgaaattagaatgatatgacgaaaaaaattggaagtttacgtgtatagaaaagttttgatatgatagaaaagttagaagtttaaagaaatatttggaatctaaacacggcgtgaacaaggggccaaaaattgaccgaggaacaacagcaagcaaagcatataggaaagggaagggaaagacagagagagaaaaataaaagaaagcagggggaagggagggaatgtccacctggagcctccaccgccagtagtgcccgtccccagcgcatccgcagacgatcctcccttccaggctcaaaaccacaccacccccaccctagagagagaaacaaacagaccaacaatcaaacatactagtacaagtcgaggtagagagagaaagctcgagacaagctaaactagctagagagaga

SEQ ID NO: 22257 - DNA, 1645 bp, Oryza sativa
  unsure (1)..(1645): unsure at all n locations
nnnnnnnnnnnnnnnnnnnnnnnnnnnnnnnnnnnnnnnnnnncagctcagagagcgtaaagagcgacttcacatacttctccttcttgtcggcctcgtctactgcaatctcgaagatctgcccatcctctgtccccaggatcacctccttggtcgacgctacagcaccgaaaccacaaacaactccacaatcaagaacaaatacacagcacggactgccggaatcgagacacaattcgatcgaggaacagtatatgcagtagtattagctcaccttcggtgatggtttggcggttccacgcgacggcattgacgaggacgttgcggaggcgggggagcagcttggggcgcggccacctggcgtggtggtagtacgtctcggcgccccccgggtggaccaccgtggcgacgcagtgcttcccgccggggtcgaggaagacgcggtgcacggagtgctcgccggagcggccggtcccgaggtcgagatctgcagcagcagaggagcgatcagcggaagcgcgaggcggcggcgaagatggcggctgcgagggcgaggaggggaggacgtgccatgggcgtcctcgaaggagaagtcgtggcggacgagccatccgcgggaggtgccgaggacgatgacgtcgctgccggcagccatggaggtgaccacgccatggcccctcgccgcgtgccgctcgaggggatcgacggagaagagctgcccgccgggggcgaaggcggcggcggcggcgtccatggtcgtcggagtcgcagtcgcctcgccggccggccgccgcgagctcgtcggaggcgatgcgattgcggagaggagacggctcagcccgtgggctaaacggaggagaggttttacgagccacgccttcatgggccgtggcccaatttcagaagcccaatactctggcccattattgtaagagaattcaataaacaacgagtgcccaattccaataaataccatcaataaacgtgagttctatcaatgtcatcgtacgactttatcctaaaaatatcgttgttgttagagttttgtccctttccattaaatacattgttaatcctatagcacttaacagagggatggcaataaaaccctaacgacaatagtatttttggacaaagttgtttgtacaaatgatatatcctgactaatgaaaagtgaaacccaacatacaactaaaatataccatatctgatgaatattagtcattggattcactaaataaaaaaaagctataatcaattttggccatacgatgaaacttaagtagaaaaaaacatagggtgttctgaacccttctagcaggtaagaagaactacatacgatagaaatgtacaccactgaaaaaccgatcttttgctcgatcggcgaaaattacaaatatctcggttttcttaagaaccggtgctaaagaaggtatttagcatcggttaaaatgtctaacggcacattgctattgttagtaccgatactaaagattatttgtattctcggttcaatttttgtcggaccttgtattttgtgaaactagcattcaccgatggtattttttgacttggatgtttgtcaagtacatttcttgatttttctctcaatgtaaacgggccgaaatatagttcgaatttccgg

SEQ ID NO: 22258 - DNA, 1420 bp, Oryza sativa
gttcagtagaatatacatgtggcattttgtgcaaattgtgggtaacgtgtattctctttctggctccagtaaccatgagaactacagaaattcgacagccatcgaatttacagatttcaacacatttcagccaagattgtgatttctgaacaagtttgagactgaacatagggcacaatggaagcattcagacagtgaaaccatggaagaatggcactgcaaatgcaaacctatatcatttcttaagttagccagaacgcctcatccaaaaggacaaaaagggatttaaacacatgaaagtagtgggggcacatatacaagctccagcaagccgtcgcgattatgaatactaccgagttctgggatggccgcgtgataagtcgactctgcaagttgtcgacggaaaagatgtgaagatgtgtgtgctcggtgcaggtttgatctttgcagtgatccacatctccccccaaatgcctggatacaccaaaagtgaccttctaatgtagttagcatcagcatctacatcattgtttcagttgcctcaggaaaagctgcataacaaaaaggataacatcagttactaccttgttaaaataaaacagcactcactaactgatcaaggttgcccaatttttgccgcaaaaaggagaacatggaaatctttcgacctagtgccaatcttaatacagatacatgcatagaccctttcaagttaaaaggttggaaagataagcactaaaaacaggactacaatgttcgacacgatccgatgccacttcgacaccgcactggctcacctgccatgtacatggcaatatactcaaactggatgaaggaaaagtagatttgcaatgctcttggaatctaaaagctagtttgctatcaatcaactacacaagtagtgggattgcagagcactccaagcatcatatgatggcgtacagcaagcaaggcaagcaaagctatctccttatgatgtaggcatatagccatctttttcagcagtagcaacttcatgacagtaaacctagaggttgttatcaacctctcactacaacttttacatcaaaaatttactcaccctttttttttccctttcttgctcacttcttgatattttcacatcatgcttgcactggtccataaaaaaaatcttgatattttcacatcatgcttgcaagaacactacatcatcgtgccattgttcgataagttgaatttttttttctcttgcttttatgaaattatggttgctaagcttaggaattcttgggaatagtaggattgtgaactcactcatttcgaccaacgaccgcattggagcaattcctcccctgcacgccgctcaccgactgcgccaaccccgaccgggggaaatccgagggcgatctcttcctatgccgggaggcaaggaatcggg

SEQ ID NO: 22259 - DNA, 870 bp, Oryza sativa
  unsure (1)..(870): unsure at all n locations
nnnnnnnnnnnnnnnnnnnnnnnnnnnnnnnnnnnnnnnnnnnnnnnnnnnnnnnnnnnnnnnnngtatatcgtctgcgtgtttggaaatgtgatttcctttcttgcctnnnnnnnnnnnnnnnnnnnnnnnnnnnnnnnnnnnnnnnnnnnnnnnnnnnnnnnnnnaaaggaatgtggcttttgttatatcagttgttgatggctgctgtgttcttttcaggttttcgatgtctccgaagaggctccggataaagtgttgcaccgtttgaatgtcaaccttgagaagctcaagatggatggagacattcttgctgttcaaatttggagaactctcagaataattgtgagtgatgatgctttgaggttatattatgcagatttgcagagtaggaagtctctttggctttccatttccatttctgttgacttaaaagaggtttcaattaggttgcaggtggcgatggtacggcaagctggctgcttggggtagtcagtgatctcaagctttcacaccctcctccaattgctactgtgcctctgggaaccggaaacaaccttccattttcatttggatgggtaagtggtcagaaattaatgtgtacttaacaaatcatcttcttgtgtcaattagtttttgaagggaggtggcaaaagtgatgtacttaaactagagtccattatgtataagttgttctgtgttaaatgatcttttaaatgattcttgcctgaactttaacctgttcctgatcatggtcttgtatacttttgctgaattaaacatcgcagggaaagaagaatccttgtactgaccaagagtcagtaaaatcattccttgggctagtgaggcatgcaaaagagatgaaaattg

SEQ ID NO: 22260 - DNA, 2663 bp, Oryza sativa
gtgatggacgcctaacaataccacgaacaagagaaggagatgcagaaggatatgggagcgatggtggtggctggttgtcatcggaggtacgacgaggcccggcacaatgccctctagctacagtcgaggatctcaccgacaagaactacatgtgagttctgagggatggctggggcagaagaagaaggcaaagtttgttgttttttttttctcttggagttcagcgataattgcaatccattatttgcttttgtttcaccaggttgtggtataatgcttcattgtattttttttattggatattccacgtattgttttctttgtgttgcaataagtagttttcaagtgttgcatctatagttaaaactgtttaacccgatcgatgaaacatttctcaagagtaacgaaacattttttattttcaagatacacataactgatacatttttgttgaaacattttttattggttagagaaacagtactctacatgcgcggcaacaccatgcgatatttgtagcgctctccaaagaatttactacataagaatttcataaaaagaaaacacctataaaattcaaaatctatacaacaaataccctgaaattaacctgccccgaccaaattctaaagctcccccctccccgaattaattaattaattaaaaacctgtcccttgaaattaattggtttaattaattcttgcattacctaattacacaacctacccattaattctctctctctcgcgtaactcgtaaacggtaatagtatatgtaagagctagacgttgtggcttctgcggtttccttctcctccggcgccggcgccggcgacgtcgtgggcggtgacgtagctgccccagaaccagtgccggctccagacgtggttcatctcctcgatgggcacccccttcgtctacggcaggaagagcgcgacgaaggtggtcatgaccagcatccacccggcgaagaagtagaagaggccgaacttgaggtggcacagcatggtgaggaacgcctgcccgatgacgaacgtcagcatcatgttgacgcacaccgcgatgctctgccccgccgacctgatctccagcgcgaacacctcgctcggcaccagccaccccaggggcccccacgaccacgcgaacccggccacgtacatgcagatgaacagcacgagcaagatggcgtacgaccgcgacatctcgccgacgcccgcgacgccgaactggagcgcgatcagcgtccctaccaccacctgggagatgaacatctgcgtgccgtcctggaggaacagcacgcggcggtcgaggcggtccacggagatgatcgagacgacggtggcgaacatgttgacgaggcccgtgatcactgaggacatgagcgactcgtcgccggcgaagccgatggtgaggaagagcaccggcgcgtacaacatgatcacgttgatgccggtgagctgttggaagcaccggatgaggatggcgatcgtgagctcggggcggtacttgcgatggaggatgttccgccatgggtgctcgatcgaggcggcttcttcgcttgccgctaccatgtcgtcgtactcgtcgtggacgtcgtccgtgccggggatcttgacgaggacgcgcttggcgtcgccggcgtagccgcgggcgatgagggagtttggggtgtccgggaggacgagcgcgccgagcgtgatgatgagcgcgggcacgccggcgaggccgaggccgatgcgccacccccaccctgcctcgatgctcgacgtcgcgtagttgatgaggttggcggagaggatgccgatggtggtcatgagctggaagccgatgttgagcatcccgcggaggttcgccggcgccatctccgacaggtagagcggcacggactggttggcgaagccgacgccgatgccgaggaggatgcggccgaggatgagcatcatgacgtcggtggcggcgccgttgagcgccgagccggcgaggaaggtgacgccgccgcagaacatggaccacttccggccgaacacccgggtgacccacgccgccacgaacgacgtcgccagcgccgccaggtacagcgacgaggtgaagagcgtcagcagctggctgtcgaacttgcagtactggttggtgtccttgctcgccttcgcctgcgcgtacaccgacgggaagaactcgctgaggaaggagtccatggaggtgacgccgccggagatgccgatgtcgtagccgaagatgaggccgccggaggaggcgacgaggcaggtgaagaacacgaacgcggtcatcttccccgggtacgtcttgccacccaccgtctggaccatcgcgccgcccgccattgccgccgccgatcagctcagctcagctcaagctcagccaagctccggcgaggagggaggaggaggaagagtaggagggggggtgtggggttcaattccttttatgggcagagaaagcagcgtcgcaatgctgtccaatggctgcactgatgaatgagactgttctttctatttctgttcttgtagtttgtgtcctgacaagttgctaaatttaggagcatttgttcagagacagttctctcttggtttgttcttacagttggtttatttacccatcttttaccccctacccagggtaccgagctcgaattcgccctatag

SEQ ID NO: 22261 - DNA, 2804 bp, Oryza sativa
ccagtcttatccttttcaatccatttttagacttttactatttctttcttggcctttccacaattactgcataattacaattatacctctccacaaatattttttcctagacaatattacccttccacgattctactaccgttatatgagatggtagtagaaatagatctaaacccttggatccattgagatcaacggtttagattattttctacttccagtaaaaagcaccggagtgaaggtttttttttttccaacgaggacgtctgtgctttttaattttaagtaattaaaaaaaatcaagtgacaaatagtgccccattttgcgattgtttcttgcaggtttacatcacaaaaatgcttttctgtttttgttttctgaagttatcaaatcttatttcagatattgaggaaacataattcagcgcctatatgccctaacaaatcgcaactttattatgagcaaagttgatgaaaggaggcatgtacaagagcccaagtgaagtggaagatgatgtttctgtacacaaactattctggataggatagctaatgttctgctcgtcagaaagatacacgagctgggcaattatcaaaaaccaaagccacccaaccagaaattggacatgaaagagcatatattcagcattacaaaatcacatacaaactcgaaaaacattctattccatctcagcttttactagtagaatcatatagacatggtcattggaagaattttctgacccgttggttgcggtttaatttcccacgaagccttttcatcagactcttcagggagaatgaaaggcaatgaaatctccttgatcatcagatcgccgcagaaggggcactcgctcgctacagcatcatccagctgggacctcaactgtcacaagaaacatgcatggcattagtacaagaaatgcagatctcgggatttcgtagtttggatgtgaccaaaccttgtcaattggtgtcgcactgataatagattcaccattcatgtttccgccattttcctttgctgctttcctgtccattaggctaagccgcttttggaggtccagtattttttcagcctacaggtaaatgaattcatccgtaactaattggtacaagagattgaactatcaaaataaggaaatgaacaattgaaatgttgcatagggacttacttgtgtttggctgctattacaacgagttacatgtgcgatcaaacaattcgcatgaaaggcatgtccacaaggaaacacataaaagggggccatgtgtccggtagatgtgtagcttcttcctacctggtgcagtcctccagcagtcaatattttgcgcttgcacacctgttaatgcacagtgaggagttaacaccatgatatagcagcgaagacagttagtacataagttcataaaaccatctgaatcaaaatggaaaaaataattttaagtgtacttgagaaaacaagcaataccaagaacacaaatattaaacaatatagcgtgggggtcatctttcctctttgttgcatatttgcatctttacttatttgaaacgaaaacaaggaaactcatgtcacaccatataaagaaaagaacaggcccaacattagttaaactacaccattttgggtatcgtgagcagtttcttaccccacattcctcctcacgatcaattacagtgtatctctgagcaagggcaccaatatcacttctgatgttgtctgccccacgagtagcatcatccatctcctgtttcagctgatcgatttggctgtcatagtccttgagagatttgcatatttcctcctgtttagacaatatttttcactgttaatgctgagaaaagaggtaatgcagaaaatgtggactagtaataattaacaacgaaatttattcattcagataacttttttgttaataagaaaattgcagttgtggatcttcaacagagaaatggacattaggaggaatttttctgtaaagcagctgactgcctggacttatatcttactttaaagtcatcgatcaatacgaagtctgggaaaaatggcaggatatcctcaatcttcaacaagttgttagtctctgataggaattctatagctttctttatgttctccctcttgactcccttctcttgctcaatgacatgctttgcaaccttaagccacagcttctttctaagttcttcatcatcttcaactttatctgcttctgcttttgcaagctctaagtccacctagcaaggaccaaattgagtaaaggaataagaaagcctcataaaaataagaacacttcaaaatcctacaccatcaatatgcgaaagcgcaagggatgcttattgaatggaattagtagactcttaaagaaatgatgagacttagtgaggaatgaggtttaccgttaatgcaagtgcaacagcttcttcatgcatggacatcatgctgtaaatacgaacacaagcacgcattctcttctcttgaagacatagacgcagagcatatttggggtcgtaaaagaactcagggccatttgtctgtcctttaccaaacttagtgtccaagaattgcaaaagctgagactcatcgtcctgcacatgaataaaccagagtacacatacaaaatcattagttatatgtgttgacaaatatacgcttgactggtatggcattgacaacctcataagaaccaccagaaacatgaatgatgaattgagtgcaaagtaagcaattactgctattacagtttaatgtttccaacacataaaaaagaaacatacacaacaaaattattacatgatatttttc

SEQ ID NO: 22262 - DNA, 4274 bp, Oryza sativa
catgtgtttcattcctgcaagagttgaattcatcacatcatcctgattatggaaatcaagttggctacatagaattgcagtttgttccagagcttctgaacatagggagtttaggcattcttaggtttgattcgaattatcactatctgatatgggatttaagtgtaacagatctaaattcacttccaccagtagcaaaattcgtttcaatagtaacaatgtttttatatatagcattcagagtcccctggtgtgataaaagacggtaaggctgtcaactgttaagatatcacataatattaaaggattcatatagtattatagcaataggggaataggaacgtataagaagccattagcatatcatacttggcatgtggttcgctcacataacgcatcattgccggtataagcttccctggattcaacttatttcttgccatcatccatgattcaacagtttcataagcatctaacatgattaaatctggagcaaatttatactgcacaaaaacaagttaaagagcaacggctagaattaaaaaatattaaatgtgtaattttgtgtaaaacagaaaatgtaaccttgttgtggtagaatcaataataaacttattttgagttctatactgcagcattcaaagaataaatgtaaagccattatgtaccacaaggtctactagaacattatgtcgctgaagaacttccaatgcctttcttgcttctccttgctgacaaagtaaatagaaaatgcataaggacttgacatctcagctaatgccaatgggttccaagtgcaaaaggtacctcatataataagtaaaaaacttgtattttcaagataactgaatgcaatgattttgaagcaattggcttcaaagaaagatgtgcaacgaactccagtaatattataaatgtttcctttccaactattctacaaagaagaatgatatagaaactacagttgctcaagagaacagatagaagggaaatttgatgttagactatggtaagaatgcaagatcatgctggcattgagcctgctcaaagcatagcctagcctgaaatatctggctggcacaagccccatcccagcacatgttacatgaactgttctataaaataatcaattagtttgtggcataaacaagctcttatcacccattataggccgataatcaaggtatgcatatctttgcttgctcaaacatattagcaaacataatgttaatactagctagcacttggcagattatactatttactattgttatgctcgacacaaattagtatttaacacctttagatgataaatgcctgacactgacctgaatgtaatgatgaaccacaatttcatgttgctcctttaaaccagcaaaataaaccagctcatccactctcccataactgcaaaaggtttcaaggtaccagttggggaacacatataatcagcaacacaacaaatggagagaacacaccgccatcttattcatgacaagtcaacagaattgcataaactaaataatgaaatattttatagtctatccattgatgcagtttgcagtcttgctgcatttccccttttaaataaatgagctattgaaggctcaaagatgatatccttcttaatagaacaaatcctactggttgtacacaaagccctgagtttaaagcaaatggacattaaatcaggtcctttgtttggcaaatgttcaccaattttaaatatagtattaatgtatggaatattaaaattatgcaggttctatccaaagatatgtaagttacctgtacaatacatatatgagaatttaaacaacctaaaataccagtgaagcatattgtgcaacaatggtaccacatacctttccaacagtctcattgttgttgcctcatctaatacatatttgctatcacttagaaaagcacggaattcatttactattgaacgatattccgagtctttagaatctgctacagcatttgacgtggctcctgtgccatcttccaacaggaggcgattaatctacaaatattgcaccaaatatactggataagcccccgcaataatcacaagtacaagtatactgaaaccaagactgaagaaagatttccaatagcaatggaacatatcttgtattacccagggccggtcctggggttttgggggcccagggcaaaaacttatatggaggcccctacatatatacataaactaatttatatatttatatagtctgataaacacataccatttaatattcgatgtgacaaaattatctatatataacattttaaaactccaatgagaaataaatagcagtagcgagcagagaagtcgaccggcggacgattgacacgagcgtggttactggcgagtcgcgatttgccaacttgctgttttcgtttgcgagacgccgagaagtcaccgagagcgcaggagcagcgtgacgtgatcgaggcggcatgacgtgagtggcgtgatgtgatcaaggcaaagcgacaggagtcaaatgaagattgcttcggcttcgttaaaacaggcctaacgatggactaaatttcattttctgtattaggctattcagctatctaacttaatatagatccatggcacgtggactagaattatacaatacatagtatatatactgtatgtgcatagggggcccatagattttgggggcctcgggtggccgcacggcctgaccccccctagggccggccctggtattacctttttctcaacaatacagaggactgtgtatctttgtattaagagcaggaaaaaaaggatacgtacaaccaatgaaaataggacaccagccttcttgtcatgaagactgttatattagtttagaaggttgaaaaacaaacaattggtaccttgtccaagtacagctcagtagcccaagttgagatcattgtaatctgcattctgtcatctttcgttaggttatcaagccttctcaacaagaaagtcctgagagcatcctgtcaagttgaggaagataattatttcataaataaaatcacaatattctcatgtatcatgtaaatagttacactagaatgaatcttagattgtaccaaagcatgacagaacatttcctctatgttttcacaatgttaacggcattatattatatttcaaattatcaatcttggaactagcaacacttgaactttgcatcagtgacaaagatcagggaaaaaaaaaacaattgaatacatcaataagcaaagatatctcagagaagctcttgacaatatcaaatggcagatgagtattttagaaagatagatcttacacaaacatgcaataatataccatattagaaagttcagactcctcacaaaaaaaaagaaaaaagaaaaaaagaagttcagactaaactacctgctcaccaacagatataaattttaagctgatctcctcaaatgataggatataattcatctgaaaccaagagaatatattttttagtatcaacgtgaacaggacaacaaaatctttttttttaaaaaaataaggaacagaattaaacagtgtgggtttaacctttgcatagaaggaagctgctatatagtactcttttgtattgaatgcagtatcagcctacaaaagagaagatatttatacaataacagaagtcattgatcatcacaaaacaaaaaaggtccagcttatcatagaggggaaaataataaaggagaaaaaagtagtgcatgggatcgaagtgcaaataaacatcacctgcactagatagacttggtccctctggaaggagttacgacaatgtgacagtgccgtagcatattctttcatgtccaggtatacttgccacatatcacgaccctcatcagatgatgaaatctaaatatatagcttcatcagcaacacaattctggactctgaaggcaattattacatcaaagcaagaatcagatagtctctaacctggaatatagaattttcatcgtatgcatagaaaagcccagttgatgcatcactacaaagtccaattattccttttgtaacttctggtgaactatcgactataagttcctccactatttgctggctgattctgttcactacctaaaaatcacaggttatgcttttgctttgtaaaggaatacataaaacaacaggtaagacaaaatagtgacagaaagcaaaatgaatcacagtgaaaacagtatagattttttaaaaagaattgtaccttaatcttgtccctgatgagaagcagaaaatggaattcagacaa

SEQ ID NO: 22263 - DNA, 472 bp, Oryza sativa
aaattgagcaattgtacttacttctaatgaaccgatgcccgtgaatgagtacaaccgtgttggtgtgacagccatcacatagaaccttgtggcgttcccaaccacggcggtttccatctgcacaaccaaattcctacatcacgctcattccaaccaaataacaccaacacaacacaagtacagaaccgcagccctcgatggcctctggcaacaaactcgaacctgcaggcccttgatgccctcctgcagctcagagagcgtaaagagcgacttcacatacttctccttcttgtcggcctcgtctactgcaatctcgaagatctgcccatcctctgtccccaggatcacctccttggtcgacgctacagcaccgaaaccacaaacaactccacaatcaagaacaaatacacagcacggactgccggaatcgagacacaattcgatcgaggaacagtatatgcagtagtattag

SEQ ID NO: 22264 - DNA, 539 bp, Oryza sativa
tcttcgagattgcagtagacgaggccgacaacaagcagaagtatgtaaagtcgctctttacgctctctgagctgcaggagggcatcaagggcctgcaggttcgagtttgttgccagaggccatcgagggctgcggttctgtacatgtgttgtgttggtgttatttggttggaatagcgtgatggagaaatttggttgtgcagatggaaaccgccgtggttgggaacgccacaaggttctatgtgatggctgtcacaccaacacggttgtactcattcacgggcatcggttcattagaagtaagtacaattgctcaattttatcagctccaaatttcggagacatacaccattatagaatgtaatgggagcaatctagatcgaatttagtgaaaagaaagacccagatttttcacttcggatatcaaagtcctcatggacggtgtttcttgatttaataacgtgactcagtaacctcgaaagtgctatactacgcgaagtcagtatgcctcttttcttacagagagatatgcgtgattag

SEQ ID NO: 22265 - DNA, 1344 bp, Oryza sativa
ggtgtcaggatgatgaaaccagccaaaaagaaatcaaatggcagaaacaaactagtagtttgcaagaaaccaagctcttgattttgagattatttttgtttaatcactgttttgttgtaaatctgatcgaatcaacatttccagaaaaaaaaaaaactagtgcagatttcagcaaagtgcaaaataatcgtatagcatggaaataaaaactctcagagcttccttctcttaatgaaatgatacacacatctcgtgtattagagaaaagaactatcagaactacaatcggcaagcaatataaataatataggacaaagataagtcctggatattgaaatcaatacagtcctggatattgaaatcaatactgcaaagaaacttacaataagaccaagctgtctggttttccctgatagtttcaatggatcatcttgctctacaaaatgagaaagtatgtatgagagcttcactaaactttgcaggaaaagatttaataaggcatttgttatctacaactgtaccacacctacattagcaagtagtactccctccagtcatgattgtttgacaatgggaaaactaaaatttagtctatgtgtaattattatgctgtattccagcccaatcttctttgtacataacagtagattagcaccacataaacatacaagatgcatgaaggatggaaatttcttcttagttaagattccaaatacatagatttgtgatttatactcaaaactccaaaccaatggggatcaaacaaaacaatgcaatgtatcaacatatgcagcagtacctctttcaaattcaaccgcttcatcaagcaccaagtttagaagctggtcatagcccttcaaagtccctgtaactgcagatgtagaaataccaaagttatggcctgtgatgtggtattagtgtattataacaaactgcaggataacaaaaacgagttttctggaaattgaaacagttctactgtcattttttagtctattttcaatctttatcttaatatcaatgctaatggctaacctccttgcaactactataaacaatgtcaaaacttaagatattacataaggggccgctcatctgcttgacggagtttctatttcaatatacagttagcatatgatattttaccactctgtccgtaaaatgatactgaaaaaagaaaaaaaataaaggtgaaaagtcatcatatagttatcaggatagccaaccatgagagtgccttcactatctagatgaggttagctacaaacagaatacaaggtgtaattcaaaaatatgcaatcacagaatctggtatctgtgagcatacagattgaaagtaaaaaa

SEQ ID NO: 22266 - DNA, 754 bp, Oryza sativa
  unsure (1)..(754): unsure at all n locations
agacaggccatcctacaaatagagaaaccaaattcgttataagttgaacaaagaattaagaccttgaggatatactttcatgagcagaaatgcataagtgtttgtgagatttcaaaatttgtccaaatagtatttactatgtgttatccataccactcctgctgggccatcatgagtcccatgtacggtgaaaacaggcaagccaatgttgaaatttgggtcttcaaaattcactcgaccaaacctgaatgacatcataatgtgttaagttctgaataatagttcagtagccaggaataaataattggcttggccttcttaatatataattagatgatgattagctaaagcctagtgagataaagtaacaaagttgagaagttaattcagccatgaaaagatcaaataatttaatttactgcacctgttctgcagacaggctgcctggtcactgaccacctgaaactgcacctgatggtcattcaggcagtagcttcttatgatctccatgctcttcaccagcgtagaaatcgaaggtttgttctcgtggaacaaattcccaccaagaaggatgaaatcaacctgcaaatttaacagtgcatctccaaccatcatatcaattatcaaacaactcggattatttaaggtagaagatggaagcttttcatttgttattttcagcttaattatgaaactgnnnnnnnnnnnnnnnnnnnnnnnnnnnnnnnnnnnnnnnnnnnnnnnnnnnnnnnnn

SEQ ID NO: 22267 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnntcccgtctgcaattgcttttcttcacaattaggtgagcccaaaaacacggcaataacaaggacagtgcaatccttagttgcaattcatggggaaatcacataattaaaaaaaatcgtcgcggttaaaataaactgattttaacttactacacacgatggaaacacgattgggtatggataaattcataaatcccccaattccatacaaatcaggaggaacaaaaagaagacagagacctggagagcgattgaacagtcccgccaggatctgatctttccgactaaactgaactccccggcatccacctccgggactcccgtggcctcccgcaccgccgcattccgtccatccggccggccggcggccgccatggtcgccggctcgccgccctcctcgtcttcctgcggtctggggacccgttggtaagagcgggataaaaggagggtttcgttgcaaaatctctcttccccatcgcctcgggttttgatctgagccgcacaggggagatcgaacggtcgagatcctgtcacgggtggagtagattgataatacgggtgtagttcgagggtctcttcgaattaaaccagtcgcgtgctcgagtgggatcgtgaagcccacttatcggtagcacccggtggcggcaactcg

SEQ ID NO: 22268 - DNA, 5904 bp, Oryza sativa
  unsure (1)..(5904): unsure at all n locations
nnnnnnnnnnnnnnnnnnnnnnnnnnnnnnnnnnnnnnnnnnnnnnnnnnnnnnnnnnnnnnnnnnncccgatgcataaagtctgtcaactgtaacaattagggtgctctgttttgaattcttaccattgagaatgctaaactgaacatcattctgttcagtgctagaccttataaataatctgtgaaaaattagtcccagtatcgccagacaagaccatttcttttcaagggtatgtaaatcagagcgctatgcattacacactacttgaattacccccaattaatatgtaattgcgacactgaaacctgtttgtgactgacaaccatctattaaaaaaaactaggttatgttttcttcgtgcttcccacagtccatgtaactaagaatatagtgttccgaacatttattcatttactatttagaaatttgctaatttgtatgaactgtgttccagaaaaatggtttgatggtaagagtgtgcgtagcaaaatattatttggcctggccagcttctgtttttgttttaattcaacaattatcccgtgaatgagtagctaactgcatgaacactgctacattatccttccagaaagagaaggcgtttaacaaggagatgaagaggaagttggaagaactgaaggccacaacatcttccctaaggactcagaagacagacctgaaaacgaagatcaaaggactagaagccacagccacaactctgaagaacagagagaaagaactggaagcagttctcgcagagaaaaatagccgcgtcagtcaaatggaagcaactctcacagataaaaacagccacatcagacaaatggaagagagagccgcaggcacaaatcctgaccagatggcagctctgatggagctcctgcagcagaaggaagccgagcttgaagagatcaaggtcaggttccaggattacaagacaacggaacggaagagcgtcggcagtaagagcactcatgttcaatcaaacaacgcaaatgcaagacctgacaatgctgtagtcgaaaaggtcacaagctccagtgatgctacacccactagagcagaagaaaagagttctaagaataccacaacagcagaaagtagacacccaaaagacacatctttagaagaaaagcaagtgaaatctgcaactagcaaggaagaagatggcttacaagacaaaacagatgatgccattgaagatattgatgatatctacggggaaagtcattcaaagaagatcgaatttcctcggcggaacaaaaagtttttgactaacagtggagtagacagccaagatgaagaactgcataggatagaacacccagggaactccctagaccaggacagtgatcgcgtcaggtacaataaactgttggagaaggaaattgataaagtttctggtgaaaccaagaataaaaagagtattgatggtagtttggaaaagatatccaagcatagcttaggtgatgccaataaaaacggattgaaacaaactgtggaagacatggctggtggtactgctgctgtgaagcccaatatgtctgtaaatgatgatggaactcaacaacagaataagagacccaagaagaagaagaccagatccaagaagaagatgatcgattctgcaactactaatagtagtagtgaagttacaaaagaaaagtaagtagatgccacatcaatcccagagtgagttttggatttgaaaattcactgcactacaatgacagaaaccatggctgaagcctgaagggaatatcctagattttttatagcagttgtgaacaccaatgctatttgatatgctggaaaatctcggagaaacgaaggcccaggagtagctgagaaaatgtactgatgaatttatgtctcagaacagcgtataacatgttttctacaacatcatgattggttgttgtcttatatggacatggtaacacaatgattttataccttattttgttgagaaaacagttttacaagtaactcaatagctcatcataaattttctacaatgttggaacatttgggtaccggaaaaatcaccctgcacctcatgaacactgcaagcaaattttgtgaacaccactccattgtcgaaactcaaattactccagcccacaaaaaaatttggtagttttttaagaaactactgacatgtcacatccagaacttgttaagaaatatgtatcagtgtgacaacaagtttgacatggaacagaccacaatgcagattatgggacatcaacgcaactaattacaagcacaaagtgaacaattttaggccaaaataatgtctagaaacaaaaagaactagctaactattgccattcagatttacatataacatcaagaaactaatgagcattcacatagataaatacaagtcgcacaagaaaaagtgtatgcattatttattgtgtttagaagcgtgcaagcccaaatgttgttgctgttgttgctgaacctaacaaaattcattatatgcagcatataatggcgtgaccttcttcagatcttgatcactcactattgatatcaaccataacaagcataaaagcagctccaatataaattaacaactaaatcccgtctgcaattgcttttcttcacaattaggtgagcccaagaacacggcaataacaaggacagtgcaatccttagttgcaattcatggtgaaatcacataatctaaaaaaaatcgtcgcggttaaaataaactgattttaacttactacacacgatggaaacacgattgggtatggataaattcataaatcccccaattccatacaaatcaggaggaacaaaaagaagacagagacctggagagcgattgaacagtcccgccaggatctgatctttccgactaaactgaactccccggcatccacctccgggactcccgtggcctcccgcaccgccgcatcccgtccatccggccggccggcggccgccatggtcgccggctcgccgccctcctcgtcttcctgcggtctggggacccgttggtaagagcgggataaaagaagggtttcgttgcaaaatctctcttccccatcgcctcgggttttgatctgagccgcacaggggagatcgaacggtcgagatcctgtcacgggtggagtagattgataatacgggtgtagttcgagggtctcttcggaattaaaccagtcgcgtgctcgagtgggatcgtgaggcccacttatcggtagcacccggtggcggcaactcgccggagaccgaaccgctcgccggagaccccccccccccctgggcgccgtgaagccacggcgccgccagagctcgcttctaggagtcactgggttctacaccactcagtccaatcaaaccaaggcgaggggagtgccgctccgcggtggaaactcagagatcgagggaggaggaagatggccggttggccgccgccgccgccgcatctcacgcgccggcggccaggtggacaggccatggcggcgccgcccattctgctgtttgctcggtgagttgccatagatgcttgctagagctaggaacccaactaacaagatggtcatcacattctttgtttcagtaattgcaaactagtctagtctccttggatgaaccggataatacatacagattcagatatatataaagattcaattaaattctcaaaaggaatagaatgtagctgaaggcttgcatcagctatccattttggccattgatctcattcccatcctaatctcatcttcttcttatggctccatatctgcctgctatctgctagacagagagcaatatcttcagataacctgtacatagcagttacaggagataacttgaatgtagttctgaatatatccatctgaatgttgctgactactacaaaatagtgacaacagagaggcaaagctgcagagaattttacttacaggagctttgcctttcttgccaccatcatcattgttcttcgacggtgcggtacggtagaaagaactcaagtctgtttttctccttgaagattgagagcctccatcgacaggagctggcctcttctggcttgcttgttgagagtgctccttgtccttgatcatggaacagcaaaagcagttcaagatgacatttggcaatgatactagaattgagctacaagcctacaactggttgacgatatttgcaacaagagaggaaaacaatgcatacagaaatttcgataagttcatctgattcatgagtatcttgttcctcatttgatgagcacttcaattcctgaaacgcgctgagcgcgttcgttggcaggctctgagagcacggcatgatttctgatcctcccttggagaggaggggatcttcattcatgcgctcctatggagtaagaattaacaacaccctttttcgctatctttatttttggctgaaatcaaatctagtatatgcagaaatagagttcctctgtacctgcatacactgatccagttgaagtactatatcttcttcagctttcaaatcctttgttgcaaacgtcaactttttctgcaatcccaagcaaacagttttttcattgcaaatatgagatatcctgaatggaactatatgatggtaatatcttacttttgctgcatcaatatttttgtccagacaagaatgaaacgccatattctcgtccttgttgacaaaatcatgcagtgcactgtctaggtcatttttgtcaagaatctgcatattctgtaaaagaaggattaaatgcgccagtgtatttttatttgtttccactaacctggaattatctaaaggaatggatatctgaagcaaaatagacctggccaccatgaattaaaaggacaccaacatgatacactactagacttagaccaggagaatgttaaattagtaccaagttactctctgcaattaattcttcaatactttgctgatctagctcatttggttcacattcttcagaactaccagtgtgttctgcaatataaagagagagtgaacaacacattactcaacaaagattaagatgcatttttccagtcaattaatatcaaaattgttcctaattcctaattattttagtgcagttaacctgaagtatattcccatttttcatgaaacataaacaggtacctcgtgttcgattctgttgagctgatcttgagaagagaataatgtcgtttgggtttgcgacctgtaaagaatacaccagttaaagtatatgataaaggattcaataaaaaaaaagtatatgataaaggaggtatgcatcagtaaatttcatattagtggttgaggtacctttccgacatacttctgaccaaaccgctgtggagttattgtcgaaaacccagagtagtccaccttcagaaatttgacataaagaatttatacaatattttaaaggaaggtaatattttctgaagagcaccctattttacctttactctgactaggggaagtttgggctctgatccactaattgctgttttatcgataagattgctcacctgaaataactctgtattcaatagtactgctgaaaactacaattcgcaaacatccaatttctaacatatttcccatttaacatgaggacatattcagacattcagtgaaaacgagctaaatgttggaaactcatgaaaatcatacctagaagttttgtaaattcatgaaacaattactagaggtatgtgtatcagagccgtcgctcgaggtcaggaggcaggtccccgccggcgtcggcgagaccgtcgtccaaacaaagctgcatcggtctctcaagctgtggtgcttctacgccgacctgatggagacgcacggatcgccggaatccacctgccccgtgtannnnnnnnnnnnnnnnnnnnnnnnnnnnnnnnnnnnnnnnnnnnnnnnnnnnnn

SEQ ID NO: 22269 - DNA, 5630 bp, Oryza sativa
  unsure (1)..(5630): unsure at all n locations
nnnnnnnnnnnnnnnnnnnnnnnnnnnnnnnnnnnnnnnnnnnnnnnnnnnnnnnnnnnnnnnnnnnnnngcaactgaagaacctggatggataatgtgaaaatcttttccagaaacctcctgcaaagtttagctagattaaaaataaaaataacacttgacaaacattagtaagaaatttgcagtagctcaaaatgtgttacctggtgatcaattaggcattcatgctcatggccccatattaccaagtcaagaaaacttggcaagagctgttcattgatgccatttgttgagcttccctttctcctgccgaaattagagagacaaattgttgctaggaagcgcaagtgaaaaaagacaacaaagaataattataatcatgagccactttgcataccttttctgatggaaaacaaaaagattgaaccagtcatcttcactgtctgctttcatccactgtattttgtaatgtgtctgaaaaacgatatatgcacatacatgtgaaattattcataatcaacaagttaacatctccatgtgcacaacacatgagaattcttcaaatcgtaatcatgcgctctttttttattattataaatacctgtaacatcctgctcaatttctcatcccgaatgttaccaagtccatatagagcaacagaagttgcaccctgaatcaagtagcacaagtcacagaattattatcttacaattgttgattacttggagttgtgtatagaacaaaataaatttactttttttataaatactggacaaactgatatttgatcaacatcagaactgccaggatcaaccttcccaaaatagttcacaaaattgcaagcagaaaggatgtcagtggcagacaggccatcctacaaatagagaaaccaaattcgttataagttgaacaaagaattaagaccttgaggatatactttcatgagcagaaatgcataagtgtttgtgagatttcaaaatttgtccaaatagtatttactatgtgttatccataccactcctgctgggccatcatgagtcccatgtacggtgaaaacaggcaagccaatgttgaaatttgggtcttcaaaattcactcgaccaaacctgaatgacatcataatgtgttaagttctgaataatagttcagtagccaggaataaataattggcttggccttcttaatatataattagatgatgattagctaaagcctagtgagataaagtaacaaagttgagaagttaattcagccatgaaaagatcaaataatttaatttactgcacctgttctgcagacagcctgcttggtcactgaccacctgaaactgcacctgatggtcatccaggcagtagcttcttatgatctccatgctcttcaccagcgtagaaatcgaaggtttgttctcgtggaacaaattccccccaagaaggatgaaatcaacctgcaaatttaacagtgcatctccaaccatcatatcaattatcaaacaactcggattatttaaggtagaagatggaagcttttcatttgttattttcagcttaattatgaaactgaacctctgcattctatgtacaaagttttcttgatgtggtccatttgtttcagtatttttaggtcataggaatataatggtggtgtgcattctcgttaatccaaacaccaggagttattcttctactattttaaaaaaatcaaacgactcataaacctgatcatcacaaacataagatgatatttaacttggcaaaaataaaaactgaattaatatcaattttcgataagatatttttcgaatatgttgggatactaaggagaaatttagcaccagtattgatagagaagaaaattgtgagaaaacctgggtttgagggggatcaaactctggccaatggcatgcccctggtagctctctaccagccaggctacacgttgttctcattttttgataagatataccttgtttataactgctaatgagcagatctcctcaaaagtatcaaatgagtcgaatcttcggatctcgtccttctctaggtagccgagatggcagtcagtcgccaccaatatgcgcagcatgctattttcttcttcatccctgaagaacaaaacacatatatcattgcaagtaacaatttagatcattgcaaaagaatagtattgtaacaaaagataacttgtttaagaaaggatagaagaaaggggaaaaggaattaatgccgattttgtgctgatgatgaaacaattgagcacttatttttaaagtgacccttggcaatatttatttggaattcatggtagcttgtacctttaatctgaaaccaggaaattatatagcccacatgtgttgggacctggatgcattattttgataaagaaacacagaaaatgattattggaggtgtggtgtcaatcatttggtctatctggaaaacaagaaatgcaacatgtttgcccccattctttttagctatttcaccgaattattaccacagattatttgctccacgcctctaaaatacgctttctaaaaaatatattctactatttgtattgcttagactacttgctttaagatttttgttaactttatttatcaaaatattcaatttatccctataagcaagtagataatccactgccataattcattcaatgcatgatttgtttcaaacgggcacgaaatgaactaccaaatgttccaattgaactaatacactacacttgtttctagctagatttcatcttggtcaaaaggaggaggaaaagcaaagaaaggtgcaaatgcaggacgcaactattaaagcgggtggcttgtgaagtacatggatcaatgtatggttgagggcttaatgcaagacaactgcaggaaaccctagctgcactgtttggaagcttcttgttggaaagttgaaatgcagctcattttgagcttctcatgtgtgcataaaaactcctttgatgtaatgatgtagtgtggtaattttgaaggatctttggcttaattagactttgctaggtatgcagaatggtggatttgactctcacgctgaatggtgggatttatggtaccaagttaccatgacaaatttaattgtcttcgcaaacttttgtcttttaaccttcatttctagtgacagaaatgtgagaagtgtgcctctcttcctaaaaaaaagatcattgcaactcaattcatgcaggagtaacttctaatgaaaggagttaattgaagtacatgttcaaacctatggattgtattatttaatataaatataagttctaataaaaggagttaagaagcgtacttctacataatgtttacaaatcaacccctcagtaccatggacactagctttagttgctagtaaaaccgaaaaatacataataaaactatgattgcatcgaataatatataaaatatatgtaccatgatgcaaagctagcatgcattgtgtatgtacaagaaaatatgtttttattttacactagctgcagacccaaacttaaatatgtgacatatatatgtcatgttgattgagctataaaacattgttcaagccatcatattgtatcaaatggagtgatctgccagctaccattttcaaatgtttacaaatggactagatatccagttgttaataattaattgtatatatatatatcgatatatttcctatatgcttgcatgcggtacatatgatacatagcatactatattcatcattgaattcgtgtatgaaatgacaagccatgcaatatcccaaccctatcttgtgatctactagcttaacttgttccaaattaattagggggtttctgactagcagtagaaaaccaaactaataataaagcgataaacaattgattatgtatatatcttaattacatttcggcgtctggtttataatggcatatatattaccattataaatatatattttcaggtatatatacatttacatttttacactaattaattagctgtgctaacgatcatttgtatatttggatgttagtttgagaagttagttttgcatatattaattacacgtaaattaattaatttaccacaggtactcaactaatagatcaggacaccagaactgatgctggatggcacatcgatgctcctatagatacatatatatctagctaggtaaccccaaataatgaatgaactcacacatgcatctaggagaaaaaaaaacaccccaattaactctaatataatatatacgagcatatgcatacatagttgagcatatgagtatatgacagtatttatgcaacaataatgcaagtgcaaattaattaacttgggggggggggggaatcaatatatattcactcagatcgatcgagctcacatttggtattatatcttacgccttaattagctcgatcgatcgatctgtggagatcgtcaacgagacgacaagaaacaatgtgctcgatcgatcgttcgaccgcgtcgtcgctgcagccgtcggcgctagctgacggtcgatctgccggccggccgcggagatcgctcgccgatgcagctagctagctagctctctcgctggccggcagcaaatcgatcgagagaagaagagaggaaacaatggcgattagctagttgcgcgcgaggggagctggatttcgatcagatgagcagatctcctaaagaagaagaagaagaagaagataaaggatagctcgcgagctagcttatatatgctcgtatatatgtagctgaatagtcagtcagtcagccttccagcttccagagcaagcctcgctcagctggtgatagctagctagctggggctaccctagctaccttacgggctcatcgtttcagggtgtgtttagattcctttttttttttctaaaaatgtcacaacaaatgtttggacacatacatgaagcattaaatacagacaaaaaaaaactaactgtacagtttacatgtaaattgcgagtcaaatcatttgagcctaattgcgccatgatttgacaatgtgatactacaataaacatttgctaatgattcgtctcgcagtttacaggcggaatctgtaatttattttgttattagtctacgtttaatatttcaaatgtgtgtcgtatactttaaaaaaattttgggcagagaactaaacacggccttagttgattttgcttatcatggaaaatttgaattttcagttgattttgtggttttctcattttagtttattttttagtctttgcttttaaatcgtcaagaacacatatatgaaagttttattcataaattattttttattttttgtttgcaaatataatgtctggctagaataagccaaatgatgggggctagatcggagtagcatttactgcagatgcatttcatactcctccgagaattaatccaggattaagtgtaatcatttcatttattggctgattataggatatatatagcgcttattattggaaaaagttatggacgagatttttgtatatgtatttttaacgacttaaaattactaccaaaataaactaattacgatcaaaagaaactttaacatcaatattaaatttgtgggtagaattttggatatgcggtttggctgattagccgtttggcttgtggaaaa

SEQ ID NO: 22270 - DNA, 2176 bp, Oryza sativa
  unsure (1)..(2176): unsure at all n locations
nnnnnnnnnnnnnnnnnnnnnnnnnnnnnnnnnnnnnnnnnnnnnnnnnnnnnnnnnnnnnnnnnnataaattttaatattaaatgtaacatattttgagacggagttagtagcttaaaaaacacatctaacatctagtagttgattagcaaaactacaggcctaatgcattgatatacacaactcatagctaaaacaattagttggttaatatctactttagatttgaaacatagttgacaaaaaaaaactttaaaaaaattgtcatggtttggatagagttcatgaaagagtcaacccttcttctattttcgttgatttttagtataaaaaatccatttgcccccattaagatatagtaatttttatgttggtttttattatcatacttttcaaattgctaaacagtatattccatgtgaaaacattttatatataagttattttaaaatacatgataaatcattatttcaacttagtaataattaaaacgcaacactttcttgtttttcgtacctaactttatctctacctttaataaaacaagataatctttttattaggaaaaaatattattatcttcgctccaaaatatattaactttccattataaatctaggcaacattttgggacagggtagtatcgtatattcaattgttctcactagagcaaaaatagttcagttgttcatcacattaattgcgcaaatcctaattggcgcgcacgcgcccctggcgcgcacgcgccggcccacacgtctcatcctcagccattctcagcgcttgcgctggcgagacgcgcgtttatttttttcggaattttttctctatacgtataaaactgattcggttagttctaggtaatgataataattaagataagatttgtcttttttccgaagattattttaagtaataaattgaaaagaaatatatatgtgaagtcaaattctaaaaactttcaatccagatttgaaaactttcaatctagatttgaaaagtttttgaagttaaattttaaaaactttcaacttttcatcccaaatttaaaacttttcatcctagatttgaaaaatttcaagccagatttgaaaacttttaactcaaatataaaaactttcaactcaaatttaaaaactttcaatacaaaatttaaaaactttcaagtcaagatttgaaaactttcaagtcaattttgaaaacttttaactcaaatttgaaaattttcaactcaaattaaaaaactttcaatacaaaaattaaaaaatttcaagtcaaaataaaaaactttccaattctacatttgtaaagaggtgtgcaaaagattaaaaaaaaatcggaaagaaacggaggaaaaaaaacgcgctcagagaaaaaaaaagaggtgcgaacatgaaaaaaaaatgtactgcgtttttttacacggtaagcgctagggttagtaggaacacgcgcggcttcccgttctggcgcgtgcgcgtgcagtaggaacaccccattaattgggcttcaaatcatacacattgaagcaattaggcttcatctctaaaatgggctgaaggcccaataagaaaagtcctccttatacctctataaagtgattgcgagaaaaagaaaaaaaaagaagaaaaaaaaagagaaaaacacaacaccatcaacccccgcatccgccaccgccgccaccaccccctaactccggtaagccgccgccgccgtcgccggcgggcgccgtgtcttctcccatccgtcgtctcggatcttgcagcgaaatttgacaaagtttccctccttgcctcgcagatttgaagcgaccagaggccgcggctaaggtccgggatggtaagttgtaaaccctcttctcccctcctggggtttcgggtgctcgattggatcgatcccgggtgctagttcttggtttggtttggtgggattgattccggtttcgtgtcttggtggagcagtcggggcgcaaggagacggtgctggacctggccaagttcgtcgacaagggcgtccaggtcaagctcaccggcggcaggcaaggttggttggtttcatcaccagtttaggtctggattcttgaatactcgtagatgtgggtatagttttgtgccaagaaacctcagtggcaggggcaggaaatcctaggtctgcagcaaaattgtagagtagggta

SEQ ID NO: 22271 - DNA, 1019 bp, Oryza sativa
  unsure (1)..(1019): unsure at all n locations
nnnnnnnnnnnnnnnnnnnnnnnnnnnnnnnnnnnnnnnnnnnnnnnnnnnnnnnnnnnnnnnnnnntttcaatatccaggacttatctttgtcctatattatttatattgcttgccgattgtagttctgatagttcttttctctaatacacgagatgtgtgtatcatttcattaagagaaggaagctctgagagtttttatttccatgctatacgattattttgcactttgctgaaatctgcactagttttttttttttctggaaatgttgattcgatcagatttacaacaaaacagtgattaaacaaaaataatctcaaaatcaagagcttggtttcttgcaaactactagtttgtttctgccatttgatttctttttggctggtttcatcatcctgacacctcagctccaacgactgtttgttgcaggtctgtaggggtacagcggtgatgcttgtatcgccaaccgatggaacggacgagattgccaaccccttccaatctgatggtgcataaacctgcaggagctgatggttctcctagtcaagatccatgctctcccagtagagaggcctttgtattaactcatgtaatctggtgccacagtctcttatgactcgtgtctcttatgaacaccaggtggtggtctgttctgtaccactcgaaactgatttctgaagatccttgctttgtgtcagatatatgaatcgcattatgctcttgttcggtttgttcatatactgtgcatggttggtttctttgcttggttcagctttcacctttgccccatctgtgactgtgagcttgcttgcagtctcttctgcataaactgcgtttgcaacagtcggaaaaagacatggaaaagaacagagttaatttaggcatttgagtgaccttccgtttggtggctgttcctgcatcaggtgattcagatcattaccttaagcagccatgtgaagcttcatagattgcatattcttctgccctgtttagaatgagttcctgttcggattgtgta

SEQ ID NO: 22272 - DNA, 2466 bp, Oryza sativa
ctattttccaatctttccatttattaacttttttcacatgcaaacaaaaatgcccgtgttaatttctccttttaattcacaataaagtccactcaaacaattttgttccactcccgacacaactttgtgaccctttttttgtagctatcttcaaatcattagcaatgacaatctttatttactttttttttggcactgcaaacaacatagcccgtgttattttctcctttcaattcataaattgaacagtcaacagaaatagctgcagtatccctttgtattttgttatactgccaatctcaatctgtacctcgttacacggatctactcgctgcatcacctcatattggctcaaaaatagttaacagttctgtagtattgctactgggaacgagcataattgctagcctccagttctaatcattcatccctacgccattacacagaaatttagagactatctcctcccactgaaattaccatgtcagcattgcagttcaagctagcaaacatgctggctaactgtaaacttggtgaaacttgccccacattcgagtcgttgggtctgaccatctgaatcaactggaaatagaatgttgccacatagcttcactccgataaaagttggtgcaatgcacaaattactctcgatcgcaatcactaggtcataggaagttcgcctgctcttgaacttcgccaactgtagaaaggaagatatcaggtgcaacactaagtcactgtaacagcatgcaaagtgaattctgaaagcaatttctcaccaggaagttcaacggctaagttagcttgagcatcagcatccgtgttaaattcctacataataataagcaaacgtgagtggtacagtgattgaagttctcgcttccagtagtttggagtgatttttaaaaattttaatagtacatgaagaagtgtgatgattgcccattggagaggcagtttcagaggggcaaataagggagttgccaatttccaatggaaaataaagagttaattcaatataatgtaatgtggtgccaaaattcatatgccataccggaatgatagctgatataaaataaaatacagcaagcgtggaagacagcaaatatatggaacacctaccctcaaaacatggttgatttgaaatgtatgaaatcttcccttaatttccttaacccttttgcacaagtcagccatagtatcatgcctagcacgccatacatctgagacctgctccagaaagtcaacatgttacttatgttaagaaacgttaaaattgatagagctgccacctgctagaaaagctcttcaacgagctgtagtgattagttccaacagagtttgttatccattgaggcattgataatcaaggccttgattcaaaatatgtactgatgcctcaacttgcacttatgttgatggatgcagcacagataatttgataaaaaaattctttggtgaggaaaactgaagaacatgacagatcaagtaaagcacagattaaaaattttgcttttaaaaaattctatttgttggaaatttaatgtttgaatagaatgatagactgtgcatagtcacaacaaactgcagtacaacattcagttatctcctgatgattctaggctaaagcatgaaaaatagaagtagtgaaggttcaaccaaaacacaaacctggttacaaacaagcttagaatctccttgagcacgtatatacttgaatcccttcttggcagcatatgttagccctaggatcaatgcacggtattcagcagcattgttggttgcaatacccaaaccctcccgtagttgagcaatctccagtcaaacagtaaaaacacatcaccagttagtcatgataattgaagattaagaaagcaccccagtatagtactgtaggtgtactgtgtacataccacagttccatctagtcgccttattactgctccagcacctgctttcccaggatttcctttagaagcaccatcaaattcaagaagacaagagagctgtataagatgaagtccactggtgagaacaagtcagcatttcgttgtagtgaagacaagtccccaagtacaaatgttagtactgaatatctaggacaaataaccaagcaagaaggcagaagcatttatagctagcacattccattgttcatactcacagaactattaggtaatggttcttgttcggagactttgggctgtttctttgacggtccagtttccttcagcaaatgattgttggtgagagaatgtgatatgtaggcaacacattttctacagcgggcacttttttaacacaaacacatcttaacacttagcttgaaaatgatcgatactcaccatctctagtggcctttttaaagtaaaagtcccagtcccaccaggttgctgaaacaaaaagcggcacacagtatgttatgggcaaacacagaatcaaatagtaacgcaacaacctttgtgg

SEQ ID NO: 22273 - DNA, 691 bp, Oryza sativa
agtggtgcttggtaactggaaaggtaagatccattataaatgtctaggctgaaattgctgtacatcaacaaattagcattgcacaatacactatgggggcacagagaatgatcctttaataggaaacacgttaacatatctatgcaacattggcaagtgcagaggcatatttctgaaaaaaagctgaaatcacaaacatacatcgtctttacctggaaagggcatggaactaggtcatcaaataattcatctcttgcatctgctgcattaatggagtaaagaggatttcttaaaccgcgcgcagcgaggtattcttctgtctctttacgcaaagaatagcctttgtacaccgtcacagaaggatcacatacctagtaagatatacttcacataagaaatggctcttgactacaggtacccgttaatgtcgttgtgtcaccagcaagagaaggttaaattttgcatcaatgacactcatcactcttatctccttatctttacttctctacccactaccacaacaataattttagtatcctgcgaaacgcatgaacaaagctgcataatgcgtactataaagcagtagcccatcttttcgttcaaggaatacagctgagctacaatgaagtgcaaatgtctgcttatggtgtgacattcatagcaaatgaaatgcgacaggagagcaagtgtt

SEQ ID NO: 22274 - DNA, 708 bp, Oryza sativa
gaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaaatggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaacttgagggaaaggggtgattccttggaagattggtttcaaggaggacatccacacgtacaggagtcggatgaggagcaagagagataccgaggcgaagattgcagacctagagttccgggtatcgagctatgaactcaacatgcaagaagaggtggcaaggaaggttgatgaacgcatggccgcacatcggtcccatgatcccca

SEQ ID NO: 22275 - DNA, 787 bp, Oryza sativa
gttgctctcgctgtcacccgacacgagttttgtttactatatctcgtgaaatttcttgtatgacaccatgagtctatatttacatgaataagatttaagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaactt

SEQ ID NO: 22276 - DNA, 909 bp, Oryza sativa
caaaaaaaaatatatgttccagcctacaagcaattgcagtaggcagtcatgctaaacaaggaaaattgaactgacatttcaacgctacctttttatcaaattccattgctgaaatcccctctctgccaaaagaaaaaaaaaaggcaaggttattagtgtattaaaaggatggctacaaacagcagagtgaaactctaggaaggagattatagcaactagccaactactttaaagtttaaaattgtgcttttataatgaaatacagcaaataacataaaataaaaatgctgaccttactgcttgaaatcccaggactgaatcgttaacaactcgattcatctgataggagcaatggtagaactcatcagtcaaataacgaacagggattcaacattacaaggtacataatgagccttgtcggtagaaataaggtaggggagaggcacactaaaaaagatttttaaaaaagcacaggatgagcattacatatgttgtacatcgctcctggccttccatgtagtaattgtgactgaaggtccttatcttcccaacataaaaataaataaattaatcaaaatccaataaaatatgttgcaataaaacatgaaaatggttttccttaaaaaaaaagaactggaaaactggcatagtaacaactaaaaccaccctccttgttgtcctgcagaattcaaaactaaaaccctgctatgatggcatacacggttctgccattctcaaagaaagatactgtgctaggatagttaataaagtacatgtcataagctctatttcaagttatacctttatgctactggctgattcatattacatctatagaattgtacacgagttgagatggtctcttaaacaatattttccacatctccagcagcgagcatagagccataa

SEQ ID NO: 22277 - DNA, 912 bp, Oryza sativa
cttgtgaaatgcaggcgtcctgggtaccaactgttgaaacatctgaaatatatgtggagttgtctcttgtatccacagcttgctctgcagcggtttctaatgcttcactggatccattggttttgatgattcgctttctgccactgcctggttttcttgactgctgcttgtctcccaggttacttttggtgggcttcactggaaggtagattggggagcagctgcatgattcagctagataaggctgcaaatatgggtgcctcaatagttctccagcctgtaaatttttcagtttaactttgaatgtgaagtgttctgtcggtgcctttgattgaaacagtgaaactgagtttgtggtacttacagtgggtctatgttctgggtttttccttagcatgctcttcactatctgcttcctgccaaacaaagcatcatgtttagcataaattctgatatatattatgggaaaatcattaaaaagttaataatattggcactcacagtgatgatgaatatatcggtggcattggagatattgaagatctgtttattttgttaattaatgatgccatgtccttaaaaaacaagaggggatatttcatgaaccatgttatacgtaaacagtaatttatcgtttgaattgtgtagtaggacttactgcagctttgaatgcagggcggtgtgctaagatctcaaacatacagcatcctgatggtaaaagatgggaaaggattagcatcataacagaaaccgtgaaaattactccaaaagctgttgtactgggaactcaccaagtgaccatatatcagatttgtaaccataaggtatgtctgctagtatttctgggcacatgtagtttggggttcccacaatctgaaaaacatagatgttgaattcattgagtggcaatgg

SEQ ID NO: 22278 - DNA, 184 bp, Oryza sativa
ggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgc

SEQ ID NO: 22279 - DNA, 779 bp, Oryza sativa
tttcccagtttctcgcaatgtcggtgtatctcctggatgtaatactgtataatgaactgcttcatccgttccaaaatataacatactggtactagattatacataacctagtgccaacatgtatcctgtgcggttgatgccgctgctgatccagaccgtggttgtcctgggctcctggccggcggcgccgttggggtggcggtcagcaaaggaggcggtgtgggggatgcatgctcaccgagccaggaggccctggacagctctcaccggaggcggcagagatggcacagagatttcgacaggttgagccgagcaggcatcagtcagtatagtgcgcaggcttccgtttccgtgctctgatcagaagcgagcggctccttccctgcatcagtttctgccgcagcgtgcgcccttctccgtggaggcctgacatggagcgccagtgtaatcgtgtggagagcacacgctgcatgcggtcgtctctggcgccggcaccggcacggcggcaaccgtctcttgcgcggccgggcgcatggtatcaccggctcaccgctggtgaaaagggaaaaacgagatttggagggagagacacccctctaaatacttttttaaagaaaaattatgagtgtgtcaattgaacatgagactttagggttgaaattatagaccacttgtcactacactatcaggtgcatcttgtagcaccgccagtgtccaggtggcctccgccttcaaaaagtattcgccttgtttttgttcgcccatgcgaataattcctc

SEQ ID NO: 22280 - DNA, 1023 bp, Oryza sativa
  unsure (1)..(1023): unsure at all n locations
ggatgagatgagacccttcctaaacaacgtatttagacattagtcatgtccagatacgttgctatattctggaatgnaggtagtactatacaagtagagttcggcacaccggcatcgaattttgtcatacataccgtggcgacgtcgcgaaggttgacgagaaacgtgccggggagggggtcgacgggcgcaaactctccggtgtcggggtcggcgacctcgaggccgccaacgcggtcgtcctcctggagcacggtgagaaagccggagtccgtgtggacctgcacgccggtcttccccacggtgtcgggcgtgtagttgtacctgttgatacggaattggcacggccagtcgccgaacgagcagtccaggccgaggctcgtggccagcttcgccgcgacgtccacgaccagctcgtgcgccttctcggcgtagctcctgatggcctccctgcaacagatcgaacgatcgatcagagtgatggaccagcgagcgcgcactacactactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgagtgtgtattgatctgacgatcaggttgtctcatgcccctagaggggctccctgccctccttatataggttggggggcagggttacaagatagaaaccataaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatc

SEQ ID NO: 22281 - DNA, 1732 bp, Oryza sativa
cgatgaccactaaaaggccgtcgaccactgggctaagaaatcagttggcccatggaagaataagctagcctggtagctgatccactgtaaccaaacaacgtggcaagattatattgaatgccggttgcctaaatcgcccggagaccagctaatccagcacctttaagatatctaatatatattagactagttaagacaacaccctacgaatagggtttatccccaaacattatgctggactttttttcatgtacattgctgacattatggtaggcattcagagactaaaatgtaatcttcttcctgattaaaaaaaaaagttgcgagcacatggcggcctggtcttttcagatcattcatcggattattaaaatcatgatttgctacatgctttaagaatatgtttcgtaagaaattttcttgtacagcattgattagacttgttagtttatttcttaaaatatccaatctgtttctataattaaacagataatatgtggtaacaatctgtttaattaataatgtaaatcaaattagagcctatgtatctcaaagaactgagccttaacttctggaaacaatcatgagctgtacaagtttgtcatctattttattattttaatatgatatatgagaaacaaatttattatattaacatatattttatttctgattttacccttacaaaatttctactgcccgtactacagtgatacagtcaatgtagtcgatctaatagaatttgatccattagattcaaagaaatggatggctcataaccatttgagggtagagtaaactaaaaatctctacaacagccaaggcaccaaatgtatgtccctcctggtcgatcaggatatgcagtgctcagcaccaaatgtaacttgcagagttgtgttcactgtcgtcgagcatacacacacatacatacagccatacaggacagcggagagcagagcgctcaacttgatggcacaagtactaccgcagccgaggctacacaccatgttaggccttgttcttgctcgtttaatccgtcctacaaggaaattgcggaagattcgaaggggaataatttcacatctattcaggtgtagaattaatctctcaatccccttcactttcactcttttgaggatgaaccgaacaacctcttagcaacagggttttaaatgtcccgctatagctgccgctatcttccgctatagctgtttgagaagggttctagctatttgttctcatatacattttagccgctatagctccatttagttcgctatagctaccgatatagctgtttgagaagccaatcgctaaatgccttaccccgctatttaaatcattgcttagcagggggagaagccatgtgtacccggtcatcgtagtggatgcatgccatttccccgaacaacgaccaagcttgaatagactagccatccatcgatccacgccatggaagagagggcagaggagtagtgcgcgtacgcttcccttccagcgtccagcgcggctcttctgggatgtcatgcattgccacccaaccagctgacaaatacagcctagatgagccattcccttgggcacaacaagcatcttactagcagccgattggtttggttttggtggtgcttcgattcccagtgactcctaatccccattgatcatcgacaaaagatttgagtgctatatatgcacatgtgtgtgtacaaatgtagtacatgatcagtgtttt

SEQ ID NO: 22282 - DNA, 622 bp, Oryza sativa
caaaatcttttgaaattacatagtttgtaccaatcaagagctaagaatgtttgaaaatgccatccatctacaactatgtaacgattaagaatgtttgaaaatgcgaatacgggtggggaatgctcctgcattacaaacagtaagaacaaaatccgtggaccattctatcttacggcagattcaactgcagaaaactaagacagattcaatgcaagacaggaacacttttcctcgttgaaaaataataaaataagattgtcagcaagtgaggttacatatcgcaatctgaaattgatctatgcagatcaaccctgtattacaccctcgttgctcaggaatgccctggcaagtttcatttgtagttaaggagacaaaataatcatcatggggagctcataggaaccccaaaatgaacctaaaataacccgccatccaacagcgaatatgaagatcttaatctttatgtgaatgcgccaggtattggcttgtgtacttgtccaccttcggtccagatgtgccgtacttcgcgtcatagcactctaccattgcagatccccctaacgctgctagtgttagggcttgagcatgcaacctgcaataataacagttatattaattaagt

SEQ ID NO: 22283 - DNA, 629 bp, Oryza sativa
atgtacctgattcacctcaataatttcttgaatgatcctctttagtgcaaaatcataaatggcaatcgtggaatggttagcattagctatatcttgacggatttgaatcgcttctcctgtcctggctgccgacccatctccctgtcaaacgccaacatgctgatacaggttgatctcgccgtctccgtcgccatacgctgccacctccggtggtgcgtccaagtcgtcgtcatcgtcccacaacaccagttgcaacggcgtcttgttgcccaccgcgttgatgcacgtcatgggcaccatcggcgcctcgaagctgtacatcctggtgacagcccgtcgcctgaaaggctcgacgcgctcgccgaagccgagggcggctcagggttggaaatttcggtcatttcggtcacccctgatacaatattatttcggccgaaatttttcattttttcatttttttcatgaatttgggtaatatttgttcaaattcaactaaattttgctcaaattttaggcaatttcggacaatttccgcaatttcgggatttcgcccccccccccccccccccggggggatacaaatggcttaaccggggggtaggaaattcttcattacgtacgcggggtag

SEQ ID NO: 22284 - DNA, 491 bp, Oryza sativa
aataggtactgaatgagttcaatgtaccaaaataacagatggaaatgataagttttgcttactcactgaaggagaggctgtatgtttaaagttgttgactgtgaaaggttctcaaagttgtacttctcatcagcagcatgctagtaagaagaaaaaaacattaatcaccagacatgactacataaggtatcttgaaggtgcaacccagatatccaggggtttatacaatactatgacatcaattaatagaatatgtatagactatagagagatacctgatcaacaataaataggtcctggtccagctttccaatgataaaaccaagattaaactgcccaacaacctgaaggtgtactagttatttagtgttcataaacttctttagcaaagtactgcaaatagaaatatagaattcatacagcacttcttttaatatttcatcctatttagaacaatgaaatcacaccactcaagtaaaaaacaaatgttc

SEQ ID NO: 22285 - DNA, 1629 bp, Oryza sativa
  unsure (1)..(1629): unsure at all n locations
cacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgatttcaccgccggcttgcctccgtcgccgccgagtggtgcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgccttcgtcgccgncgagtggtgccttccgctacacggctggcctattatgccgccgctgttgggcgtctacgacttcaccg

SEQ ID NO: 22286 - DNA, 1840 bp, Oryza sativa
  unsure (1)..(1840): unsure at all n locations
ttgggcgtctacgtcttcaccgaccggtttgctttcgccgcggcagactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtcttcgcctatacggttggttggtcacaacaccgttgtcaggcgtctacattttcaccgaccggccgccacgtccgccaccgactggtgtttccgcctgcacgctggcctattatgccaccgttgttgggcgtctacgactccaccaccggcctgcctccatcgccgccgactggtgtttccgcctgcacgctggcctattatgccaccgttgatgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtgtcttcgcctgcacggctggcctattatgccgccgctgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgccttcgccgncgncgactggtgttctcgcctgcacggctgggctattaatgccgccgttgtgggcgcctacgtcttcaccgaccggctcggcttcg

SEQ ID NO: 22287 - DNA, 3765 bp, Oryza sativa
cgccgccgactggtgtcttcgcctgcacggctggcctattatgccgccgttgttgggcgcatacgtcttcaccgacggctcgccttcgccgccgccgactggtgtcttcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgccgccgccgactggtgtcctcgcctgcacggctggcctattatgccgccgttgttgtgcgcctacgtcttcaccgaccggcttgccttcgctgccgccgactggtgtcctcgcctgcacggctggcctattatgccgccgttgttgggcgcctacgtcttcaccgaccggcttgccttcgccgccgccgactggtgtttccgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaatgccatgatattttactacaaccagtgactctccaatattcaggatttctacttggacaccttcagcacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccaactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcatatcagaagctattcatatgagctacacttggtctatattacccggaagatttattactcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttggatttttaagcaattgattagatacaatatcattgcttttcgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcattcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacacttcgcgggattcaaatccccaac

SEQ ID NO: 22288 - DNA, 27161 bp, Oryza sativa
  unsure (1)..(27161): unsure at all n locations
aatgtctaaatacgttgttttaggatgggtctcatctcatcctagattgatatattctgtgacggagggagtatatgatctttgtctggtttcgcgtacgtgttgtgagtttggcgcgcgggtgcaggcgtggagcaacggggagctgcacaacgtgaggcaccgcgttcggtgcgtggcgggggtgcagcgcgtctccatcgcgctcttcctgctggcgcccaaggacgacgtggtgcgcgcgccggaggcgttcgtgagcgccgagcggccgcgccggttcagggatttcggctacgacgactaccggcggctcaggcagtccaccggggagcacgccggcgaagccctcgcgcgattagccgcatgatgcagtaataatcacctttaccacggtgtgtaccatcatgcagtcacatacgggagtactacaattgagaggtttacttacagtatatgttcaaacgggagcgggtgtttactttgtttgatgcactgcatcaattaaaatattaaaatatacttgcattacaaaagttaatttgttgattaataatacatgaacaatacttaaagttaatcataatttggctctgtttttgtccatttgagcctctgacttactcaattgatgagtagtagtgagcgaagtaactcatctgagcaaacagaatccagttaaacggttgatcatggaaaattttgcttagtaactagaagtaagaaaaaaaagagagttggcgaggagggtaggttacattgggacctcctctatatgaaaagacctagccgaccataggctcgaccggagaccgtggtatacgtcgaggacaagagcgcaaacgaacttaatcgccgacgacctgaacagacatcacggtgtgtaccatcacggtgggcgcgcaccatgcctaaacactgtcactcgccaactctcctgccctccaattcaaccgtcgttggacaagcctgcgctaccgggggatggccgcggctttatcgggcgcgcattccgcgccggaaaccgatgtggggactaaactctggcagtggcgcactccgagatgacggtgggcggatcgatgataatcagcagcttgcctactccctccgtccaaaaaaaaaagacaaatcctggatttccgtgccaacgtttgactgtccgtcttatataattttttttataattagtattttcattgttgttagatgataaaacatgattaatactttatacgtgacttatctttttaatttttttcataatttttctaaataagatggacgttaaaacgttggacacggaaactagtgtttatctttttttttttttgaacggagagagtacttgcgatcgagtcgtcttctattccgaactgagatgtctcccactgcccccacacattgtgattgatgtgtcgtggtgtggtacggtgtggctgctactacagtggagatcaatttgcttttcatctttttaatcgaatggattatttgaattttcaaattttgcatatgctgtcttagctcttaacgcctgacaatttctaagttgacagggatccggaattttacatttgatgcattattggtctaatatactactccggagtatatgctgtgtcgtcacatacgaacgacaaactgtgatacgcgcatgcatcgaagtgatgaagcactgcaagctgcatgcggcttagtacacacacgaatgcttagcaacatgcatgcttgctctgttcctccgaatgtcgtttcatggtgaggcatagtgcttaactgaagcactgcgaaccgcatgcctgttagcacaattcataatcatcacgaaacttgtggatgtgggtatgtttaattaggaactacttgcttcgttttaatcattttagcattgccaaaaacggaaagacaatatatagaaacagaggaagtagctggtatcaaaaacaatatatagaggttcagaagaacaaatgaagaaaagagttggcatcttgggccatactccagtgcaacagcacccaattcaactgtcgttgggttagatttgtccagctggcacctatagagaaacaaaataacaaaagaggcaaggtgtggtttagagaaataacaaaaagagttggtagtgggggtttaagtgggcgaacccatgcaccacgaagaaggctttgcagcagggtggcgaagcgtaggctcatctcgtgcatcggacagagactctgtcctttgccatgagtcccgggggggaaccccggctccgtggaaatccaaagctgcacaactatcgggcctgggcttgaggtagagagccccaacccaattaacccgccagcctatacaggccgaccagcctggaccaaatacgccaagtcccctactccgaaagccccaatctcctctaccggctcgacgcaccgacctaacaccgacccaactccagctggctggtaaatttctctcgcggggggccttctctcttggcccgcgaccccatcagtgagtgagtacccattttctcttatgggcctctttttcaacgaccggcctgcaacacagcaggtgacctcggtccaacaagagcgcgagcgcccccacgccttttcttcccatgcaactatctgacggcggcggcctggcgacttccccccttccagggcacgccggcgcgcgtccgatttagggagggagagtttcgtttcggcgacctcgaccccggcgatttgccatgggctcgagcccacaaaccccaacaaccaactctttagccctccgaaagctggagtaacaggcacgcgcgaccgagcccggctggtggagatggtgggaagcgcgtatttaagctggtcttggcgtcgttcggcaagcggtatggtactaatcgagggaatagtgcttgtagaggacatcggtagtgagaagtgggtgcttgagctgacttgaaagcccatcttacatgggcctcttccttctctgtttttgtctcagggaaacatccgagatctgcagctgggcaggccggcacggagcccgcctctgggtgtccacgaatccgctgaatccccctggtgttggaacagcgaagcttctcgttagcctcacggcctcacctcaccatcgtcaacttcaccgagaagcttatgcaaacagccaaacagtcttttgcttccctgaccagtgaaagtcttgtgtgactgacaatcatgttccatttgatcatttgatgcattcttctcataactctgattaagttaattggtgtggtttctcatggtactggagttgcacaaggtaagcacttgagtaggcgtaatgatgggcggaaaactgatcgtactaaaaattgtgcgctctcccgggctaaatactacaaataccctcatcttttcgtttatatttatacttataagtcaaaatttaaatatttcacattaaatttgaagctaattttgagggtttttttatcaaagtttatttttcagcctttacttttattactaagaacacataaattattatcgatgggcgcgtaagttgattaattgaagtagaaatctctagcctgtctccgaggtagcagtcacccagtagctccgtcacgctgcctgttagcttgcggttcaatatgcgttgtgattacaacaggcaaaacattgagcaatccatttgtatacatcttacaaagacggtgagattagcacggcattaccctgcggataaggattgaatatggagtaccgaggtagcatgtaaatggcatggctgttgtgcgttgtgccagggctcattgccatcacgtgttcatgcttcacacgtaaagtacatacagacgttgtaattagatttgaagatgtgtttattgacaaggtattggcaaaacggccgcagaacaccaatgtctaggtcggcttgaccaactatgaacaatgttgaaaataaccaatcatggcaccctacgccagggcaagaaccatagccacactcatcaatcttcaactcgcaattgcagcatagggcagctagtagttcggaatgagaatggacaattgccgaatggccacgagaagttagaatccggcccaccctgatggttgctccactttcttcgctgctcctgagctgaatctctgggaggaactcccctgagcagtgggcctgttgatctgagcggcagtactccctggtgatgtcctgaaactatctggcccgaaaccccaaccatctggtgattgtcttgagtttgcgttccttgccaggttttgcgctccattggtagaatgatcaacctttggtctgacctgagcaggttgagatttggggtcagggaatgcctgccatgttttggcttcagagctaggtaatgagtttgcgagcattccttgctcaagctcccacaccgttccttcaatcttctccttacgctacatatgaatgcaagtctcaggtaagattctaacagaattaagaaataggttaaatacgttgtaccagatatacaaacggagcacgaacctgtggcccggagtctggtaatcttgagctgactttgcttgatggaggtgtagtctcggcaagagtgcgcttgagctcttgaatctcctggcgctgggagcggcatattgcagacaacttttcaaacttggctgtcatctcggccttctctgatgatgttttcttcaactgctccttcagattggacacttctgcttcaagctcagattccttactagcaacattggtcccagaatggagattgtttgcttcaaaatcagcgacaaagctgttgaagggatccttctctgattttggttgtgattctttagttttcaaagaactttgtgactccatgaacagatttgtgttagcaccacttgcaagcccattgtttgatacagagttacttggtgtaccccggacagcctggccagaacgaccatgtctatctccaggggcactgatgctgatatcccctctgctttggttatgctttgatgaaggtgatggttttattggttcctcatcaaacaaagagttcctattatctgcaacttgagaaccctgtgcatgctgtgttgcccaaaatgcacctagaggtgcatctcctgcctttgagcttccatgagataacgaactattggattgttctattggaggaggaggcgggttccttctaggcatcacatgtgttcttttataagcacctatacaagaaaaaaacaagacaaggctccaattatgcaaacaaattattgcaatcttacatgatttggtggcttctgtctgaattgacaatagcaaaataatgcagtaagcctacctcagccaacaatcacactatcttttagaaaatatttagaactaacaatcagactagaacagtaaatgtttattctagcatgcagtgcacatcatgatggcatggcacaaaggctgtatatcctagaggacaagaaggtaggtcatgacagaaaggttgcttagcctataggacaagaaaataggtcaatgacaaatgcagtgaagcaatgcccataatcataacatccaaacaaatcatagaggatgccaaaagctccctgatgagaaaaagatatacgagtgcataagaaataccaaaaaatatgtttatttgaagatggcccacatacatttgaagcaaccccacatgaataatgaagtgcattctagtgccaatagcatgtctttcagcataccttcatcttgcaaactcatggaaatgcctgacgaagctccatcgggtagatttttctgtaactcgagaggtagtagttcatttacacgaaaccagacctgtcaaatgtacaaagtctaacatcagatttagaaaaatatgcttatgtggttcctaaggctacatgcaacagtctatgactaacctagtatcatggagatgaatggccaatcaatcaaagctcttgcctgcgtgacatcaggtctgtcatttggagaggcttccagcatatctttgatcaactttgtgacagcggcactatacttgggttgctctggaatacgataattgccattaagtatctgcaacttggactctccatcaaatgcagacttgaagtagcatattctatatagaaggcaccccaaggcctgccaaatgtcaattcaaaaaaattttataaacaaattcaccttggtttgaatataatgcattgcaggatgaatatatagatttcaaaaattaagaacagtgtgattcaccaagatgtatctaaatgctaagtagatatgccagcataataattaaagtggatatagcatataatagtacttgctgtgaatataattacacttacccagatatcgactttctcactaataacttctcttctgtaaagatcccacatctggaaaatgcatccatggggtcactgggggttacacaggttttaaaaactataaattactccatgggcaattgtttctttacctcaggggccctatatgctggggttgtatgcttccggatgatatcttcctcaatccccatctcttctggcctatcaaagcatttatggtttgttgatgtgcttccaaaatcgcacaatttccatgcaccgtctaatccaagaagaacattttcagctttcagatccctaaagaatcagaaaagaggcagaatgtaagatgcatgtaggtgataaacaataaagcgattgctataaaaccaggtccctcatttacacctaatctggaataaccctaactgattatttgtttgcatatgcccagccttgagaaaatagacaagctacaaggtgcaggagttccgcacttcacaacagaacataaatttagtacatacacagtttgctaatataccagcaattgcttagtgaattcaagtaatctaatcaaacagtaaaacagaacagcataactactgcaggaacgtactttcaaatacttgataaaagcacataaaacgttctagcaacgatgagatataactatctttgatactttaattttttttttcaacatacctatgtgcaattggtggtgactgaccatgcatagcaaaaactgcattgcatacatctctgagaatcaaaagtgccttcttctcctcataataaccagtacctctgctctccattgcgctaaccaaggacttctcacagaactccataacaagtagtgcctcctttgtgcggcccatatcaaaaacatcatgggcaactagtgtaaccacattaggatgccctttgaggaggttcatcacctggatctcctccattacaagatcaagcaattctgagtcgttgcagatgatgtgcttcattgcgtactgctttgatggatgcattgcgtcggatgccagatatacacaagagaaacctccttgtgcaatagcattgcgtactgtaatcttaatgttgccaacatcaatggtgcgaccttccaatccattttgtactttccccccgaagggattgaacctccacattatttttttttccgcgtgcccctacgaatataaatgaaaatccactgtttaatttttgtcagtgcgctcttacaaatatttctgtgtagataaaaagaaagagtgaagctccaatatgcagtaagtaaaactgtaattgtaaaagtatagcactatatctgtgtactacaagattaaaagaaatactagctgctcaaacaaggttatcaagctccatcacctaggccctaatacaattaccgtttaggatttttactaatctgaagatttaacatagcaactgcacatggcacacccagcagttaaggataaccacatttgacaaaggtaagaaaataagaagtaataagccatgtcatgcaatgagctgaaattttactttcggcctgtctgaattggataacatagtattaagctaggaccagcaaacaaaacgtaaattctttgttaaaaagaggagaacccatattctctgtaactaattaattatttaagggtaatccaagtatccaagtgaaccaaaatgggtgtgactagtcacccacaggtaaacccgattgctggcacagttctccactaagatatctgatataagcaatggcgttgctgtgaggcactaactccgcagaaatcacagaatccataagaccgtgtattctaaactggttaatcctaagcagagcggatgctatgaacacatctgcagtacgatcagcctcatataagatcatctcgtcgaaaccgctgtgcatcctcgataaacaccagaagtaaagggaattcgtggtgcctttcagccagatttcaaccaagcatctaaaataaccaccaaacaaaacaaccaactaaatacgctcccgtgccacacacccccgcgcgcgcagatcgctgcgatcccattcccacgcacgatccaatccaatccaatccaaccatccctccccatgccaaatgcagatccgagcgccccgcccggtgaaaccgaacctacccacgcgggcgggccgcggcgtcgcgttccccagcgaaacgcgaatcgcgcggaagagcttggccaggccaggcgaaggcttacgcggcgcgcacctattagatcgaaggctcctccgtactcctctggggctcgcgtcctcgccgccgccgccgcccgcgggcggattcgcagcgcgatctgcggtggtggaggaggaggttgctgggggtgcgcctgcgttgtgatgcgacgcccgtggaggtggaggtggaggcaggcgagggagggagggaaaaaggaatggacgaggggcgagacgtggtgatggatggagtggtgaaggtggaggtggtggaaccgtggcgtggggagctttgcagttgcagccttgcagggggtgtggccgggtgtgggggccacgcaagggggtgtgggctaaaatattttccttcttttttgcgcctttttgttttcgtttttttttttttgctcgcgtcgccttcttattggcagcctcagcaatcaaagaaaggtgttgtaaaattccaaatcagcatcatcccaacttgacaggttattagagcaaagttaataatacagctgacttgttgtatgtaagattctttatagtcttctctcagcccacccatataatagttagctctttataattaatatttcatccgtttcacaatgtaagttacaattaatgaatctagacagatatatatgtctagattcattaacatcaatatgaatatggaaaatgttagaatgacttacattgtgaaacgaaggtagtacatggttaatttgtcttctctcctctttctctgctctacctcggtatttagttggcttacaacctcctattatactttctcttagtagttccaaaatgcatggtgcattctcttttttttattttagatgaagaaatttcagaaggattgcaagtcacaaaatcgtaattttaattcaaaacaagaaaatcaattagtataacacaagcctgaaggcagagataacacttgcattttcgaatatggatgcaagaatctataaaaccattgtgttgtctagtggcttataagttgcatatagtcattttatttctaaaactagaaagaagaatctctaaaattagcggccattcattataccagttatgtttggatcacatcaaaccgaagcggaagatccattagtgtagcatcgcctctacaatgaataaccatacatcatctatatgccattttgaagactagttgttgtttgattcatagccttagtttgccataacattagcacgcaggtttaatcaacttagcccaacgtttggtttgtttacacttttcatgtgtcataacattcaacttagggtcctcgcttgtgtactattcatagccaaagtttgcatagctaatagttccttagccacaaaagttgtggcgtgccgtatcttagctcaaaatatttggcaaaataatacatgcaaccaaagagctcaacacaccgatcagttctgcaggaccatcatttgccttttgacttatcaattgcatacaaaaattgaattgtgaaactaaattttagagttgatttgtaagtttttttaatcgtagttttattctggctttcaagtcgttaagaacatggatatatataagtatattcattatttttttctattaataatccattttatggcttactagctgtagacaaggtttgctaaaccgtccttatttgtgagggtatgttaagagttattgcaagtagggtttggtaaattttgttcggatccaaattatgaaaaaaggataaattctcctaaaatttataggatcaatacatgatttgcaatgatatctggtgacaaaactttataaaaataaagctaattctatattttggcatgactaaaaggcaacattggtccaaaatcgatgtttgatgctcgtgaatgttatatgtgaatgctataatcatcatagttgtagacattatatatttctattgtcaaacgtggttttttcccgtgattttctttttatttaagtcaaaagagcatgtttaccacgccttatcgtgctgcgattgccacgacataaccacagtaatcgcgatattgtcataagatttaaattttgatatttaaattttagaagataaaattcacatggtctttagcggtaaccaaacggttaccgtgataaccgtcttattgtggggtaacggtaatctcccatagatcatatgagaaacttggttgtaggttaaacgattaaacttgcgttgaaaattgacgatgatcgaactctcgttaacaaccttctaaacttgattttaagtttgaaaggcttgaacacaagtgcaacattctcaatttcttatattcgaaatcctggcaatcccttttaaaatcttgggagcacttgtttctttgccactacttgcggttgaccggtactttcacgttcgaaacctcaaccaaatcatggtggtgcacggttttcgggtttggtagcatgttgttatcgggtaccacagggtgccccatcgcaaatcgagaatgaaacagagccacagacaaacacagaggtgcgaagcttcgtgaaaaaggcaacgcgtcggtgcgatgctgcagtgcagtttgcctttgtgcttgtccagatccgacaaaatttttcgctctgtcagatcaaatattaaatataaaaaaataactaattacatccgtggataaattgtgagacgaatcttttaaacctaattgctctattattatttgacaatatggtgctactgtaaacatttcctaataacgaattaatcaggcttaataaattcgtttcgcagtttacaaacataatttgtaattttatttgttattaatttatatttaatactttaaatatgtgtctgtatatatgatgtgacgtaccaaaactttacacccataaatctaaacgccccctctggtgacagatcgaaacgttggggctatatctgtcacagacaaattcggtgttactacagcggtgcatgtatcgtacatttgtacgtgtaattcaagcactttggacggatggaccaatcactgatcaatcgatcatgtgacttctccggctcaagaggtgacagcaaaacaacatgggcttaacagatttaaatatcaacctaacatgcccttacacccgcagtgagcagtgaagatcttcaactagatttaaccatttataaataagaaagcataagtatagcttaagaaatgctcaaaataaaaaatagttttcaaacaattgtaatagctattttattcaatgttagattaagggttgggaaaagaatatttatagtttaaggttacctaagagatgatttttaaggaggtaaaaaatatcaagctaacaatttttaaagaaaaagtattaactacagcaaaataaaccaattcggagagaaagtactctctccgttttactcagtgtcatattatttcttagtcaaaattctttacattcattcaatcaaatttatagaaaaactagcttacattcattcaatcaaatttatagaaaaaatagctaacatctactctattcttacacacaagattggctttatgggcatcgagaaatgcaaatatgtagattggctttatgggcatcgagaaatgcaaatatgtagaattaattattcttgatctgtagatgaaatatgactataagaaatagatgaagagagtacgtcattctagcattttctctaatattaatgaatataaacatataaatctctttaaattcattaacatcaatactctttaaattcattaacatcaatacaaatgtaatacgaatataaaaaatgctaaaataactcacattaaatcgaagtactacaatttaattttattttatattaaacatattttaatacaatatttgtttttattataaatattactataatttattacaaatcaaatttgaatttttttaaaaagagttctatttaattaactatagctaaatttagatttggtattttgtgggtagggaggcccacacaggcaagtcctgcaaaagtaagcagtgtcaatacccgcgcgagcctcttcccctcgcaaaaattgccgtgcagggtttgagtcccgcaccgcgagcggctctcaccgcaacgctttgttttccttactcattagtttaaggcaagttttttcgttgcacctcacccaccttatatagcaccagccgcaccccgcatctcctccggccagcgaggtgggattattcaccacattccccctctcgttcgttgcgctgtgtcgaccatatatgggccgtggtggcccattgacctgagagggttggagcccagccgtaaaatgtgggccgcactgcgtcggcccataactagatgcgaacatgggctaggcccacttaattcaggtctctgaccttaaaccctccgctcgcctcctccgcgaagcatatacacccccattctcttcctcgcgccgccgccgccgaagcagctgcgaccgccgccgccgcgattcgagccccagccatggcgaagaagcggaagcgctcctccgatgcggcggccgcggtggagaagcccgacgagttcgcgccgcagcgcccggagcgcaccctcttcggcttcaaggagaagcccgcggacgacgaggaagccgaggccgaggccgcctctgagggagaagaggatgccgccgccgccgccgccgcggcgccgttccgcaacaaggagaaggtgctcgtgacctgctcccgccgaatcaactaccggtgagtggcgccgcaccgcgcgctcgtttttttttcgttcggtgtgatgtggcggcggatagatcgattgatgtgtggatgtgttgtttttgtggggggattggggtggtgggttttgctcgtaggtatcggcatctgatgcagaacgtggtgtcgctgctgccgcacgccaagaaggacagcaaggtcgagtcgaagcagagcaagggcaatgcgctcaacgagctgctcgagctcaggaactgctccagctgcctcttcttcgaggtatatatttacacatatactgctacgatctcaagttgcttcaggcctcatctttgatgcgctgatggttgcgtgcttgataggagaagcatgcaataggattatcactagctgttgaatcgttctatacttctgttcttaacatgcattaagctagtgatttgtagttctagcgctaaaacaatttcactctttagtaattctatatttcttttctgctgcggagattactgagctactacttcactatgataataaagcttggagcttcaaattctctgttcagtttagaccttagtattgcaattctgatggtggaacttcttctatatgtatactacagtgcagaaaacagaaggatctttacctttggatggttaagtcccctggaggaccatcagtgaaatttctagttaatgctggtaagtatgtcaagtatttgtgagctgtaatctgtacaagattatggacattattccatcagtgcctaaatgtccagtaatgtttacatgcagttcacaccatggaggagttgaagcttacagggaaccatctgaaagggtcacggcctcttataacattttctacaaattttgatgaacaacctcactggcagcttgtgaaagaaatgctaacccaggtgcatgactgatttgatatgttattttgctctacatgcattcttatcaatgaacaagttgatcatgcactagactaaataactaatctttatcaacttattgtgactttagtcttggttttttgcctggtaacagcgttcaaacttgagtagttgaattaaatacatgttttttgataatgtcttattgtacttgtagaacccagtttgtgaattcaattcacaagtattgagagtgttctgttgtttatggactagcctgtaggtatctgctgtactgtctacatgaaacactttacatccatttttgacatgttgataactttgattaagaaagtgtaatccttttaaaaatctggttctagacttcacaattttttagtactttccatcatacacctttttcttaatgctgtcagttttcagaattaatatttggtcatgatgccaatatgaatgttgttttagctttcacatgttatgaactttatggagaactgggggaatgcaatccgtgatgaagttatacatgcttcttttctagtaaagcagttgagaaacaaacttgccctaaaaaacataagaaactaactattatttgctctgcagatatttgctactccaaaagatcatcgaaaggcaaagccttttcatgaccatgtgtttgtcttctctatcgttgatgaccatgtttggtttagaaattatcaggtaatatattagtctgtttgttttcttaattttcattaactcctgccagttacaagcaatagaagttcctagcattgtctgaatattaccgtatgatcaactttgtcagatttctgttccccacaatgagattgacaaggttgataaaggaggtctggacaagatgacacttgttgaggtaaaggcgcatagcttctatttgtataatatttttttatgtttccaagtttagtttcagttttgagatcgaacttgctgtgtaggttggcccaaggttctgtttgaacccaatcaaaatatttggcggtagtttcggtggccctacattgtacgagaatccattctatgtgtctcccaatcaggtatcccttttttaccaccaattgattgctgtgtatgtacaatacatatttctgagcatcttaggtgagcacctgaaaatgttaaagcaatctaggtttgtttgttctggtcatgcttacgctttcttttgtgtatcattaaatggaccaacaaaagtttttgctgttgtgtttgctctgttcattgattcgtctaagcattgtgattttgattcaactataacaaatcatttaccctcatgttgcacgactgcacgtgtagttcatatgtttattttgttatcttcgtcagatccgtgcactagagaagcggaagaaggccggcaagtatgccaagaaggtcaaggctaaggtgaggaggaagatgcacgagatggagaacactctggagcctgatgaatttgctgaactttggaaaggggaggactagttcagctatagtgattgaaccatcaacccccgttaaactagttgctctcgctgtcacccgacacgagttttgtttactatatctcgtggaatttcttgtatgacaccatgagtctattatttacatgaataagattttagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaacttagcaaaacaaaacggacggattagtttcatgtgcgtccctgatatatgtctgagtttcatttgcatccctcaatcatataataaaaacgtttattttacattagttttacgagttggagtatactctatatctggttttgcatccctcaaccgtaaaccaaatatagattacgtccattttgtacttagttttacaagttggaggcatacccagttttgcggttaagggtcaagcaatcaatactttttgagggatgttaagtggactttttttccacggccgaaacataccgcgtgcatacgtgctgcgttaaacgagcccaagaccaaaatccaggagagcccaagaagctagggtttccgcctccacgccgccgcacgtatataaacctgcgaccaaaccctcccctccattctccttcccaccccaccgccgcctccaccctctctctcgcgccgcagcgaagcgcctcccgcagcaatggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggtctcagccatgcgaccaactatcggctgctcgtgatctatggatcggtgttcctgagtgatttttatctgtttgtttgtttgtttgcgtgatgcaggtcgaccatcacgccggggacggtgctgatcctgctcgccgggaggtacatggggaagcgcgtcgtgttcctcaagcagctcaagtccggcctgctcctcatcaccggtaaaccccttcccgcctctccccgtgcctgtgatactgcgatgattgattttggcttgtgcctgtgccatctgggaagcttgtagtgtgcggatctatgaattgattttgtatagtggcacttcgtttgttatttagttcgggaattgtgaaatcagaacctgtagcttatgtcgatttatatctgatgcaaatgtgagatttattccccaatttataatcgagtgttcatttccctaatagatactgtattattcatatccatgcgattgagtcatgttaattgttagtagtaacaactgtattattaagaaataaaaccaaataactcaaaaaaaatgtagggctaaaactactaaacttttgatgttactatgttctctaaaccgcaattttagtgcctactctgaattgctcataagagctggtctttcaaacaagcagggacaatcaatccatcatagttattttggcaaatattgttttgttaggaatcttttgcctcattgatatagattgagctgaaatttgcatctgtaatacaaagatgtaaaatggattgtgctgttttttgtaatggaaattccatataacatgcacactgaatgcaaaaagggaattgtatatttttgccactcaccctctggcatattttgatgtttttagtagaatgtaatagtctcactttgttttaatcaagttaatttcattttgatgggatctgacctaagccaggaaattggttaagctctgattacaatcaatgaattggttgggttcagatttttacaatcaaagcactggattttggcctaaattcttattgttctccttcaggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggtatgtcttgattctgtatggcattcctccatggccagttaccggtttagctccaatgctaactcacctgcctattctctgttgaatcttataggcaaccaagaatctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaagttagtcggtacaagtttcaagttctgaggaagtctttttgcctagtgtgtttctgtacttctgaattttgtacccgggtagtgaactctccatttctgttgaagtctgcctgtcaaatattatgagaagattaagagaaggattatctactttggtggttcatggttaccgtacctactcaaatgtgcaatgcataacatttgagccataattaagctattgcgttgcaagttgtgtactggtgtctatttgattttttttttgcttgtttccgcgaggttaacttatttaactttcagtgcttgatgcatgccacttaggccggtgcaatgctgacgagttgcccttaacgtttcggttgtttacaatttgtttcaacttgtttacggatatattgatttaaacaaaaaagcatgtatgagtttgatttgcagcattagtgtatagacaagatgatctgataaaagaagggcgattgctgtggttgcaaacagtaatagcagatggccgatttcgcaacaaaacaaggtaatagcggattagtaacatatcagcgtgctcggccagattttggacatccctatggagtgtgggtgtcggtaggagtacgaggtttatagattcaagtatgcaaacgatagtgaaggtatgatctaataagagtgattgctccgtctcctcccgtaaaaaaaaaacaacttataactgaatatgattgtaacataatacaacaaatcgtaacatttataatcgtatatttgtctttttcgggatagagagtaatgaagatataagtggtattgaggtggtatataaaacggagacagggaatggtggaagtagtgatggttggttgtatgttttacatgaggaaagggaaatgagtatcattcaattctatatttgtcttttttgggatagagtgagtaatgacgatatcagtggcattgaggtggtatataagacgaactaagaaagggtcgccaccgcgggaacgtgaacggttagatcgaccctactggaagatcgaacggacaatattggtgagaaccaatatgttattaataaaaacttagggttttttttaaaaaatgctgacgtggcacggtaaattctcagtgatcccatggcatgtagagaggttaatatgtggaagggcatggggaagggcgaagtagtgatggatagctgtatgttttatatgagggaagtgagattagggagaacggattgatgagtgcatacaacgatagatacatattgttgaatctcaatagaatggacaaaaatgatttaaaaaatatgctaatagcaataatacatagtcatattttggcgcgaaaactcaaaactatggtacaatcatatttaatatatattagtgacgatgtgagtggcagtgaggtgcatatatgtgataaatgagttaaaggtgataaggcacatggataaaaggggttcttattgtatcttgtaactgtttatgattaggtgaggtgatacttgttgtgtatgggaaggatggagaatcggaggcggtggttgttcatttccagtatgttttactcaagaaataggagcgtgggagaacggatcaataagtcgatgtaatcataaataaaataccattgaatctcaatagagtgacaagtcaattttaaaatatgctaataacaataataccttgtctctttttatttgttatgtgttattttggcgcaaaaacacctaacaacggtaacatcatgtttacaatacattttttccaattaaaacgggagaatatttattctttgtttctcttttctatcccgctatttggaacaacgatcactgtgactaaactacattctctattttaagattacctctacattagttttccttttcgtttttgttcaggtatatttaattgatggcaaatactattagtgcaccatagttgatgcagaaactaggactttgcattttgcttatctaaattaataattaaaaataaaaacctgaaattgatataatattgtaaataccgctctacagtccatccatacattatatatttttcaaatccttttcttttgtttcccaatttttgtgttgctgggttttttgctttcctcccttccaaaattcaaacgaagccctaggctccaaacagccctaggctttccgcattgcggcgcggcctcagcggcggccggcggcgtgggctccggcggctcgagctccggcagcgccggcggcggacggcttccttttggtcttgcgcgcgtaggttggattggatgtttttttgctgcctccgtttcgatgatttttgttttttttttggtttgctccatttccatttacagccatttcttcgccgcaggaaatcgaagccttcgtttgacgattccttcccaaagctaagcccctaccaaatggagaagttcctcgtggcggcgcctccaccttccggcgatgctccggcggcaccggttcctccgaggtgctccccccttccccgatctcagtacacccgttactgaactggattgcgttttttttttcgcttctctgaccttatctcgatccgcagacggcaccggtggagccgcgtcgccgccgagctggacggccgcatcgacgctaggtttcggcaccgggagtccgttcgcctgcgcgattcgttctccgaggtgacagaaatctcggaaaagagcatttgctttgtttccgtgttggttattacgaagttgttttcactactgggattactgcatatgagttagacactggaactggaattctctagagcggctaacgacatatttacttttttgtttctttttagtaatgctaatcataggttgtagattccaatagcaaagctgctcccttatgtttcttctgttgcaataagctggtagaagtgctagaacttgcgaagtagcacttataggatgtcattggtcgccctgatctctttccggttgctcaatgttctttcctgagctggtggtcaggcatcaggaaaggggtccctaacagcttaggcgcgggttcgataccgtcgtcgtgctcgctgcctagtccatctggaaggaaaggaacaacagggtgttctatcagcagcagcactcgtggccggacgtagctagggcagcggcagaggaggctgccttgtggagatcggcaggtctgctcccggagttgacaatcagcattagggtcgcaaaatttatgccgggacatatcacctttgtaaccttctctttgtttcttttttctgtccgggttggtttgtaagttgttgactttattccctaatcgtaatacaaagatgcgcaaatattttgcgcattctcgaaaaaacaaagctatggccctttttgatttagtagatcaagagtttgtgtcaatgtcctccaaggttcaaattggtgcttatggctctatgctcgctgctggagatgtggaaaatattgtttaagagaccatctcaactcgtgtacaattctatagatgtaatatgaatcagccagtagcataaaggtataacttgaaatagagcttatgacatgtactttattaactatcctagcacagtatctttctttgagaatggcagaaccgtgtatgccatcatagcagggttttagttttgaattctgcaggacaacaaggagggtggttttagttgttactatgccagttttccagttctttttttttaaggaaaaccattttcatgttttattgcaacatattttattggattttgattaatttatttatttttatgttgggaagataaggaccttcagtcacaattactacatggaaggccaggagcgatgtacaacatatgtaatgctcatcctgtgcttttttaaaaatcttttttagtgtgcctctcccctaccttatttctaccgacaaggctcattatgtaccttgtaatgttgaatccctgttcgttatttgactgatgagttctaccattgctcctatcagatgaatcgagttgttaacgattcagtcctgggatttcaagcagtaaggtcagcatttttattttatgttatttgctgtatttcattataaaagcacaattttaaactttaaagtagttggctagttgctataatctccttcctagagtttcactctgctgtttgtagccatccttttaatacactaataaccttgccttttttttttcttttggcagagaggggatttcagcaatggaatttgataaaaaggtagcgttgaaatgtcagttcaattttccttgtttagcatgactgcctactgcaattgcttgtaggctggaacatatatttttttttgaagactattgttacatattgttctgtaaaaggaaaaacaatatttatgcaataatacgttgtaatttagaataatgccattaaaagtttcctttttcatacatgccaatgccatcgcatagtttctagtaagagacatgccattatgagctactggtgtgcacattttacctaattaccccatcttcgtcgctttcctcccaacctttctctactnnnnnnnnnnnnnnnnnnnnngcactacgatagtgcagctgcctctgccatctggttctactagatctgtcatctgagtctagcaggaggtggctgagatagagtggcagcattggaggaggatcgacagcaccattggggtagggtggatgacggtcctttgcatgcaacgcacctattgcaaagtgctggcaccttccttgcagcactggcagccatggactttgctagcagatctgtccatgtggctcccttgttggcagcacgtccatgttaactccaatttgtcttgtagcgttaggccgtccacatcttgaacggcagcctccacctttgagggatccaattcatgtctccagcacacctcccatgctcaagaggtgtgctggagatgggagtggaggaaatgtggaaactgtgggaacatgggagatggtggagagactgaaagggaggagagagcaagaaaaatggggcaaataggtcaatttggatatccaatggcatatggtgaacacatcaactttgtaatggcatgtttctaagcataaatttgtgatggaatatctaaactataatgtttgaaatgacatttatctatttttcctatataaaatgtttacacacatttcttgtgtttctgattggcagggaatataccttgcatcagttacagcctcggaatgtttacccgtgcatgattttgagaccttatactgctccacatatggtccatcacggggtaagttaaaacagagcccaacttgaccatctaagagattaaattggattatatcaagtccacagacatgtcggaatccccttatacataagcaagtactcaaaccgttatacataagcagaccaagagtgtgagtgtagttttaaaatgtggatatttcctttctagcacaaaccattatgtgtttataaaattgcttttccttgtcactgagatagacctgccttttcttgtcaatgtgatattgaagttaaggacttaattctttttccaagaatatgggtacacttctgtagtttttgttactgcattattgttggtacaaaatgatgcaattcagcattcaaacttctacacatctagttggaatatatgcatctgagagcacaccaaaagaattgcaatggtgaccaatgcatcatttccatttttttggaatgaaactacagttaggcgcacccagcagttaattttataaattgggtaaacaatttgtacaaaaaaggaaaagagacaaacagtttcaattacaaagtttataaccaggcaagaacaatgcattgtttcattttccaacaacatactctaagagaagggataaagtgagaggtggcactccaaatgttctttctcaaaagttgttataatttcttgataagttgcttttttttgtaaggttctccataactttctgcctttgtatttatcataatccttctgcaatttactgtttgttggtaggtttgccagatgaatcatcaaactatttgctacatatatcaaactcaatgcccctatgtgctgtccgatggaatccagcaaatcaagatgaggtctgtaattgtgcactagctgaatctttatgtgtgtggtattttagatttctagcttatttcagatcagaaagtactttgtcgatttaacattgatgggttcattttgtaaggatgaaccgtgtcttgtattatctgtcattctatttcttattgttgtatgcctgctgaggatagtttgtacatgtataccaaataacatggacacctgtttgatattggctatgtcccatcagtggcaaatcttcttctccatcatttatctcttataattgcattcatgctgcagatagtttgtgtatctagacaaactgacatggttctcctgtttgatattggctgtgtctcgtccacgccaactgaagtaagtgcccttttcccatttatagttcgttttgtcttctctcattacaagaactgtattctagtaactctagatcaaatacttttgctttgctttgtttgccaattttaactcaccgaccttctgttattaataatttagattttacggaaaggaagatccagatatcctgtgctctctgaattccgcaaaggtttgactgatgtagctttttcttcagatgataagtcatggtatgtgacaaaatttgtattgttcacccttggcatgccaattatgtttgcttcttttaaataatgcaaccgtaaatgcataaactattgctagctagtatttgatgtaaagcttggctgtgattgacagcatattgtgttctttcttaatttagaagttgaggttaattttaacccctattgtacatacaatactatgtaaacccaggaattctacaaattttgcacattgcaatgatatttcttttgttgtttgggtgggcatggggtatgttaatatagaaaataggattatagccagggtatgtggattgactggattctgcttatggtggttgttggtttgtaaaagcaagctactacagagattgccaacagcgtccctcttcttgttttttaaatgaaacaatgttgttactaatatgctatgcttatttgtgctccttccttaggttatttgcatctggccttgatggagcggtcttcatgtgggacatgcggctaagtaaaaaacactgtcttgagctcataggacatccagaatctcaatttagcagtgtcaagctaaatatagataaccgggtacgctaatttagcagtgtcaagctctttgcctctttagctttctgaattatgttctcatatcgacctatctctgtttaagattctgagtttccaacttggcttgtaaattgaacttagtgttacagaattttagagatgtaaaaagaagtttggttatttgtgttaaagtttgggccattcatagatggaggctgacagtttattttctagaccgtgtttgctgcaactaaagagggcaccgttcatgcctgggatctccgtggagggagggcatcagctgcttttcaaagccataatgaggtactctgctagctcttcctcatttttatgcggtatcgcaccatcctacttgatcttcattttgataatttttatgatcatatattcagaatagcaaacttctgttcatgattttttcttttgggtctaggttcaacaattatcatcagtgaagatatcaactttgttgggcaaaattccatcgctaaaggtatgaaaaacaaaaacaaacttatgattgcgcataaggaaattaatttctccttttgcaagtttccattcttgtgagcatttagatgtttcatgtagtcacagtatcggtgagatgtgaattatcaaattcatatagagtacttattaaatacccaaatttagaattaatgctagctattgttttgcatgcaactattaagtttgatgatattgacttgcggtaactcagtagaatatagaacgccaaacggcaatgatatatccctcttgagcttgtttactcttctgaaaactgtttaccagaaaaaaaaaactatatgtatgttaacttgtcaattctcttgggtcaagttttttcttttgaaaattttgaaatcttgatatttggaacaaacctaacagtcattatgcacatctagctgaaaagggaggtcactggggatttatttagtgctttaaaccagtcagattatgtattcttgctgcgaactggcagtttgcttagtttttgccatatcaggaagtacctaaaccctggacatacttctgttgtcctaaaataagttcatttcttgccattgggattaaaattagtatggagggaaaacaacaaaatgacacatctcaagtaataaatggagggcatggtttctacggcttgtttgaagctattat

SEQ ID NO: 22289 - DNA, 1578 bp, Oryza sativa
ggtatatcatctaatgggggtttccttgctactatatatattattttcttttaacatatttgatcactgtcttcaggaccaaacgaacattgtgtcgagtgaaattctttcaatagacttcaaccctagttgctcatatcagttagccttccatcttgacaatggctggtaagtagtgtgttgcactgttattaattatctgactgtaaagcaaggttactttgttgacttattggaattttccatccaccatcctttcgggtgacatatttaattactcttctacttgtttaagtgttctgtgctatggtctagatctcagtgacaatcttttccatatgcatgttaggtctggagccttgaacattaacaccctcagtgtgagtcacctgcactgccctcctcctgattggttgtaagtagattacttctgccttcacaaatcttcttagtcaaagtaacctttgctaattggacctattgttttgttgttctcttctgtttgttttactagggagcacatgaacttcatgtggcaaaagctacatagaaaaccgacctggttgccgacatcttcagtaagaatattatagatcacatgcaattctttttattaaatttgaaacctgcatatcttgttgcaaggtgaaaaggatttcaataatgctgaataaggcactttcatttatcactgtagtcataataataaatatctcatctggcattgaaatacattggagctagatgcataacatacactttacattatccagatttatgcagttggatctgcctccaatactgttggcatgcatctactggattttcatccagatacaagttcagcatgccatgtcgactacaagtgagctgatatttgctttccttttcttcttaatttacacaatcatacattttgtcaacaatcttctttggtctttattctcacttggcattccatgtttcagtgaggaaataagaggctccgatgaaaagaaacctgcagcaaacaagtttattccttcatctcagagagttgtttcctgtgcagcacatcccttctgtcatactatacttgccggtactcaggttagttcccttccatcttcagttactagaatgacctccatctcggcgtataattgggaaagctatatgcattacgcatcagttgcagatctgagtctgttggcaaaagttaacttcttgttatcctcttcagttttcatctttgctcgtgttatcgcaaaagcaagagtctatcaaaaactcggagtagcggtgtcatggaacaatcttgatttgcctccaagacaatatctccaaatgcagtcacagtgctctacattagctcgtgggccgtcctgcatcggagaatgatcagccgcatgggagcacaatctattggtcccaccacagaggctcccaacctgatcgaccggtcaaaaagaactaaatctcttggcgttacatgattcgatcttctgccagtgcattgcctccaagatgggcgacagatttctgtgttgcaaccgaccatgtatgtactttcatggcatgctcctaggggctctgaag

SEQ ID NO: 22290 - DNA, 7370 bp, Oryza sativa
  unsure (1)..(7370): unsure at all n locations
tcctcttttattagagagcatgagaaagttgcttgaaatcatcgtagtgttagctaacagcaactgccagtcactattttctgcttcggttgctcttcccttctcttgtctagcaaaaaggatgatgtgatctgctgctaaatctggacaaaatttcccttttttttttgcccagatttaaatattgtttgaaaatttcgttcaacaatcgtgataaaaatcctgaaacctcccaaaattcagaatatgggtgccccaaattttcttttccccttccgaaagtgcaaatcagcaatgggtcaaagcatgtttgtttcagatgttttcaacagaggagttataaaagctgatgcacataaatatgaagatcggatccttcagggcacttcttcgagaatctagaattctacaaagaaatggtgtttgcatgtggctgtgttctttagtctgctttctctcattttttcgcgcgcacgcttcctaaattgctaaacgatgtgtttttttgcaaaaaaaaatctatagaaaatacttaattaatcatgccaaatcgttggaaatgttcccaactccaactagggaacacagaggattgagaagcaaaggacattggggtccttgatagaggaggcaagctaggaaggtgtatgaagctgaacaggtggaaatgctgagaaacgagaagcctgccatccaggaggctgagaaggaagaagtgattcccatgtgcacattagaccacttcttttgtgtttgttcattttcagtatcttttgtgtttgcttatttaacatatggaaaaaactgatacgatcagtgtatgcttgtttcaacttagataaatcagactggtgttcctcctacctgaattaaaatcatatattgaggtgttcgagtcattttgatcatcttttccattggaattgttgattcctggaattggagctgtgctaaatatacccatgcttgccatgccatgacgcaataaataacagacctagcacacatctcagcgtgtatcatacggtaaaaaaaaatcgagtgatagctaagaaaaatcgtttcgagtgagatatatttcaatgaaaaatcattggttgaaacagaaaattggggttacggaaaaaaatatttcaatgccgccttttctcccaaataaaatccccatctttatttagatcgtcgtaccttttcaaccaaaaaaagggaaaaatgacagttgatcaccaagacaatcttaaagactgaatcttgctaccagcttggaagcatgcaaaactgagataggcctctatgattttctagtaaagcagtataatttccattgggaaatcaccaacaacgtgcaaagttctgatgatttctactgctcaatactgtataatcaagtaaatcaggacgttatgcgacgagtcacaatgttcacaccaaagagaagttatgttctacgacagaagtgccatactgtagttaatacaataacagagtcacagaaaatcttgtcttgttagctactaacagttgtcgatgtctcaatggagcgtgcagtaaaaatatacagaagctatacacagttgaaggtctgctgcagtaagcatgtaccagtacgacgaatggtattatcaacagctaatcctatctatgccctcaagaagagagctaggctacccccccatatcccagggtcctcaagcagagatccccctcaatggtacacaaaactgagcaccatgcctcaacaagcccaggatcacagcagggatggaagaagagcagctgatgcaaagggtttggctaggactagcggctaagaaagcagcagacaagtgggaaaacctcgcagttgcaggcctgagcaggcctcactctctcctctggacagtgtgatcagctcatctcatctcatctcatctcatggacaacagggtgcgcttctggatggtcaccttggaaggctgagcagccttcggagctctcttgaggttcttccttaccatcttctctatctgctctatggagctggacagttccttctccatgagatcagcaagagctggatcatttggtctggatggtgtctgaaaggagcagtcagatggagaagaagatgatgccttcggcttgccctcggccaagtaagctgttgatgtgcttgcaacagcttgggttgagccaggacaaggggcagcagcatccagggccttttgagttggtggtgttggtgtgctttgagggacaccttcttctttttgtactggagttgctggatccacagatcgtgaagaatcttcactcaactggatctgctgccgaaccgcagcatttccgaggcgacttttcctctcaactgcctgcaaatggtaggtaaaattataagcatattgtcatggatgcgtgattatatccattaacttgaaggatgtatcagcattgttatcctgctacgactcagtactgcacaagcatatgttcaacatatgagcataaatacaactacagggaaaaaaaggcatgaataactataaaaatgacagagaactatgtacaacaaaatgaacaacaaaaccccttttctctttcccccaacgacagcattgaagcaaaatgtgaaatctggattaactggtattataataaaatgagatatataactctggttgtttgacactgcggaaaatacacttatttttgctatgaagataaggactaatatatcagctagcaagaatttcatcaaggccaaaaaggagctgttttgtatttaagcagctatatacacaacaagccgaagtactgaatatgtaccaatcaaagtacttcaaaaagttatccttaaagtttaacaggaaagtatctgttaaactatcgaacactgagtaaaatttaacaggagaagaacagaagaaagcactgtagcaaagccaaactgaaatcgcacccggtaaactacagcttgatgaatacatttagttcaattttttcaggttaagtgaatctcaaaagatatgactactggcaaggcaagcaagttaggctgttgccaaggttctatatagcacaaattccaacattgaggtatttcctcatcctctattaccttcggtgcacaccattgaaaaaaatgtatataactaaaaaatgcacctacctctataatgcaaagcagccatgaattatgattcatgataaaacagacccaatcccccaaattggtggctctttagttttagtccataaagtgtacaaccaacaagtccaacgaatcacacatatcatagttgattcctcacatgatcagaagatcattaagaaatgcaacagacatgaaatggatgaatggcacatttacatgttttaagcctgttatttcactgaacttctcagaaaattaatcagtattttatctgattactggtcacttaaaatgacggataggcatatcaaaacagataaagaaaaaaacaaaaaaaacaccatttgttcagaagaaagtccctcgttgcttcttactaacaaaattcagcgattttgttgcagtgacagaaaagatgcccaattataaccagcagtagccagaagacacttaatttgctagactgcaactattgctagtaatattcacaataggtaaccaagacatcctcaactcaagcctaatcacaatttcagaatcatgtgcacaacatttagcattaccatatcaccgtgaacatatcatgcatcaaatataacctaacctgaacacaacaatatattgacacaaatcctcaagaacataccatgcataaaaacctaaagtattaaaacatgatattagcacaaaatgaccacacaattttacaggattcagagaacatccaccacaaagcccatgggaactgttcatcaccttgacgactgatgtgatatcatggagtgggctacacgacatataatgcaaatttgtcatgaattatgatgattcatgttataacagaccgaattccccaagtgtgtacaaccaaacaagtacaacaaattagacatgtcatagttgattactcacatcagaagagcattcaaagtttaagcctgttatttcactgaacttccctgaaattttgcatagtatgtcatctaattactgatcacctaaaataagatagacagatcgaagaagatacaaaaaagagcgaagaagcatcggttggtgaagtccctcattgctaattcatttatagtctgatatgattttgcaagtataaaaaggtactaattgattatagtatcaagcaattgtgttcctcattttagtgattgaaatgcttactaacaaaattcagggactttgttgcgataagcagaaagaaatgcatatttatcatcagtagtagtcgaaggacaccttaatttcctagactgctactcttgctagtgatattcactatctgtaaagaattcaacctcgaacacaagaccaccacaattccagaatcacgagcacaccaatcttagcactatcatatcttcaagaacataccattcaccaattataccctacctaaacatgataactgacacaaatcctcaagaacacaccatgcatcaaaataataaaaacctgaagtcctacacatgatatcagcacacaaaaaacgaccacaccaatttcacaggattcagagcacatccaacccaccacacagcctacgggaatggttcatcaccttgacgactgacgtgatgtcgcggagtgggctcctcgggtaccactcgggcagggggctcctcctcttgggtgtagccctcacggtcacagcccaggacggcggcacgttctccttgttgctcgtcggcggcagggcccgccgagccagcggcttgaccgccacggctcccggcggcgacgtcgtcctcctgataaagaacccaccacccgaggggtcggcgagcgccgccctaccgccggaatttctcacttcaggcatcctggagatctgcgagaagaactcatgagcaactaatggaatgaagatttttcgcacaaattctgcgcggctcagatttggctcctgcctcttccaagtaaaaagaaaaaaaaaccaccaagacaagaaattgcccccaagaaacaccagaaaacatctaagctccggttttttcaactcagattcgtcctgaaatcctctaatccccatcgatttgcaactaaatgacccagaaaaaaaacacagaagggtttgggggaaacgaacacgaaccaacgaatccccacaaaaaaaccaaccaaatctcccaaaattcagccatctcaccttcagattcctgccgctgcaaccccccgcacgcgaatcctatcccctcccgcagatctgcaaaagatcagaatcacaccacaacgcatcaggaaaagaaaataatcgcccaaagaaacccaagaaaacaaacaccaccccacccaaccaaaaaaaaaaaaaacgcgaaaacaacctacgatttgctcggctcttctccgattccttccgatccgggccccgcggcgactactaactcccctacgatagaatcacctaactatggtggaatagatccctagggtttggagcttggaggtggctatggctatggctatgggctctaactaacgggagggggggagaccaggacaggccgcgcgtgggcgggggattcttatcgcgttttaaaatggcggtgcacggcgtgatccgtggaccgagagcagcatctcgccgtccgtagaagggatgacggcggggattgttccggtgtatggaccacgtgtatccggtttggggatttggagttcttgaccgttggttgctttgctctgctctctcggctgagaagtgagaactctgcatcaaggtgttctttattattattattaatttattttttggaatttggacggtaaaaattgctccgaaaattggcacatgatgattattttttgagcctcaaatgggagcatcgatttttattcatctctattaaaatatggagtatatatttacaacaaagtgttccctagaaaactgatttcaagttgttgagagaacatgacaaacatacttcgacatgtgggactttgtctatagtttgtgtattactgctcttgtttttaattcatataatatcatgtatgccattgtgattaggcacctttggcgtatcgtagggacatgtgcctccgacatgtgggaccgtaagggtggccccaccagttagggactcgcgccactacccgtaactctgtaagaggagttgattccaagccattgatgatcgaattacgtttgtgccagagcttgctagtgctcttgctgttgtggatggtggtggcggagcttactgcttatgaaaaaaaaatcaatgttacagaatatggaccgatatgtgattttgtggactatagagttcctagagagttgtgactatgcatttccagcttcatatactcagaagaacaaatatgtcttttttacttaggagttaacggtcaatacacagtcaacatataggagtgatataagagggtgtagaaatttagaccaatggcatataagaaattaggacaattttcagtggcatatgagattctctcatatctagttacacggcaactcgatcttgtttttacgagttcaactgcaacaacattacttgagcatagacgtactcgttataaacctctagacattatccatatcttgagaacgaaggcggaggttaaggatccctgttctttgctctatcttccaaactcaagctcgctcgttttctttctgtacgcttcccaaatgtactaatctatatgtttgagtactaaactatacgttttctaaaaaaaattctatacgaaagttgttttagaaaatcatatttaaaattaactactccgttttacgtgagtatgaaattagttcccaacaccacatgccgaaagctacgaggcaaggcatagaaatcattccatcgttgtcaaacaccctagcaaagagcaacaacgcgtacagtacccccagcttgtctcgcttcgaacacaacaacatccatcgccagaaactgcaacggtcgatccaagcaggaagatgctactggtttagtagcatggcatgtccccatctcaaggaacactagttgatgcgaaggaaggacttatgcctggtgtgtttggattggcatggcctatggggacagattagaagtaagcgctcccatgatgtgcttagctgataggtgcattctcggtgcctcccaacctcaatccagctcgtgtggtctgtgagaactgaagattannnnnnnnnnnnnnnnnnnnnnnnnnnnnnnnnnnnnnnnnnnnnnnnnnnnnnnnnnnnnnnnnnnnn

SEQ ID NO: 22291 - DNA, 8521 bp, Oryza sativa
aggggcggtcgccatcgccatcactcgcgccgcgcgccgtcgccatctcccctcgagccccgcctgcgccgcgcgccgtcgtgcgtcgtcgccgtcgcctcgagccccgctcgcgcgccgtctgtcgccgtcaccccgcgccagtgtgcccgcgtgatgccgccgtcgcgtctcgaaggaggcgagcgcggcgacggaggaggcaagggggcggcggaagagcgcggtggagtcggagtcctccacctagcctactccgccctagccgccggagtgctcgtctcccctccaagaccgcagcctcctccgccgccgccggctctcctcgcctcacctcgccgccgcagcctcctctgccgcagcagcctcccctcgcctcacctcaccgccgcagcctcctccgccagtgctcgcctcctccgctgccacagcctcttgcgccgccgtcacctcgcctcgcctcacctcgccgctgcagcctcctctgcctctgctgcggcggccgcctcgcctcgccgccgcagcctcgcctcggcgcccttccctcgcccagctgaagagagagagagagagtgagagattgggagagaaaaagagtaagaaacttacaggtgggatcacctattttttttataaataaattgctgactggactgccacgtaggatcaaaaccaccgcggattgagtcgaggggggtaattcgtccggtttgtatagttggtggtgaaggatgtccggttttgtatttcaggggataattcgaacgaccgcgatagttcgggaggtaattcgtactttttccatagaaaaacttgcgcggtaggaacaacaatcacacatctcacaaaattgttcacatgagatcgaagattccaaattaattctactatcagtagagctatgagaagtgggtgcacgacttcaaatcacagatgcaaaactagcatactgcaggacaacgctatcggctgattgaaaatccaataatatgaataataacatagcattgattgactggctactgcagagcagtgctcatacgaacaaaaatatcaagattttgatttaatgaaaaattaagacacagccacgatgtggctccatgtcagtgttcgtaacaagtttgcaagagaatttatgtatgccagtattggtaaaaaagagaagcttttttttttactaaaaaaatagaagcttttggacaaaggaaaaaacacatcacaagccgtcgatcaatagtttgacgaaaaaataactaattacacagattgcatgtaaattacgagacgaatcttttaaacctaattgcgtcataatttgacaatatggtgctacaataaatatttactaatgacggattaattagacttaataaattcgtctcgtggtttacatgcggattctgtaatttattttgttattagactacatttaataccttaaatgtgtgtccgtatatccgatatgacacgccaaaactttacacctctgtatctaaacacaacctgaacttgctgcaggtttgcacatgttagaactcactaatcaataattttgctgaaaagctagacacatacgggactacgggagtctcgagttacaatttttggtttatggcgtactacgagcaagtttaatagtacaattagttacaagctataattttatacatgtcatctatagatagttttagagataatttctacaatagatatctctaatctcttcactatacacttgactatacagtgggtcctaccctcctctctccctcctaccttttctctttgccctcctgtcttgtgcgcaggctaacatggtttcaccaatcacaaattaagaactgaacatgaaatggggctcaccaggtgtggaggaatgtgctgcagctagcgcttattttgtcgcccgcattccttctctctcttagagcaggtttaattaaacaggcgactgccggcggtaaaaaacaccacatcagcgatagagataactagaagatgggtgtatgtacagctgttggttatacgcacaagcaccaataaattgattattatttttttacgcctaatccgtacccacgcattgcctcacatagacccacatggaactatgggataagctttttctatagtttctttcttcttggagtttgtgtgtagtcggcgatatagtcgtccgctaccacccactctcctggttttttccatccagctcatcactttggccaggttggatgcgctatcgcctgcttaaaccgtttattatacctgctcttaccctctctttctttcaacacaccaaagaatcagacgtggtatttttgtgcctgctctactagacaaacgtatgcgccggttatgatcatcttgagcggagagcccccaaggccccaaatgaaatcaaggcgttggaggacggtccactattgtcaccttgtcctcgatgcaggaggatcagcaattcgatcgattatagtcacaccctgcgaccgctgctactccagtccctcgtaacactctgcttagggccctcgctgagcgagacataaaaccattacgggtgccatacgaagaggggttctccactgttttctagctgggctaacagctggatttctgatgcttaccattcctatatcgaacgatattgggatgaaacaattactatacgtcgagtagtgtatctgaactcaagcttgagacaaggtatgtgcatggagtgatagagtagctagctctttctccttatatcacttgtatatctcctaattgctattttggatatttttcactgggtgttgggtatagtgaaaggcggccggacaaggaggagaggagatacataagtggtgcctcttaatatttggtggttcggctagcttcagaacctcttaaagtgatagaaaaagcactgacaagaaggattgcaccaactatatctttatgctaattaacttatggataaccataagagcatgcccatcacaaagtactaagcctaatttccacatcatcaagagccaaccatctaaacaactcatacaacagttaggtctctaccaataatgcctaatatggagtatttattttaatgaccctaaatcttatgctctgttgattggcgtgttttctccttaaaattaactgagcctgaaatctgaagaacaagctagtgatgattgatatggatttaattagggaaaaaatttaatcttgaaattttcaatggccataactgaccacaaagaaatactccctatgtttcatatcataattaagtctttcttattcttttttctttatcaaatttcttgcggtttaatcaaatttatagaaaaacccagtaacacctataacatcaaattaatttcataaaatgtaacatcgaatatattttgataatgtgtttattttatataaaaatattgctatatttttctataaacttgatcaaacttttaaaaaatttaactacgaaaaaaatcaaaacagcttataatataaaacggagagagcagtaacttcgccgagacaaagatagcaacttcatgttctttatttcttgagcctgtcaccgaaatgcaagcaaccatcagtcgtgtcacaacgtccacatatacaagcggcggagggcgctagcagatcttcccacggatcggtgcaagaacagaagccgcggaggccggacgtcatgccagccggtggcatagttctcgtgaagcccggacgagtactagcgtatccgctgagtacagattatcgagacgtcgcctcgcagctgatcagttctttatgggtgatactttggttcctggtgcctcctagtcccagtgaaggatcaggggtgtctgtagaactgtagtacaagattacttggcctttttattttctttctggacagctactagattttttttattgatcccatgaagcacatgtttggtgtctgtatatactatgagagaagaggattggagatcaggcatatatgtatgctgaggttttagtggcaaatataggatggaaaagatggtaaatattaagaggactcttccgtctagataaaaatcaatcatgggcagcaaagttgttttcatttgtatttgccctttagtttaaattttcaatttcattaagaaaaactaaatacaaaatgaaaaataactttctctttttttatacataggtcatcggcattggataaaaaagggcagagcactttctagttatggacccaaatcctttagcatggaatattttcttttttaattaaaaacccttagtatatgaaagaatgaaaatgtgtttttgttattttctcgtggaataagaagccctcgtaccttaatgaaatgaaacaacagtaaccagcacatgtttatatatagtcattaatttggtgcatgctgtggttattgcatctcacgagagttattgtcccttgtcgagactttctctatgggctctatatataggctgtgtttagatccaaactttggatccaaacttcagtccttttccatcacatcagcctgtcatacacacaacttttcagtcacatcatccccaatttcaaccaaaatccaaactttgccatcaactaaacacagccatattctagacacacaacgactaggatgtaattctctgccatagaaaaaaggtgatgggcgcatggaacaagcgataagaaggacggagcaacacatcctgtagggattagtggattattgcctggatgagtgaaatatacttgtctgttgtctcctaatttactgacatcactcaactcgaaatggagaacatgttcaaactacaaggcatgtctagtatggatgtactgacaagcaaacaaacaatggctttgatcgtttgtacttgcagccagcaagctgcgtcctgttgctgctacatcaaatcagcttgcatagagctggctggctgcagctgcggtgttgtagccagcacaaacgatcagccccaatgtgtgttgttcttggtgcaggcgcgcgattcgtgcactattcggccggccctctccttgctctatccacgacacatctaggctcgatccatactacaaccttcatcccaagctattgccatggcatctctggtcccagcactaggatcttgctaagtgctcgacattatattgtcatgtgtaccatatctaggagattctaccaaaacacggaggcatttctaatggctatgtttccaacgccttccattcctatacggaacgatgaagctagctagcattatgtttggcttctatctgaactctagcttgcacaacaggcatagcatggcagcaagatagagctcctctttatcacttgtatctctcactattcttttgaatctttttcatcatattagtgaagggtgtgtgtaactagaggagacgaggtaggctttggttcttgatatagttcgtgtgtgtggggttgggggggattgcaccaagccaccaactacagattaattcactagagctagcctactgatgtaaagatgggaaaaatattcagagcacatgagtaagcaggtggtactaatagtaatagagcctgaaatctgaattaggagccagtgttggtcgatatgcatttaattaagtgaagactttgatcttgagatcttttaggtaccattactgattacagattaatagctgtgtcatgccaaaaggattaaacaaaagctctacgaaaaaaaaaagataataaggattgagaagctagtgctgtactactgtccagtacttaattctcagactttcagaaccaacgtgactagtaagccccccgttctggtcaaggcagcttcgtgtatagatagccatatggcccgagtcccacggcccagcccaagtcacgtcaatttggtccggcccaagcacagcacggcccgattggggtcatgctcgtgccggcccagcccgacagccaggccgcgcttgggctgctctctcggcacggtgggccggcacggcacggcacgatcaagaaaaatagtagaggcacgtaaaatacacttaattaaccatatgaggcaaggcccaaaaacatgagaaatacaaaatagacttatttttcagtcatatggacacaacctatagagtttagggaaaaagtagacttattctgtggagaataatgatagctgttgtgccttcaggccagcccggcacgtcccgagtcttactgggccgtgtatgcagcccgtgggctggcacgacatggtctagcatgtaggtcgggccgtgccggtccgactgacctcagcccaagcccgtatcaggcggcccatttggccatctttagaacgcatcctcttcagagcaatcgatcgagctccaatgtaactcgaaatggcttgctgatcatgatgctgggcaaagcttcgtcttccacctgtgcaatatcctcatattaactctacttcttagcctagctcttagcacttgcatatcgtccgccgaagagcagtatgtatatttacccaaacatatagactgatcagccctgatcaacgtgctcaacacatccaaaactcagatacacacattcatatgttatgtgtttcagatttactactactctctaattcttccatacgaagagagcatacaataccatatgcatcagcgacaaatatttcttaagataacgagaagatacgaggaagaaggccaacgtacaggagacacaaaaggcctatacattgtgtccacaaccacaagtgaagaagcaagcgcctgtcgatcgatcgcgagctccctcgctccatggacacaagccacacaactccaacggcgagtacctctctccggagccatccgccgatccatccacaccaaacgatcatcatgatcactgcgccactggaccggctcctggacagcacgcaaagtgtctgagcagttcttcaccaacacagaagttcttgtaggcggtcaggttggtttgtgtgattctttgattcccagtgcctcctagtcccagtgaatggaaaatgagcatgtacgtacacaactgtgatacacttttgatcgatattttacttcacttcacccttttggccatctactgtatatagtttttgttggatatatagagtatatatcccatgtaactgcgtggttggtttttgtattcggaagagaggatcgatcagagagcgtgtgtaataaataatgctaaggttatggtagctagaaaggtaaaggcgaggcgagctaaatgtacaggttatataagagcaaggttaataatagtgccgactgctgactccaaccgattgccacgtccttcaatcaccagccatctgcaacaacatacaacagcagcgaatacttcatcttttaatgaagctaatctctaaccagccattactttaagtctattcatttttccgttggttgttgtgagggcaggtgggcccatggcaggcaaagtgcctagctagactcacgtgtagagctggacataaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtagactttttgctatctcttgtatgaggtggacaagcatgagctagtgcactagctcaaccattgaaggaggcctaatagtcgctcgcttctctctttgcaagctttctttctctgccacacgtgctaaaatcgtataagcaggctataagctcactattgtacctgctctaagactcgtactaccagtccaccgtaaaaggggttacaaatttaacagcaaaactaattagcacatatttatttagtgcatgttttactcaaaagtcatgttgtacgtactgatttaagactatttttttataaactcaaaatccatggctatatgcattttggatgtggaggctggctgttaggtttgcacacaaagtgtagattgttggtcacaagtatgtagcatgattcagctagaaattaattgagtgtatcacatatatatatgggtccttagttatactagcaatgcaacatgtatagcttcatcaaatttcaacaaaccaaccaaaaaccgggatattaaattgtagcacatgcaacatgcctacaggttggtgtgaaaatatatggctacgaactaaacaagcctttaaggatctaataacatcttccttactttgaaagaaatagtaccgagtataaatatatataccaatgttatacaacggtggtttaatttcagcttatagccgtgttgtatatcatgttgttttgttgtttttttccttgaccataattatagcctcgtaattttttcatcgaccgtaacctaataaaccttgctgagcggcaaggggattggggctgatttacagagccaaaga

SEQ ID NO: 22292 - DNA, 19164 bp, Oryza sativa
  unsure (1)..(19164): unsure at all n locations
tgcatatcattactcaaccaagacatctagactctagacattgtgcgaacaccactctagtacatggttagtactaagaccgtgccctgtcttagtacgtagctccaccaaacatcgaaaatgctaattggcagccagtcgcgcgcgccctcccctgcgcgactagacatgtgtcgcacacggagagggtacggtggacggcgcgccgcacggagggagtttttccccttttttgttttttttcggtttctcattctgttttggttttttccggttttgttgggtttctctttctttttttcttccggttttctttaagatgtatgtttgtaaagtttgtatttgtatgtataccaagttttgtactcgtatgcatacaaagtttgtattcgtgtttttttctcttggtttttaatatgtacatatacaaggtttgtatacacgtatgcaaagcttgtatatgtatatgcaaagtttatatacatgtatattttttatacgtcatttttttgtacacattaaaaatatatatacgtgtgtatatactttgtatagatatgtagaaactttgtattatcaatgatgagtcagaaaattcatgccacctcggattagagcttagtgccaagatccatggcgctgagttcgcggcctatttttggttgaagtttttttgcaaggactagtttcaaaaaaagtttttgaaaatggccaatttgttaaagaaaagggtatatcatgatggtggcttaacttcaacgacagagaacattgtctgtgtaatacaactgtggtgatatggtttgctcgtcatgaaggccataagaaggaactggcacatggtttgctttgtgaatatgtaggatttcatattggaaactataccttacttcaaatatgtacatacaagagcagtatcagtatcattaattagaaaattaaagtacaagagaaaaaagtttattttttagaaacggcatacatttagtgatagatcgtcatcgactaacgtacgccaccactacggtcgatgcattctctccgctctcagccatcagttaggtctatgcatagggtgactgcctccgtggtcatgatagtcatggcgatcaaggctctaatcattgttgtggcagccgacccaactccaccaatctctgtatatgttggattaactgcattcccagtacctcccacccctagatgttttggttaaagccaaaatgtgcctataagaaacaagttcgtgggaaacatcaaaattttggcaaatcaatgttctaatggagctgtttgttttgttacccttttaacaaattttattagggtatccaaaccaaaatagccctacatatttaagagaggagaggataggagggtaggtatataataattatgctggctgatgaggttatggtaagtagaaaagattgtattagttcatagcccatagctatatatcttacagataggggttataaaagtaatgataacttcttttattacttgggttcatgcatgttttccttattgcatcttatgagggttatgtccattgttggaacaaagcgcaacaaggatggcaagggcctccctccaaagggagcgagcccaagcttggcctgtgaggagatagagaaaggggatgaaggctgagagaggtggatagaatggggagagatccccctcctcttgcccttgaagggctcattttattcatatgtaacgggaaattacattcttacccttgatttgctatatatgtacaacctcctcttgggggtattttagttctttatacattagtttatacaacactctaagtatggggttattccccaacatcccttgttgaggttttctctagtggctttatataattctttgccttactttacacaagtaatgagcgataaacatgacacatcatggcatcggcttaacttcatcagcctaaatctgtatacatttgaacttgtggttttctggggctgccattggacaagatttctgttgcatatgcgctggactcgaaacgaagatcaacacacaactgcaaggcatggaggcgttgctaccgtggactgccgggtgatgtcgtacgtcttgttcacggtgaagggctggaggcaccttgtgcgctacaccctctccatcctccatcctcagccgctgccatgctcaatgctccaatctgagccctcgatgcccggcaatggcatggcctctcaacaccagcaccgaccttcgactcggccccctcgttaagtacagtcatgctatcagctgtaccaattctctggtagatcctacggaaatccaatgtatctctaacggctccatttccgatgcccactattccaatgttaattaaacgatgaagctagctatagtattatgtcatgaacaatatgaactctgacttgcaaaaggcatgctgcacatggcaacatagagcttgttgtggccctcttttaacacttgcatctctgtagaaattagttctcttgaaactatatatttcatcgtatagtgaggggtgtgtaacaaggagaggtagactgtgtctcttgatatagtttgacggtgtttttggatagctttagggcatctgaaaatgatgagaaataagcagagacaggagttagctatgggcatgaactgcaccaactaccaatgagctagttgatgtatatatggatgtaaaaatgggacaacatttagagcacatcagtaaattgattttcacaagagggcctaggccgaacacagaatactgttggggacctcatctttaatcccgtttacaacccctttagtcccgggtagcaaaccaggatgtccaatccgggactacagatgggcatatttagtccaggttgaaataacccgggactaaagatggtagcgtcacgtggctggcgctaccatctttagttaccaaccgggaccgggactaaaggtttttttcttttatttttcaatgttttttctgcttgcatattgatttcgaaccgactcaacaacaaaatcatcacattcacaaaataatccacaaattcacaaaacatctaaaaatcatccacaaatttacaacacaaaatcatctacaaattcacaaaaagatctaaaactcatccacaaatttacatcacaaaatcatccacaaaatcatcaacaaaaccatccagtgtcattgccgcctgcactggccttcatcgcaccatcccggccagcgcgcccgccacaccgtgctatcctggtggctgtcgtctcccctctggtggacggccctcaacgagccgtgcgccgccggctaccgcctccgctccgcgcgcacctggccgcctaccgtgcgcccggcgactaccgcctcccctccggcggagggccctcagcgagccgtgcgctgccacctgccgcttcccctccggcagaggggagggcgctgctgctgcccgctgtcggcgtaaagggagaggggaaggggaggaggggatcgcagaagaggggtggacgaggaggggataaggaagaaggcgtgcacgcggttgccgatgctgaggagataagtaagagagagagagagagcaagagatgtcgggattaaagatatgatctttagtcccgattcgtgataccaactgagactaaagttcgttgggggcctgacagctattgaaccgggactaaaaattatctttagtcccagttggtgttactgatcgggactaaagatcaaaaagtaccgctgggcttttgaaccgggactaaagatcctttagtcccggttcctattcaaaccgggacgaatgtgatttttgccatccgggcaaagatcggttctccagtagtggaatatcgtcagtgaattttcacaaataggtatttttttagtccgcttgtaaaactaaaggggtattcacaaaaatcattttgtactagtgtgatagcccaagatgggtatacagtttcatatctagaaattattaaatttcagaaaaataaaaactaaatgaaaaagctcatggtgttttcagtggtatgttttagttaattctgagtgaaataaacataagtaaaaaactaaagaaatcattgtatttccaatggcatgttataggacagagtatatccaaggtccctaggcaatactatggaaaagcatattggtgtcgatggagaaatcctcatagtttctagattttaatttccagccggcaccccttaggcgggttgatgacaaacatcatcggtgccagttacacaactaacacctatagtgtttatagatgccggttataagtgtccaaaccaacaccaatgattcctaagaacaggcaccgatgcccccggaggcactaaagaagttattagccggctcaattactacaattgcacaaactaaatcctaatcacaagtgctatcgtatcagttcatcacatcccagaatcccatgttcattcattcacaagtgaacagaagaaaaatcacaaatctaacttaaaacaaaaaaaaaaaatcaaatttggctaccctacaatcacatctcaaacaaccactgtggatagaccggtcatccccttcactgcaatcggcaacggagagtggtgaacgatgtattccctccgtacgtgctcagccattcaactaaactataggtctatgcgtaggcgagtgtgttcgtggtgatgaaaattatggcgatcggggctctaattgttgttgtggcagccgacccgactttaccaatctttgtatatgttggattgactgcattcccagtacctcccacacccctagacatacctagttcgatcgatcaagcttagctctaatcaggtctttactgtgtatcatatcttgtgtgtgctatatgttttggaatacaggcaaagtacatgaatgttcgttgtgtttggggtccttgagcatggcctctcaacaccagcaccgaccttcgactcggccccctcgctaagtacaatcatgttatcagctttaccaattgtccagtggattatacggaaatccaatgtatctctaacagctccatttccaatgcccactattccaatgttaattaaacgatgaagctagctatagtattacgtcatgaacaacatgaactctaacttgcaaaaggcatgctgcacatggcaagatagagcttgttgtggccctcctttaacacttgcatatcttagaaattaattctcttgaaactatttcatcgtatagtgaggggtgtgtaacaaggagaggtagactatatatgtttctggatatagtttgacggtgtttttcgattagctttagggcatctaaaaatgatgagaaataagcacagacaggagttaggcgcatgaactgcaccaactactaatgatctagttgatgtatggatgtaaaaatgggacaacatttagagcacatcagtaaattgattttcgtaagagggcctaggccgaacactgctagggaacttatctttaatctcagtttgtaaccccttttgtcccgggttacaaaccggaacatccaatccgggactaagttgaaataatcgggactataggtctatgcgtaggcgagtgtgttcgtagtgacgaaaattatgacgatcggggctctaatcgttgttgtgtcagccgacccgactccaccaatttttgtatatattggatcgactgcactcccagtaactcccacccatagacccagtttgatcgatcaagctagctctaatcaggtctttactgtgtatcatatcttgtgtgctacatgttttggaatgcaggcaaagtacatgtatgttcgttgtgtttggggtccttgagcacgggatgcatagatcatttatataggtgcaggtatggataactgacttgtagagactaaatcgaattccattattgaaaaaaaaagcatggacatctcactaaattaacctttgcctacctcgcaaaaaaaacaatttaattaactttttctagctgaaacaagattggggctaacaatgtgagcggaactgagcccttataacctgccctttttattgcattggatcgagccataaatgcaatcttttccactcgccttgagtcaccataacctccgcacaattgttatatacttacccctcctatcctctcctcccaaatattagaatagcaaatttgtacgcaggccattttgatttggaaccctattacaatttaattgttggtaggggtaacaaaacaaacacctccgttaaaacattgatttgccaaaatattgatgttgtccacaattcttataggcacactccaaacctaccttttcaactctatcttactaaaattttgatagtaccaaatcttacccaaactttgacattaccaaagctgtggtaggacatcaaactaaaagtctccgtagttacatatgttcaaagtctagtggatgacgaaaaagacagactagctagcaataatagacatgcatatatattagagcttgttcgcttcatcaaaccgggactgagtggcatcacgagtgcggctaacaagatattcgaatagcatggattggaatggccagcaagatggtttggacaattctttcacctatggggacgttctatatcaagcccatgctcctcctctgtactagctagcatgaattgcatatcgatcaaaaaatagagggactagttttcaatctgtcatatagaagcaccaatctcaatgctcaaaccatcaaaaacttcttggccttatgagcagggtggggttggaattgctcccttactcacgtcctgtgtagctaagtttcaagttttcaacgttactggatcagtttcttctaccattattatttcaaccctatgtatgaaaaactatttgctactataaattctattagattattcattctaaagatgacaaaatcttttataacaaaatttgatttttttgttagataattataacaaaatttggttattgatgaatgtccactaatattttttttcaacaatatctgcatgtacaatttttgcgcataactttctatatataaactttatgcatgcaaattatttatgtacaaacaattgagaaaaaaaaccatatgaaaagttgtcgttattttcagtccacaaatcatagaggctaagatcaaatttgacgttaatattcggtccaaaggctaaagatcaaaatcggtgttatttagatccacaaatgatcatggaggatagattcaaggcattgctgcatgcatgcttgattctttgagggcattcataggcaacccggaaagcctgtaacaaaaatcagatttaatgccacgcgctaaaaaaaagaagaaggaaaggccggtgatcacgcgcgactccctgattgatgctcgggtgatcgctaagagagcccgcaatggtaaagtaaggtgctatttataaaacatgtacatctcagcaatagactagattaatagtaaaccacttcaatggtatgtctacatgggtatctatagctctctaatccattgccttatttttctctatagactatctccatgttagtagatagctttgctctctctcttcatttaatctcttccaaataggaaaatatgctgacatggatctcttatagagagcttatagataactattgtgggtgccctaactagccttttcgttatgaacggttaacgaaataatccatttagagcaaatttaatagtataactaactactagctccaatttatctatagccaatctaataactcattcatacaatagttacatactacactattaatacctggtcccaactgtcatacatacatcgcatcttggagtccgtgttgcagctggctataaatctatagcccccctcctcttctctctccttatttatttccttaaaatatgtttgcagttggtttatagcttgctattgtacctactcttatcctgactggaacggcggcggcggctccttgggttcgctatcggaaacgagagtgcctcaacgcactcacgaatagtcccggccggcaaggggcaaatgtatttccaaccttgtgttaaaatgtccagttttactcttccacttttatattttactcgctccgtccgaaaatataagcactttttaacttcgacacagtcttcgagatgcttctttaactaacaatacctataaaagtaagatggtttaaataaaaagagttgcatattaggataatttatttaatgataaatctaacatcaaatttacatgattgattatttttaatttctttttgctattagtagtcaagatttaaaaacttggcactattctaaaaatacttatattttgagacgggggaggactagttatgtggagctaacagtgggcggtggtggtatagcaccgccgcatggaacaactaagggagtaaagattagacaattataccccttcttagtttggaccaacgggcgctctcatcttgtgctcggtgaggggcagaaggcggattttgcactaggccccctctgcaacctccatcctcaacaatcgtgctcaactctccaaactctgtccggcatggcctctcggcaccagcagcggcctacggctcagctcactcactaagcacgaaattatgttattagttgtgccaggtttcaaggggatcctacatgaattctccctctgcgtaacagctacatttccgacgcctactattcccatgttaaaatggagctagtattatgtcgagtactctataaactcttgcccctcgttttaccacttgtaagttgtatctctgcatatcctctctggttttttttttaatcaagcatatcctttttttgaaatctgtttcatcgtatagtgtgggttgtgtaacaaggagaggatttgggcagtggctctgatatggagtatatagcttcagggggtttcggctagcttcaaaggatctgaaaaaaatgatgagaaataagcacagatgggagataaaggtgcatgatctaatcgcaccaactgcatattaatcagctagctgatggatagatgtaaagacgagacaatatttccaccgatctaagtaggtggtactagagcctgaaatctgggcatctaattaaatgaaaattgatcttgagatctttgaggtgttattaccgattgcaaattagtaggtttttcatgcaaaaaataataatatcagggaacaaagagatgttccatgtaaaaagaaaaaaggtttaaacaagacaagtctttttcttgctactgctcaatgatagattgaacagagaacaaatatgctgagaaggaaaaaaaattgtgaggctggattgcaattgtgttatgtgtgatcttaatcaagaagaaactcttgaacacatcttattcaggttcccttttgcacagcaatgctgggatctctggctctctgccctacaagattgaggaatgtatcagtccaagaggcacttgaagatttgagaatcaagttgcaagtccccttctatatggaactcataatcgcaatggcatggagcttttggctaccaagaaacaacaaaatctttagaaacatcactccccatttctcagtctgtcaagatcgttttagtcaagaatttacgatggttattttttttgaggagaacgacggcaggagatctgccggaatttaacattagaagagaaaaattacaaagtagcacagagattcagaggttacaagccaaggaatggaaagagaattacagctgcaggaaaagctaaaaaaaattcatgggggtttaaaggccaagctgcgcatatcaatagcttgcttgataaaataagctacttcaatctctgaacaggaagagttttggaaaattcttctatttctttccaaccaaatattccaccaagtagttagaagagttcctctgaccagctgcacatccttcttagagcctgcaaatttggttctagaccaccatgttgacacatccaggacaggatttattccgaccgaagacaagttttggaattgacaaattagggtccacacttttctgacaaacacacagtaactgaacaaatgatttgtatcttcaaaggcacaaccacaaaggcaacatatccaattgcaaggccaatgcctgcggagcagattttgggcagtcaaagttttttgatggagaactagccaaccaaagaattttatttttggttcagtcggggatttccatagagaatcaaactcattggtggcaaatgagccttcgaactggaaaaggtaagcactctttgttgtgtagacgccagactcggtccaattcaaggtgatgttgtcaggatcctgggaaagcgaaaccagttggagtaatccaccaagctgtaccaaatcatggatttgttccacggaagtgaattgtctgaaggaagtgagccatctattatctcgcatttccatctgaactgatctttgctttctctttgccaggctaaaacaactgggcacaatatcttttaaacaacggttttggatccaattatcatgccagaagctagtttttgctccgtcaccaatcgttattgtcgttgccgcttgaaagagtcttgtgtccatctcatcacaaggcacattcatgcctacccagggtttatcaacttctttccacttgaaccagagccagcggagtcggagtgctctagagaacctgtccagatccggaaggcctaaccctcctaagcttttcggtttgcaaacagtttgccaattgactagactatcacttggatttgaatgatcagggtcttcgcccttccacagaaaagatcttctgaaacggtcgattcttttgaagacccattttggcgcatgaaggactgtaagatgatgcatcggcatagcactaagaaccgagttaactagggtttggtgacctgcagaggtaaagaagcgacctttccaagctggtagtctggccccgatcttgtctataagaggaaggaaatcaattttccttaatttcctgaagtggagcgggaggcctaggtagcggcaagggaaattcttgatctgccctggccaaccggcaagaagctgttgcatgtcgattccattgcaactgatggggaaaatctcagttttgttgatgttagaatgtaaaccagaaatttgtgcaaaacacgaaaggatgcgagaaagagcattcaggtcatcgggatttgggagagcaaaaactgccacatcatccacgtagagagaacatctgaatatgccacttctcacaccaatcagggctaacacattggcactctccgctgctttaatgatccggtgaaaaggctccatagctacaataaacaacatcggggacaggggatctccctgacggagtcccttagcatgattaattctcatccctggggaaccatttaggagcacctgggacgaggaggtggaaaacagattagagatccaatttaaccaatgatgtccaaagccgaaatgacgaaggacctccaggagatatggccaattcacagtgtcgaatgcctttgctatgtctatcttaatgaatagactctgtttttttgatctatgaagcatctgcaccatgttttggacgtacagaaaattgtcatgaattgcccttttatgaacaaaagcactttgattttgtgagatcatttcatttagtcgaggagcaagtctatttgccaaaattttggtgataatcttgacgaagctatgcatgagactaatgggacggaagtgatcagcgcctgtagcatcatcttttttagggataaggcaaataaaggctgggttcagttctgcaagttgagaagtgttgagatgcataaaggataaaattgttgtgaggagatcatctttcaccgtggtccaagcggttttgaaaaatgccccaatgaagccgtcgggaccaggcgccttttcagggggcaaatcaaaaattatggattttaattcttcctccgtaatatcttcttctagctcattaaggtccaacgaaggtaaatgtaataaatgtaatagagaccaatttagacttaaagttctttggaaattggtccccaatctctccttgaaaaatctaaaaagttcttcttccttgtcttgtgccgaaacagccactcctgacggggtttgaagcgaatgaatgtagtttttccttcttcttgtgtttgctttgatgtggaagaatttggaatttacgatggttatctatagagcaaaagctatatatcttcctcttatctcacgatggctaaacaacttgtaaataactctgttttttttccctacagttttgttgatatttataacattgcaccgtaggaatgtttcatacagtatttgcgttaaagaaagtgctaccaagaaaatctattatgagaaaaggagtgaaacacccttgagcagctagctagcgctatactgctgtagtgctcttcacttattccctgatttccagaaccaaaacggcaaaaccctggttccagattttcatcgaaaacaagaagctgttctgctcaaggcaatttcatacgagcaccactcacaggtcacacaatcttggattcttggtgcagcaagtttagttcagaatcttcagaacagtacatcctgttcagaacagtacatctttggtcgctcacttcgccttcgatggctccggcaggaatggatggatgaagataaaccatggaagggctcaaatctaccatgtgatgagaccgataagcaactcttcagggcctcaacgatcatatccttagggaacggaggaaaagccaaattctggcatgacaggtggctacagggatcctcaccaaaggaattaacgccttccctctactagttggtgactagaaaaaacagaacagtagcacaggagttacaggataacagatggcttagacctatgaggaggatgaactcgactacccaagtaagagagttcattctcctttggggtttaatccaacaagtccacctggatgaaagcgcaacagactccatcacctggaaatggacgccgaatggggcatactcagctagctcggcatacaaaatccaattcctaggtagcatacaggacaacagagcaaatttcttctggaaggcaaagacagaaaacaaatgtaggtttttcgcttggcttatggtacataaaaaaaaatcctaacctctgacaaactccagctaaggggatgggataacagcccgatatgctccctatgcggcattgaactcgagacggctaggcaccttatcatggaatgtgctttcgcaaagcaggtttggagctcaatttggtccaagctgggcctacaaatgccgaccacaagcctcttcaatggagatatcttggcatggtgggattcttgtaggaaaaaaattgtcaaagagcaaaggcgaaacctagatggcctcatcatttacacgacatggggaatttggttgcaaagaaacagcaggatctttcatggcacctacaacacggtctcacaagtggtggagtcaattatacaattgtgcaagtcctttgatgaagctcatgtcacttagatgattttcagacgtattttgatgcttgttgccttacattccctaaaaattgcctgtcttccccgccaaatgtcgacgggatctagacccattaacttgttaggggttgtttgtactcttgctttctctccttaaatgaaattggcagagctcatgccctttcccctcaaaaaaaattgtgttgttcctgatctttttcaattccaccatgtgcagtctagctatcctcacattctgcttcattgcacttcaatccaatgagcaacatttaccgaaacatatagacagatcacccccctcaacttccaaagttcacatgcacaattgttccttagatagagcatgttatatgcttcatatttaattttctcccaaattaatttttcaattccacaagattaactgcatcactggacaacgtgcatcagccaaattggaggaagaattgaatagcttggcgctcatcaccgaaatacaaccacgaatttgtccccgtgttttctggccgacgtcttcgcctagcaatcctatgcgtgccaagccacatcccacatctgttcaagttcatcccagaacaaggccagtcgccggcggtccaaagattgatgtcatggcagaagaccggagcgacggccaaagctctgggaagctgtccaacgattgatgccatggcagaagaccgacgtgtgcgcttctttatctgctctagcgtcgagtgagatgtcgcaaggatgataagcactaggccactctacggggtcccgttctgtgctcaaagaatcccatcagtttggcacggcgagacgtctggctgaagccttttagtctggttgagctgatactttgattcccagcgcctcctagtcccattaatattagaataacattgtgtgtacactctcatctttcttctcttcatgtcatctactatggattttcttgtatcctatgtgttgaaacaaattatcccaacgagataaggaccctcctctttgtgagagggagtcattgctagtgtagagtagggaggagagggggaaactgaagatgacagtggattgagtatagaatgaatggagatctccacctttacctctcggggttctttttattcatatgtaacgagaaattacataattgcccttaactctattctgtacattagagtggcattgttctagaaacattttagtccgttatatatactagagtgagctcgcgcgctacgctgcgcggtattgtagcatgtaagactgtaacacatagaaagaaatatacgattaatgcaaaggtttgtctaagtggattacctactaacaatactcaattcctagtgtacctaccaagaacattatttaacctgaatagtttttttaataacttaagttcccagaaacagttctagatagttaataatttaaaaaataatttcacaataatttcacaatacatagcagggatgacaagcatactatgattcatccaatatctatgggcacaagatgcaattcgttctgtcaactaactgaaaaaggtacatggttaaatttctcgtaattttgtttgcgagaactgcagtattaagataatacctgtaaactctagaactggccaaaaacccagtcagatgagacaacagtagtgcatttatcaattatggtatgaaaaaacgactacatttcagattcattagttttacgaagagacttgactcttcactatgagagctttctgtgcaagaaacatatctgcctcagcaatttagtcaatttagatcaccaaatgcaatggcaatcatctgctaaaatcatttcttgaacactaagaaaaatatgtgccaagttaaatcattcttaagttaatagtttggagaattaactcagcatattgaaagatgttactaagtcagtagaactcaaagtttggagaattaagtcagcacatggagagatgttaccgagacagtagaagaaacgtcaaattaatgaacaaatcctcatttcagtcaatgttatgttactaatcaaagcagtggactcttaaaacagccatgtaaaggaacttaaatataaaggttcctgaaaagagacatctaaatgcaacaagtaatgtatccactgtgaatcaatggacgatgtaaatgtaagaaacaaatatacatcacctaccaaactagtatgagagtcttgaatatttgtatttttctcttagatgcccctcgtattctagtatagctaaggcagttgttgttgacaaagatgatggatctacctgccttacagtatttcgaaaagaaaagatcatcatggttaacacatgtgtagggataattccataggtatttcaaatggttttccagctaagcatgagcttcaatcttgttacagtccttgaggagaatctatatgatattatgaaatataaaaaagtgagtgaagtacatcaattatgcaagtgagaaaaagcagtaactactacatcagtgcaggaaacaacaattattcaagtgtgggattgaatcatcactgcagcatgatttttagcttggaaacagctttggcagtgttatggtggcagaacaccaatgtaagagctatatctgcacaggctatggagaccatactgtttgcgctttgcagcactcaattggcttagttagtttggtgggcaaaagagttgaatcggagtgctccaacctaacacagcttagccttcagagatgaagaccacagcacagtcttcagagactaagatcagctcatacaaaagcattaatcgttgctgcacatggagtatttttcctgtatggttcagaaaattatcaattggagtgctctttctttttttttgtcaaaatggtaatacatatacaacacaacaatttactaattacatataatcaatgaataaaaataaataattggaaggattaacttttcttttctctaaggagaacatcagagagcaaagcacatgaaggatctcttctgcctatttaccttgtatttgtttgtcatttatatgctggcagctccattcctgaagatccatgagctgagcatagtggattgcccctcccaacattagcatgaattatcatgaagtctagccgtctgtttacctgtatgctgaaaaacaccaaataatttgtttaaaaagattctgctaaacttgtttcaatcctaagctggccaccttgacctttatttggagttcagttttggacaacaaagtagtggcatactgacatgcttaaaatacaggaacagaaaaatgaatagaatctcattcgcaggagaggatgagagtaattgtaacttctgtcaccaatcaaaagtttagaacattaaaagccctaatggaaggaacctattaatgtgagaactcatcctaataaaacatctatgttgccagggaatcaacaggtttcagggaagctcaccagttcctgtcttgcctcatcacatcaactctctttccatcagagggtagaggaattggctcagagttcaaattatcagaaggcaaaattaaaaaaatagagagaaatctcgaggcaccaatattcggaaatgtattgggttctatccgaatcttgaaacgaacttcgcaaacaaacatctgataaatttagcctaaattcagaaccacttgaatctatgttagatgagagataagagaagggagactgtaccggaggagaataggtagatcgtacaccgatttctgccattgcggaaatggctgcgtcagctagcaacaccgtcgggcaagtcgctgaggaagaactgaaagatccactccccgcccgccatctgtgctagcagtgagccaccgagttgacctgatgccgaagaagaaggcgacgttgcgatgccatgtgggacgccgatgctgaggacgggatggggagtatgtgatgccattcaagctcgctgtacgtgcagctacagtgaagaacaaaaatattgggaagagatgcggatgcggagaggacgaggacgacgagcggatgcggagaagtggaaggagcaatgtggatggctcggcgggcagcaaaaccacgtctcggtaagggttggccgcgcaacttagaaggtagaaaacaaaaaaacaaattcagttagcatagacatggtcggaagaacgtcgacatcacaatgggaaaacctagagcaaggcacaacgggaaaagatcagagcgtacgggatgatgcgattagggaaagtactgtctcgaaaaaaaaacagaggaacaccatatataggaaatcaagcgaacagacatccagtgacataaccatctcagtttatctatataccatagcaccacacgtgtaatgaactcaacgtccatccccgtgataaaaccagctgatcttatatacctcagtgagcagtagctgagggaggcaaagatgcccccctccctccccccaaaacaagatgcgatgtggaagagacaccaatccaagagcacagcctggaagggaaaaaacacccaaaaaaaacagtgagcacacgcatggctggaacaacattggcatcgcaatgggggaaatcgagagcgagacgcagcaagaaagatcagagcagtagagacgatgcgattagggaaactaccggttgaaaatccccaagaacttagggtgtgtttggataatgggaaatgggggttgggattgggattgggaaatgaatgaagggttaggattaaatgaaagagggagaatgaatagctaggatttaaagatatcttttaatggatgggaaaaacagggcctaagcgggaggagcaaggaatagaaccggcgtcatatatggaagaaagaagggagcgatgcagattacctcccttggtcctcatggggttctctgcgtagtggagcagcgagcagcagccaacccgttgccgccgtacactatggcagagcagcagccaaccccatcgccactgtactccatggcagagcactaccgtggagattgagagaggggccaccatgtggggctgggccgctgggcgttggaggcgtccctgatggctggataaggacgacacgcgtcgagaggatagaggcgactcgcagatggatcagcgcacaggaaatccaggacggtggaagaccacggcaccgatgctgcgatgaccactaaaaggccgtcgaccactgggctaagaaatcagttggcccatggaaggataagctagcctggtagctgatccactgtaaccaaacaacgtggcaagattatattggatgccggttgcctaaatcgcccggagaccagctaatccagcacctttaagatatctaatatatattagactagttaagacaacaccctacgaatagggtttatccccaaacattatgctggactttttttcatgtacattgctgacattatggtaggcattcagagactaaaatgtaatcttcttcctgattaaaaaaaaaagttgcgagcacatggcggcctggtcttttcagatcattcatcggattnnnnnnnnnnnnnnnnnnnnnnnnnnnnnnnnnnnnnnnnnnnnnnnnnnnnnnn

SEQ ID NO: 22293 - DNA, 2157 bp, Oryza sativa
atcattgcttagcagggggagaagccatgtgtacccggtcatcgtagtggatgcatgccatttccccgaacaacgaccaagcttgaatagactagccatccatcgatccacgccatggaagagagggcagaggagtagtgcgcgtacgcttcccttccagcgtccagcgcggctcttctgggatgtcatgcattgccacccaaccagctgacaaatacagcctagatgagccattcccttgggcacaacaagcatcttactagcagccgattggtttggttttggtggtgcttcgattcccagtgactcctaatccccattgatcatcgacaaaagatttgagtgctatatatgcacatgtgtgtgtacaaatgtagtacatgatcagtgttttttttttgccttatttttcccctcttctcctttcaggctggtgtactagaattttgttggatcgcatggactacatgtctggtttgcttggtttcttatatattcgggatgggaggagaggatcaaattaagagcaggtataggccacaagggtgagtgatattgaaagctgtggcaattaatcaaggtttgtcccagtactgtcgttgttagtaaccattgtatccgatcaactgcattccttttgtctactagacctagtttgatcaagcgagctctaattaggtgtaattaagctatgtggcacatgtagtgtgcatatttggactactgcagagttcagagttcagagtgcaggctgcagtgtcatgcacgcacagtccttggggttggggagcttggcataagcagtcatttataggaataagttcatcaaacgaatccgatttttgactttaaagcccaataccaaatacaatatatctcttcactattaaaaccggtgtagataagatccctcagcggtttagatggcagttttgactgacctggtgcatatgtggctaatttgactgatgtggtattgacggggcgctcacgtggcaatttcatccgaaaaaataataaaccccatgggacccacatgtcagtttcacatataaattaataaaaaaatggtggggcccatgtggccccacatgtcattatcacccctcctctctaccccatctcccatcgtcttcatctctctcccatctcttcacagggcgcaagcggcggcggcgtcgaggagggcgtcggcggcgcgctcggccccaaggcgcaagcggccgtgactggcggcagcggcgcacgagcgggacatcggcagcgcatggggccccatggcgcaagcgaccgtgactggcggcggcggcgcgggagcggggcctcggcggcgcacggggccacagggcggaagcggcgccatgggacgtctcctccgcctatgccgcgcgcctcccggaggtcgtcgtcggcgccaaaccgcgagtcagacccgaagctgttgctcccatcgagccggcggaggaggagggcacgaacaccgggtagccgaacgcggcgtccgccggcacgcaccgcgcacaccccgtcagccccctcacgtacatgtcccacgccctccccactccccagtgccctcgccggcgccctccacatccagctcagcctgctccccctgctcatgatggttgtttggtttgggttgggttgaagacgatggattttggttggagacgtggagctctcaccggtgaagggtagggctgcctcttatacaaaacaatggtggtagcagccaaagcaagtggatgggctggtcggctggagatcgttgaggtggccaccggcgagcggctgtcccgctggcttcgcgcgccgccgctccggccaccgttgccccactccacccgccgtcccagtccacctgctttgccttgcctttgctctgctccctccaaactccaaattaacagagagaggctctccgctttggaaattttggaggggatggagctccttccccatggaagcagcaacgtctgaggttaggttcctaccatcgtctccccccttccctccatgttatctctagtattagtcaatgcgcataaatctttctcttcccggaaagagttgcccctgcgatgatgatgatttttggcctgacttttggtttctgcttctgttcttcatttttttttcttatctcggtgtgct

SEQ ID NO: 22294 - DNA, 7280 bp, Oryza sativa
  unsure (1)..(7280): unsure at all n locations
cgtcgccttggcccggtcgccaagtcgcgccgctgcaccggccggcgctcgcctcgccagtcgctagccccgctccatcggcccgaaagagagagagaggagggaggagtgaggatgatatgtggggcccccgtgggtcccaccatttttaattattttatgtgtggaactggcatgtgggtcccacgggtttattattttttgggtcgaattgccacttaagcgccacgtcagtgccatgtcagatgaagaccgagtcaaattagccacataggcgccacgtcagccaaaactgtcctcaaaaccgccgagggacctcatctgcaccggttttaatagttaagggacccgttgtgtctagcggttgagggacgaaaatcgaattcgttgacaagttaagggaccttagatgaacttattcctcatttatatactatgtgcatgtccacggagctactctatcctttcagattataagtcattttaactttgatcgaaatcaaagtgttcaagtttgatccataaaaaaaataataacattctcaatccaagacaaatatattcaattatcgatttaatagaactaatctggtattataaatatactatgtttacgtataaatttagttaaatttaaagtaatttaattttaactaaaattaaaataacttataatctgaaaaggagggagtagtaatgaattaatcgagcgaaaccttggtgtagctgaacataatgcagctgatctggttaatctaagcccatgtggtaactgggcctctttgtttcactggcttgagcccagcacaacacaatgcttatcattattcagcccagacgtccggcgcacacgcaggcagaccaaagagctctgtattgactgcacgtgcataaaggaacattgtgtacacaattagcagggatagttttttttttttaataatggtgtaaacccggcgttaaaaaggcaatgtcaaaacaaaagacaagaacatataaaaagaaaatcgtggatgaaaagatattgtttaggacgtaatcctatttactaaatctctatccataattaataaagattttcaggactatcgcctctagatttcggcatgccaattgaaagttgttcttgtcctcacaaaatggctccgaaacttaatgcagtatgttcctctataaagtactccctctgtttttataatataagggattttgaatttttgcttgtaacgtttgaccactcgtcttattcaaaattttttaaaattattatttattttatttgtgacttactttattatctacaatactttaagtacaattttttatttttttatatttgcaaaaaaaaatttgaataaaatgagtggtaaaacgttacaaacaaaaaactcaaaatcccttatattgtgggacggagggagtacctatatgtaagattaaattaatggtttttgctatttcacttgtgatatacttttgtctcctatctttcactttttatccgtaggatcttgcatcaggattcgtattctcgtatatttaacttatagttataattaattacatagcacttatactcagttacatagcacttacacatagttatgtagcacttgcatttagttgtagtgcattaaaattagaatttagaacattttttctttagacttacgattttttacatgcttatcttctttttgttatttgatttaaaacgggctatatcccattggttaaaaaatatgtacgatttgaagtagcccctttaattaatcggagaattgtcaaacaccaaatcatttgtattgttacaaagagccaggtagcggcatggacagtttagtccttcaggtctacacacaaggcctctttgaatcataggagtgaaaaaacaaaggaatagaaaaagctttttagcttagaatccactccaaccaaccaatcttcaaacatatgagaaatactattacaatttggaccactctccacaaaaatttagcataatttcaataagaaaattatgcaacgacgtttactcgggttccagttccgtctctagctagattatctttagtaaaaacaacgcctttatgtaaatactgcatcaaaaatcatgattttaagcagcgtctgcaatttccacatagccctattcatctctatgtaaccattattaataactgctccatagcggacgagttatgttcaaagtaatcgtaacaagggccacccgtttcttcattgtcgcacgctggcatccgaacccagactactcattcttgataatgtaggatcaaatcattccccatgcatcctaatcccaggggtcgttcgatcgagctaataggtctaaaatctgtaagctgtgtagcaatatacattgtgtatgtcactttagaatgcagaccaaccttgggtgtgtgtatataatttatatacagctagttttaactaattaaccttttcttgctgaaacgagattttggctgatctgatctgatccaatcaggtgtggtaactggtaactaggccttttcattgcattggctatagctcgagcccaacacagcaaaattgcatatcaccatcattcagaaccagacatattaacacactggcagaggaaagggccctgtctagtagactgcaacaaacatgcatgaaagccatgaaggcaatagctacgcatacttgcaacaatttattttcctggattgatacgtgcatgaattaaatgtgctagtacagcctaagcacggtcttgatgatatatacggaacgccccccaaatacacatatctttcctacacggctactctactgcgaagtctacaggcagttcgctggtctctttctacattggcgaaagcaatggccaaaccaaaaccatatcgtttttttttattttctcctctttcgcagagcgctacctcacaccccacctcttgcagggcccatctcctgcgcacattgacaccaaatcacgaaaaataaatggctcagatcttctaaaaaaaaatccaaagtctccgtgcaaatattagtacttctatagtactatatgtctatatgtatgatgccgtacgactagttttttaattatcactgtcatcagcacccattacggagcactacattgtgttacagtaataagcactgtaactgagcataaagcccagatgtgtactagagcatcaaatctcaattatttatggttcacagaaacacggaaaatttcagtcgtcgttgatctgatctgatctccatgtgaaactcaagactcgtagctgacgacctcgacgcgacgagaagccaaaatcgcagtcggttttgacagcgacaccaacagaaacttccaagtctgaaacgtagtgactgtaccacagtacagttcagtactactcctaatactgcaacttttcttgcaagcgtagaaggcaagaactatacgtgtgatggtactctccgaaatgccaaaatgtcaagcacgttgccatcgcccaagcactgacctcccaccacgtactacagccacaattaagcgaattaagcatacgtacgcccaattccctgctcgatagggcaacagatttaacgcaaagatagagcgtcacatccggcatcatatcggcactcactcttgtagtgtacttctccaatcaaattttccaggaaaaaaatatttccttgatattctttttaacccaaatcctatcaaaagccatacctagctagctagtagtactgtttggcagaattatttgggcagatgtggtggtgtaacgaggaaggaaggataattaagggcataacaacaaggtggtttgtcgaattgtttgattagtcatgagtgatttgattggctcaccaacaaacacgtaccagtgggagtagggcatgcataatcatcggtggataacctcgagccatggccaccagctaccagacgagaaatcaaaccctgtttgtttctaggtagaggtagcggcatggacagttgagtcctccaggcctacacgcacagttgagtttccagtcaaaaagctacagcccagacaagcagaggcaaccatgcaacaaaccaatcatcaggcaatctgcaaaaaaaaaacctgcctgataattgagggtttcaggtcgtgtttcatgtcagcatccgaaatcctcaaagcaaaaaaagaaacaggggagaactgcattatctgattttagcataaactatgatggaatcgaattattcggttggaagaaaataatatgcatcgaattctggtgaccaaattattctactactagtggattagcgtagcagctggagctagcacggaaatggacatgagcttggcatcaccagctagccaatcatactttcagtatgctagtatacaaaatccacctttctttaatatttttgcaaattttttcttctccttttttagtgcatggtggtgttcacacttggcagaggccaaaaccgcagcatctgcaactcgccatgcgcagcaacagtggcccaaaatctcgacattgacttctaccacagatccactgagcgcatcccgaggaaaaaagcacatgcgatagcagtagtaacagcatgcaacagcagctccgccactactattactgcgaccgctaataataacaagcggtgcaggagtaaaactactcacaatttactactactcctactcccgtgggatcagttaccgcactgtgcactcgcaatagtataaactgcataggccattctatgcttgggctactcgccgccgttgtcactgcatcgatcacttgctacactagtgacctactacagtgtatgcatatgcatgacactagtgtgacagtgtgaagcaagaagggtcgtctttttctggccaagagagagagagagagacccatgttttgcaattaacatatgtacaatgacacactagggggatagctgtgggtgccaaaacctcaaaagaatgagaaaactacagcaggcagtgagtgaggtgcagtgcagtgcagtgcaactcatgtcatgtgggcaccatatgcgtatgatgcgtgcagcagccttccttttcagcgagaaaggcacgccgcagcagcagcagcagcagccaaccccacaagagagcaagttatttaagaacctgagttagatagactgatagatacatgcaatgcagccaaagcggagcaaaaaaggggcagaggggacgagaaaaaagagcagaggtagaacaagaaagggaagggagagtgtgccactacgtgagaaaccgagacgaaagggtcgcgccaccagcccaccatccaccgccacgtgggacccaccgcccgcccgcagacgcgagcaaacgttccctccactactaattacacgtaggcagtacgatcactctcctccttcctaaagaaagagagaaagagattgattttgattatactagttggttagtcccatacaaaacacgccttaatccttaaccaccacccctcccctcccgttaacaaaaagctaaaacgcgcaacagcgacgcacacgcaaaagcccagaggcaagtagcagcagcagtggttgcgcggtgctgcgttcgtctcggtctccgtctccgtcgtctccgtccactggacagggcagaggctgcctaccagacacacgccctcaacctcgcgcccgccattattgcgaccctcccgcacgcgtgcgcgcgcgcgtattatcacgaggtccgcgagcgaggcgcagagcagagagcagaagcatcatttctagtcccccagcccaagcaacagtagccagcaagaacagagtagggaggaggaggaggaagaaggacgcacctgggagcagagccagagccagagccagagccatggagcagtacgaggtggtggagcagatcggccggggcgcntacggctccgcatacctcgtcgtccacaagggcgagcgcaagaggttctcctccttcctctgctcccctttcctcttcttccttcgtcttcttcaggcttccctgatgcttctgttctttcttggctcgatgatggtgcaggtacgtgatgaagaagatccggctgtccaagcagaacgacaagttccagcgcacggcgtaccaggaggtaaaccagatcgaaaccctcgttagttcttgttcattccccacacttgagcaaacatgttgcacccatgagttgtttgctgttgcgtctgcaaaacccttttgagattaccagaaattactgcgcgatggattaaagaaaatagcttttttttttcttttcgagttcatacctgattgaatgtttgggaggacgggacagatggtttggtttgatgatttgattttgatgctttgcttgctgtttgctgcacagatgtccctgatggcgagcctcagcaacccgtacatcgtcgagtacaaggacggttgggttgatgaagtacaaattccacgcattaattcagttctgggagtaatttgcattccttcgaatcaagggttctaaagttttgtccttttttctcttcttcgatgatggttgcaggggacctcggcatgcattgtgacaagttactgtgaaggaggtgacatgtaagaacctctcacatttttcactcttcactgcctcctaaaatttttaccttccattggtgctccaacctccaaagtcactgacatcggaatcacagggcagagaggatcaagaaggcaaggggtgtccttttctctgaagaggtaagaacaccgtaagtagatgaaatggtgattttaccacctatatcaatgagcagtacaaactgttcatggattggaaacttaccgctgatttggtacttgtatgatcaaagagggtgtgccgatggttcacacaattgctcttggcccttgactatctgcactgcaaccgtgtgctccaccgtgacctcaaggtaaatgaacattgtccctatccacacaagtcgattcatcaggtatcagcatcacctaacatgcccttggctcctgtgctgttacagtgttccaacattttgttaacaaaggataataacatccgtcttggtaagaaatatatatttcaccataaatataaattactgcatctttcctttttcttggatgatagtgtagtgacctgaatattcattgtttcttgaaaacagctgattttgggctagcaaaattgctcatggaggaccttgcatcgacggtatggcttaaacctgtgctatcatgttgtgtaaatataactcgcaaaacacatttccaggtagcaaa

SEQ ID NO: 22295 - DNA, 10235 bp, Oryza sativa
cgatcgacagattgatgaggccatctttcttaaagctgtaagaaccagcagcacagtagatgtcgtgccagtctctggtgcaattcagaagcctaatgaggcaccaataccaaaggaggacctgaccatttggagtagtgcaagagcagagaaaggaagtgaaagcacacactcaccaaggatcaaaaccaggcacaggagacgttcccatcgttacagaagaatcatcaccgaagagcgcggtgaaattggcacattcagatagcactcctgccgagtgggaccatctgaacatagtgcagcagagagctgacgcactggagtcgctactcgagctttgcgccaagctgctgaagcaggagaggcttgagaagcttgctggcgttctcagaccgtttggggaaggtgctgtgtcgtccagagagacgccgatatggctgacaaaaagcctcatgcccccaccaaaattggaagggtcaccaaaacttacgtaggggagcgaatttcatggctttgtttgcaagtgtgctgttctggttctgagagtgtatatagctttgctacagttcatgattctgtatcactgaggctcgagtttctatttatcttgatgtatatggtttgagtgagcgagggcattgtgtgagctaactatttatcagatatttactgtacaatggcatgtgctgtttggctgattcaagtaataatggaaatcataccatgttcattcctattttcttccagccttccttactggagaactgtttatcaatgtgcagatttgttattaccgacaggaactgaatgggaagaggcaatattaaggggatgttcagattgtagccaaaataaaatgctggcaatattaccaaaattttggcaggatttcttatgtatttaccatagtttgattaaaaaaactaaatgtatgcatatctttgacaactttaccaaaaattgtatggtttgaaatggcatcaatctgaacagcccctcagttcaagcatactatatccgggaacaattttttgactaatcacttggttccgatgattctagaaacaaaacgatcactccatcctgatcaagaaataggagcaaaaatatagcctagtagtgagtagtgagcactgagcaatacttgatgatgacagaacagagaatatgtaacactacacagcactggaaaggctgacctgtactgctgtagccctctgctcactgaatgattttgtcaccttatgtttgggcattgttaccactgtcaaaggaagaacctttgccgtgcttccaagcaagaagccttgcgctttctgcagaactcaatctgctacaaatcaacaagatatggttgtttcttttctgcgagaatcatgctctgcgcactttcagttcctggggctctggcttataccctgctactgtacggtgtaccatgtccaggaattgatccctgaacactcactggaaaagaaggtgtggaaaacagcagatagaacatgcatcactgtaacacacagtacatggcaggattcagtcagcctaaccgtagacagttgctgaattgtaaggatccgtctccagtattattgccgaattgggttatttgagagctaagttctcaatttaaaaatgatgcatatatttggttggatatagaggccgggtaaaaattacccttatctaaaaaaaagtattattccagatgccaacaatgatgaaatttaacacatagtataacaagaaggaccatgtgttgtccactttggcacgtcagatctttatatgaaaatctggtgtgtaaattatactagtttgaagtgtaagcccgatagcccatgtaccacaaacagtcagtagagactagagaggcattcactacatatgaacgatggatacgtgcttggtgaagaaagaagtacatgatgcgaaatcagtacaaaccttcctgattcgatgatagtcaagagatcctaaaccagacatttctcctcacgatcgaacattgttgtagtgacttcctctgaaacaaaaaaaaaaacatcagaaagttcatctccctaatttgcaattagttaccaatactgcaaggaacagaaagcaaacgatgttcttgcatcaaggtagcacgatgcagtatcgtccttttcctattcggcgaggacgcgcgcgttcgatgaaccaaagggatcgagctcccccaaggaagtgtatttgcggatgcaatggtccaaattccgcccacgcgcaagtaggcgcatggatctctagaatctccgatagggttggaaagtgggaagcgatatcgtcggtggcgcttacctcggcggcggcggtagtgaggaacaaaaagccgaagcagtcgcggcggcagacgcgcgcggaggtcggtgcgtagtagccgttgcactgcgggagaagaggatctagggtttatggctgggagagagattagagagaggatacggtttgaaggaagacgcagagcaaggaaccacctggagccatttggaggaagaatcccaacttggggggtcgtcggatgcggcgccggcgccggcggtagccacggtgttcggcgaaatgcgcgagcggagtggacgggagcaggaggagagaattgtgcactaagacccctgatttcggttagatttttcccttttgttgaatatggtcgctaaaagtttcgcttcggactaaatttagtagttgaggttttaaattgttcaacaagttctccaagttaatcatttgggttaatatagtttttgaaaaaaaaacgtttcgtgagtatgccaagtcatcctcacatgcatcgataatacgaatgaaatgataattatacccttatatgccatatagaaaagaaagaagataaatgtttctcacgcgtatgatcgttttagaattgtcacttattattgatgcgtccaagcactgatcgtatcgtatgaattcctttgtcggccaccctccgtaacaatgttgggcctggactagcctgttattttttttttgtctgtgtccttttctttcttttctatatggtatataagatagaatggttatttcattcatactgctgcatgcgaggatgacttggcatgctcacgtggctttttttttatccaaagactatattaacccaaataattaatttggaggatttgtttgagcggaaacaacgaaaactaaattaagcccgaagcgaaactttaaggactgtattggctattcaccctttttttaattaggccccccggttggtggtttgtaatggtcggagtttcctcactagaatttccctctattcgacctatcactatctctactactttaaaaaataaaatatatttccgccctccgtatataaaaaaaagggcgagaaaaaaattctgtcgtaaaaaaaaggaaaaaaaatgtccgactcccctaataaaaaaaagtcagactccggaaaaaaaacttctagtccgttaaaaaaagaaaaaaaagtccaactcaaagtgcgtaaaaaaaacgttcgccccaaattctataaataataaataataaagtgtctatccatatattttctcctctaattaattaaaaaattgattctctattctttccattccagggaaaaactaagggacgctatcccgtcacagcgggacagttaacgaatatatcctactaaggatgtcgtcggccctacgtgatccatctcacattaattcccacgtggctggatctcatcccaggctcccactcagcatggtgtccctattctattagttgcatggtgccttttgaatgatgagaggacacgttgtctagtgagtggtgagaaagaaacaaaagaagtccaattcgtgttaaagtctatgcatctactcttagatactgccacggttctagttaccttggtagtggtgtttcttttatttttttattcttggtttatttcttgatcttttttgtattttcagttgaagcacatttggaggtattgattttgtgaagtattttccctataatatactatgataagttctaatgctcaagtttgacctatctcattccgtgttttctatcccgacacatcttcaatttgtaacccatactatttcgtaatagtaatataagtatcaactcaaatacgtaccatcttaaattccatgggataccaaatttgatacaagttttcgctagctttgaaacctactagctctgaaacctgtgcataccagatttgatacacaaggtatcatgcctgatatttatgggtaccaagtttgatacccaggtaccatacctgatatatatatgcactagccatgatacatgcggatatcagatgacaaatattaggtctaatacttacggataccatgtttgatacctaggtaccaagcctgatacctatatgtatcagatacatataggtattagatgagtttgatacccaggtaccatgcctgatacctacaggcactagccatgatacatgtggatatcagatgacaaatatcaggtctaatacttacggataccaagtttgatacctaggtactaggtttgatgcctataggtactaggcctgatacctatatgtatcatccatgatatatgtggatattagatgagtttgatacccaggtaccatacttgatacctacaggcactagccatgatacatgtggatatcagatgacaaatatcaggtctaatacttacggataccaagtttgatacctaggtactaggtttgaggcctataggtactaggcctgatacctatatgtatcatccatgatacatgtgggtattagataataagtatcaagtctgatatgcacgggtatcaagtatggtacccaggtactatgcctgatacctatagacactactcatgaatcatgatacatgtcaatatcagatgacacaagtatcaactttgctcagatgacaacttgtcttatatgatccatctaaattatatgagcaatcattagttggtccaattagccaacctgataactgtgcatggttggcgtaaaaatccaaattatttaataacaaaaataccggaaaaattatattttaccacaagcaaactcattatacaagaataattttagtgcaggctacggccagggaacactgtccaatactaacgcataggcattaggcatagcttctagctagctagcgattgacacatgtaagctactagaccctataccagccgaccaggcaagctaccagaccctatagtgtttcatagtgtgtctaggggcacgtcttgtagaggcgtgtcttgtttggatactatacgcacatctcgtttaggggagagttaaagggtataccgttgaacggtattccgttctctagcagccctcttccttccacatcctttgccacatgatttccccttttaattaggctttaatttaccggataaaatcttcttttaatggttgtcaatgatggccaaccgacaatcttttttcttttttatcccaagtattgcagattcgctctgattttgggaaaaataaaaagaggagatcaagtggatcaaaagactacagtaaattctcaaaggttgagtatatttaatggggatgatcggctctgttatcatacggacacaaaactgtattccagaagttaggagaggcagactgggtgaagtgaggtaggatgcaaagctttttcaatttattcctcaaatcctaatagttattgtattactgacaaaaaaaagcctttacccgttgcaatgcacatgtaagtttccatcatctataaaaaaaaggagaaaaaaatagacccaaaagcgagaaaaaacaccatttataagaaaatcagttcggaaaaatcacttgattcaacacgagaaaaaacatcgattataaaaacaccggtccgagaaaacatccgactcaacacgagataaaaatcgttttatacaaaaaaaaaagataaaaagagtccgaatccacacgagaaaaggtggatcgaaaaaacatctgactccacgtaaggaaaaaaacgtcgtttataaaaaaaccgctctgaaaaactgtctgacccaactcgaaaaaaaccatgcgcatataaaaaaaacccggttcggcactgtgcaatgcaaaaaaaactgtctcattcgaggaaaagaaaacatccgactccatgaaaaataatcatatcgtttatattgttttacgtccatcttgatagctaatatctgttttgtctagagttgaccatccgagacagcgtaagatttgattaatcctattattagttacaagaatgagattgaaatagtatttcacattatatgtgtacaacgacataaataatccaattcttttgggtaaatgaggcataggtaatgttgcctcatcgccgaggttttgctatttacattgaagatgtttcaatttttcttatcatatgtcttagttacaacgatcgatacaaacattatcattgatatggctatacatgtgaaacgtatattgtcattaattttttttttacccgttgcaactcacgggcaattttgctagttaaataccgatgatgatctcgttgtatttgatgatttctgaagagtgactaaagcctgaacctttacaacgagggccaacatgaactgtttacatcactcgttcacactggcatgtctaagggcatgtttgggggagcttcgcaccttctcctataatctttcatgctgctaaaagttctccaaaaagtagaaattaccccctaaagtattgggtgactacaaattaccccctaaacctgaaaataagttatttttcaccctcaactatcgatactggatgaaaaaacaccctgagtagctttgcaagctgttttggtctacgtggcagcccaatcaccaattcttttatttttaaatcagtgggccccacatgtcagtctctcaccctctcttttatccctcacctctctatcactctccaaaatactctctcttctccctccctcaccaaataacctcgaggatggtggcgggcagaactcggggcgacgaaaggggcggcggagctcaagacgatggtgatcggagtgggtggtggtgaagagggcgcccacagccaccggcgctcgggacagcgtgtgtagggctccaacccgtttgttagcgcactatccaaccccgcccgcgacgcccccttccccggcggcgatggcgtggtggtggaagcgagctcttcattaacagccagatccggccaatgtggctcccgccgctcgataacgtcggcggcagcggtgagccgacgcgggagaatgaggcgggggtgggggacgagcacagcggacgccaccccgctccgcacatggctgtctccaccgccacaacttcatcttcgaccgccccgtcgtcgccctcgccgccggtcatgctgccagtcgcgccgctctcgcctccatctccatgccaggtgcgctcgccaccctcgccgccggtcgtgctgctctcgcctccacctccatgccgggcgcgctcgcccccaatcgcgccgctcttacctccgcctccatgcctggcacgctcgcgcccctcctccatggcaagcgtgtgtgggagagcaggccagtcgttgctgccgcgcagtttagaaggggagggagaagagagggggggctaggatctgacaaaaaggccctagctttgttaaagaatatgtttgttcactgaactaccacgtgtgctatttgaaccctaaaccgctctcaacagtactgtgggagggggggttgtctggtattaaaaattcatggtgaacgatgtctggttttcggtcggtcgactgctataattcagggggtaattcgtattttttcctatagaatttactcagattttgagaatatatagttgtggaatccagaaaataaactaaaagccaatagctggaaaagccaacttttcaagatttttcacctgcttgattctctccggttgcttctcagaatcttaaactctcccaaacatgacctaaatatcatgccgcaatgacaaatgtgacgcaaaattaaatatcacctctctctcaagtaataattgtataattgggaaattggagaatcgaagagtggcagcttaattatatgagtgttaacttacatgagtggcaaatagtcaaatgtctcaaaacttttgcggtatttttcggtggaactcctacaaggctatactgtggtatcaagcggagggcgtatatctattcagtaaggatgttttttttatatagatgcaaatttcttaattaaagagggtgtagcgcgagacattaccatttccattgttttcgctgcctcctacaccgatcacgcgcgcattaattgtatggcatgaccgcatgaagatgaccgtataacaactgtcgacgatggccagtaaatatataaatataaactattttaaaagacatttataaactgcgatattttgtttcacgataatacagtaacacgaatcgttcttacatcatcaactatttttttcccaaaacaaaaaaatgtttgattgtagtataactttaaaagtgcttatatctatatatagagtgtactacagatccatcgtcgcattctaaggaactacgggagtactaatgtaattttgcacggttaaatgggatttgttatacaacttcttattagctcctattttcatatgtatatatatgccatagatattagaagttctaatggatttaatatacaacttctttatttttttatttataaatacagttgtgtactttgtatacatgttactgttatcaatcgagttccatgaccaaacggcttagagatttttcattaatactagtatacgaggtcgcgtattcctgcgaatatagccatcacgttatcctgtaatatatcgtgcgtaagaaaattcattaatttaatatgtaactgaaaaatatattgtaaaggaggcataggtaatgttgccctattgccgaggttgggctattacattgaagatgttccaatttttcttatgatgtcttagttacaacgatcgataccaacattattattgtcatggttatacatgtgaaacgtatattgtcattaaatttttttcacccattgcaatgcacggccaattttgctagttaaacatgatgatctccttgcatttgatgatttctaaagagtgactaaagcctgaacctttacaaccagggccaacatgaactttttctgtcactcttccacactggcgtgtctaagggcatgtttggaggagtttcgcaccttctcctagaatctttcagctgccagaagttctccaaacagtttagaattggaaaaagtacgaattacccccctgaagtattgggtgagtacaaattacccccataaaccagaaaaccagttatttttcaccctcaaccatcgataccggatgaaaaaacccccgagcagctttgcaagctattttggtctacgtggcagcccaatcagcaattcttttctttttaaatcagcgggcccctctcttctacccctcacctctctatctctctccaaaatactctctcttctccctccctcaccaactaacctcgaggacggtggcgggcagaactcgaggcgacgaagggggaggcagagctcggaacgatggcagtcagagtgggcggcggcgaagagggcgcgcgcagccaccagtgctcgggacagcggtgaggtcagagtgggcggcggcgcggcggatgcgatagcgcatgcagagctccaacccgtttgtcaacgcgctgtccagcctcgcccacgacgccctcttccctggcggcgaaggtgcggcggtggaggcgagctcttcattaatggccagatccagccaatgtggctctcgccactcgacgacgtcggcggcagcggcgagccaacgcgggagcatgaggcgggggtggaggacgagcgcggcgaacgcctccctactgcgcatatggctgtctccgccgcaacaccttcatcttcgaccgcgtcgtcgtcgccctcgctgccggtcgtgccgacagtcacgccactctcacctccgtctccatgccaggcgcgctcgccaccctcgccgccggtcgcgccgctctctcctccgtctccatgccgggcgcactcaccgccctcgccgaggtcgcgtcgctctcgcctccgccttcatgccaggcgcg

SEQ ID NO: 22296 - DNA, 11792 bp, Oryza sativa
tcgaaccctaaaccgctctcaacagtaccatgggagggggggggtttgtcctgtatgaaaattcaagatgaacgatgtctgattttcgaatttagggggggtaattcggtcgactgttatagttcagggggtaattcatactttttcctttagaatttactcagattttgataatctatagttgtggaatccagaaaataaactaaaagccagaaactggaaaagccaacttttctagattttcacctgctagattctctccggctgcttctcagaatcttaaacttcccccaaacatgacctaaatatcatgccacaatgacaaaagtaacgcaaaattagatatcacctctccaataatagttgtataattgggcaattggagaatcgaagagtggcagcttaattataagagtgttaacttacatgagtggcaaatagtcaaatgtcccaaaacttttgcggtatttttcggtggaactcctacgaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgctacacttgttgtactcctgtacttgtaacatcattttctcgtaacagtgaagcagatcgatcatgctccacctaacacaattccgtgaaaaaaaaagataggccttctgaatattacctctaagaatgagactttgattaaccatttgaaattcaaccaccaatctattatagtatttaaacagtcttagaagcatcgcatttattgtgtaggctaaaaatagaaatacaatttaaaaataactaaaattcagaataaaataagaaatattaaaagaataatccatgttgcgaagatgttacggttttttctggctgtgaacttaatacaccatcagcgaagatggcagatcttcactggcggtcgtctattttacaagcggtctacttacacaaccgcttctaaaaataacttttcactacctacacagctgcccggaaaaaaattacttcgcgctataaaaaaaccctctccaccccttatctttatcccttcactcctcaccactcatcccttcctcccatcttctctcgagtgctgcagaggggcacgagtcgcgccgtgggctacggatccgtcctccggaggggcgcggccgatggttccggcggcgggaggcaccttgggcaatgacaacgagtgggtggcgaggctcccggcggctgaccagcggccgaacttgggagccgcagcaggtcgatggcgaagctaggtcggtggccgctgtgaggagacgaggtggatccagttctgctcccgtccaccctacctcctggcgatgtatttttttttcatattctttgtgatttgtgaatggatatgagtttaattagtgatttgtgatggattacaatgtttgtgaatgaatttgttgaatggattatgagatttgtgttgaatttgggatttgtaaatgaattagggtggtagagaattttggatttggggtaggggattttgaacctgtgggggattttcacttgcggttctctttacatacctgctagcgaaattatattttcgcaagcagctctccttacatacccgccagcaaaattacattttcacaagcggctaattttcgcttgtgaaaattctctattttcactggcctttgattactggcggatgggttggccttaccaaaaatataaaatggacgccagtaaaaatcattttgtagaggtgactaaacggatgttttctacttttctataaattatataattatgttgtgccttcgtgatatcttgatttaaagttataaatttaaatgagaactttgatgccaattatcccgcatgcacgagtatctctattggatgtgattttcttaaatttggaacataaataaatattcttgtttgtaatgaagaatattttaatgaaaacaattaattcaacatgatcacggtagatttgtactccctctgttttatgatataagtcattctagcatttctcacattcatattaatgtcaatgaatttagacatatatatctatctagattcattaacatcaatatgaatgtggaaaatattaaaatgacttacatggtgaaacggaggaagtagatgttttcgtaaactttattttcctgtgataaacttaatctgcatatattatatatgcatggggtattattatatgataataagcgaaacataactcaattttgtttttgaaattatgattttaatatctctagcatacatgataaggtagataataatttgattagttactaccgtcaaacctggtgggacaaattcgttgtgctgtaagtgtcacgttgagtttttttttcaagggaatacgcctctacgtgctgttttttttttctgacagcccttcctttttcttttattcgtgacagtcccccacagcaatacgcatccagatgcctccgttcccctcgtgtttgttcaggtttaggatgctttgtttttttttttttagggatcaggatgctttgtttggaagccaggccacgttcagaacttttttacttctgtgaccaggaccgattctatatccaacggttgcttttgttaccgttgctctatctgacggctatgattcgtcctaagatttatctcatgattctctcacttggagagagattggggtaacttttagtcctttaaagtggatataatagtgtttttctcgagctattcttgtaaataataaatagaatagcacaaatttgtgacagctagcagaggtccttcgacgtgcatcgccaaaggtgctaggtggtgtacactcatgatacacgatggtgtaactttatttgccattagtttacgggcaagtttaatagtacttagtataaaaaactattagccataaaattcaacacatcatttataggtaatttaatagtctatttatataataaatatatcatcaattaatacttgacacacctctgtaacacatacttcttccggtttttaaaatatggcgccgttctttttttatgcatattttaccattcgtcttatttaaaaattttatataaatatatgaaaatgtaattcatgtttaaaatatcttagtggataaacaagtcccaacaaaaataaataataacaatatttttctactaagacaaatagttaaatatggggttacaaatctattaaaaacttgttgaaacccgtacaactactctgcaacgtacatactacaaatttgtaatctattttttttctttttcttattatttaagcacaaatttgatagggacaactctggtatactctgggaaaaagataaaacaacttatgtagtataaatcagagggagcaagagtgctctaaaagaaaccccctcgcatctaagttttataaaactagtgggggtgtgcgaaggtaggctcaagcgttgattctgctcgtttagctagcccgcctctgacgctgcattatggagggagtaggcttgtagctagcccgcctctgcacgctatatttcaaggaatcagagatccatacagacagagacgttcagccatcagacctgcagaggcaatccatccatggcatctatcgttcctgtactcctgcgcctgctgctcctgctgctcccgcttcccctgatccgagaccacctctggccgagccaccgccggccaacgccgcaggacgatgcgggtgagctccacccgatcttcctggtgcccggggcgagctgcagcgacctggaggcgcggctcaccgaggcgtaccggccgtcgacggcgcactgcggcgcgatgaaggggaagggatggtttgggctgtgggagaacaacacggagctgctggtccacgactacgcggactgctcactggagcagatgaccctggtctacgaccccgccgccaacgagtaccggaacctgcccggcgtcgagacccgggtgcccaacttcggctccgcatggtcgttcggctacaagaaccctgttaaccggtaagtttcgctcctaccaaccacgagtccacgaatcacctgattaaaatggcaatatactctctcggtcccttattcccagaaaaaaaccaacctagctatagctagagcctgtttagatcaatttactatgccaattttttttggtaaatgttttgatggcaaaagatttggcattgaagttttggtagttggtgtttagatgcatggtaaaattttaccagtttattagtaatgacagagagagcacggctcccaacacactttttggcaaaatgtgttactctaggctcccaaatgataaataccaaattgctaactttttaccactagtgtttagatccatttcggtaaaaattgttccaaaacaatcaaacttttgccattttggaggaactaaacagggccctagtttgtgggacagatgagcacatggagagtggattttaaaccatccactcgttgtttacatgtcactagttataaaaatatttagaaaactatgagaagatatactctcccttttttttatccgctgaactaggcctaaccctagtactgccaccatgtggatctgccttccatgcatttccacctccaattgatgcaaaaatcgatttctcactactcccccatcatttttcatttccattttaattcaacttttaattcatcgaacctgcattgtgggttgagttgagccgaagagagacaagccgagcagagaaagatatcagactgggttggggctgaaaaagatagtttaaaatagtttcccatacacatgcatagctgactcttgaaaagagaaagaatcattagtacttcttccttcaatttcagaaataaattatgttttagataagattgtagtgaaagtcttaaagctttaactattaatattcttttaaaaaatagtgtgtgtgtgtgtatatatatatatatatatatcatacaaagaactataataaaaatacagttgtatttatttatgtatatattataaaaaagtagtaaaaagatatattatgaagaccattttgttgttcaaaacgttaacaattatacaaaccggtgaaattacgtgattcaatgctggagtaattgcttgattacatatatatatattttagtctacagagagcacaatgccttggaaagctcagagactggctggaagaattgggataccgtgatggggacaccatgttcggagctccctatgattttcgctacgccccgccggtacccggccaaacatccgaggtgtactctcgctacttcagcgagttcatggcgctcgtcgaggcagcgaccaagaagaagcagaagaaggccgtcatcctggggcacagctacggagggatggtcgcgctcgagttcgtcaggagcaccccgcgggcgtggcgggacgcgcacatcgagcgcctcgtcctggtcgcgcctacgctccaagatgggttcgtaggctcggtgatgaagttcatcacggggacgggcataattttcgtcccgacagccacgtccacgaggcccatgtggaggagcttcgagtccgccatggcgagcttcccgtccccggccgtgttcggccgcgagccgctcgtggtcaccaagaggagggactactccgcgtgcgacatggaggatctcctagccgccctcggcttcggcgagggcgtcgagcctttccggcgacgggccgtccccaggatgtacagcctcgaggcgccgatggtgcccatgacgtgcatcaacgcggtgggcaacaagacgccgctgcaactggtgttgtgggacgacgacgacgatgacttattagacgcgtcaccggaggtggcagcgtatggtgacggagacggcgagatcaacctgatcagcatgttggcgtttgacacggagatgggtcggcagccaggacaggagaagcgattcaaatccgtcaagatagctaatgctaaccattccacgattgccatttatgattttgcactaaagaggatcattcaagaaattattgaggtgaatcaggtacgttagtagacactccgtacgttgggtttcacgtatatatgttgggtttcactgtgcgcggtaatcatatatatcacgtgtggaattctgtgtaataaatgaatcccatgcagctttgtgtataccgatgggttggttggtaaataaaaaccaaaaattactgctcccaccatcccaaatcagaaggtatatatcattaatttatttcacgttatattccaaacgaatataaaatcagtatcatataaaaatacttaaaaatataaatctaatgatatacatatataatacttaacataaaaataattattacaatcattttaacgttatcgagtttgattatccttcaaaagatgacgccctataatttggaatgatgctaatatattagctcaatttaaggtaatggaaatatattgcatcctcggcctttgttatactacgtacaatcaataagctttttagctaaaaagatagtagttgaaaggccaaacccttactaccataacaaacaaaattagacagtagttgaaaggccaaaccctaactaccataacaaacaaaattaattgataataaacttaaaaaaccatatacattctaacatattacgtcactcatagtagaatacaaatacaaagatacttgactatcaactctaagaaagtaacactattgcgcgtaatataatgctccttccaccataacatcaacactaatattgaagctagcttaatgacatgaagataacctgcgtggaattaaacaactttttgttattaaaaactttatcatttcattaacatcaaaattgaccaacgaagtacactaaccctgaataaaaccattttcaagcgtctagctagacactcctcggagtaactcgtctagctagggactcctcggtgccagttaccaaaaatatttctggtggttcgaggaggagggatatcctatatatctataaagtgatcatctccactaagtatagttaatgatatttctctattctctcattaagtcaaatcacctcaactgtttctaactattggatggttgatctatggtctaaattatctccctcccttttcttctaatataaaatcataccaccatagttttatttttttatgattagtttatattaccttgttaatttctttttcttctctcattgagtcacattatcttagttttccttttacatgattaattcatatatgatttaaattgttataaaccacattatcatatgttttatatataccttttttttcaatagtcgggcatagatgaaaattatacaaaatgtagatattttacatgttatttgtactaatattatacaaaactcccataaacgcgggatatcatctagacaccatcatgcaaaacgagccatgtggcaatcaaagaataggtgctgaattgttttctacacattgcagaaaccatccctaccacaaaacaaccaatacaagtcggcactataggtatcggaagtgctaaaatcgacacctatagaccttttcctacctccatgtaatgaaaacacaaacaacgacacccttaagtgattataggtgccagttctgtaaaaaaccaacacctatactattggtgtcgctttttcaaaaaaaaaacaacacctataataaattaaaggtgtcgtttttaacaccttttaaaaactgagccgtgagccgaaccatcgaggagtggataattgaggagagtgcgtggtgaggagacaagtctctctctctctctctctctctctctctctcggtctgatcgcttctctctctcgcgcgtctctctctcgtcgtacctctctctctctcgcgcgaagcagctccccatggtcagcggcgccctccccttcgccaaatccaacgggaggggagggtgccggcaactatattttggatttttgggtactcgatctagcaaaacaagttagatggtcaaactgtatcggttgactacccataaaacatttgtttgtacaacacaaaagaataaatgagttactaaaacatcagttagtgacatagaacgcaatatcaaaaataaatagagaaaaagaaacaccaccaaatccacataaaacattaggttctaattgttgaaaatcgtaaaattaatacttgttgaaacattaaaaaaactacaacattcacatgaactattgaaacaccataaaatacttattgaaacatacaaataacatcatacatagcattaaaagccctatcgttttgcttatgcttatccttattttgtacgacttgttcacaacaaaaaaaacatgagaaaaacttttatatacatgtttttagcgattcaaaagcaaatgctgtaaaacaaactacaataaaaaattacaaaattaactccaaaattaagttttagaattcaaattttagcttataatcataagcgcaatgatgaagatgctaaaatataaactattgcaccacaacatgattctccttgccatcaaagaaggtgaacctggaataatgcagccttctcaaatcgctagctttgatatgctctgcccttgtaacatttgaaggcttgcgtgaagacaacccatgcaatgatggatatgacaaggaagaccaagaaaaacttcactgggaaggacacaatcatcattaccatactctcaattagagagtgaggttccacccaccgccaccggatccatgcatggtcagaacccctcaatccggggcacatcatgaaccccaccgatggagcaaacgggatagagagcactacctctctcattcactggggtggagacaattgatcttttgtcgatgtcgtgtgggccaaactcttgctgggagtcgtgtcgaccaagggagggatgttgcactggtcgatggaaatcaatgaatagatggggaaggagtggatgggtgtggtgcatgatacaaacatttctttttccagtatcgagagttagagaggaggagggggtggataattggtgttatcttcagttccaactacttggggggacattgagaactaacagttggtgaaacctagtgatcttcagtttcacctacttagaggggacattgagaacgatatagttggccaaacctggtgaagctgcaaaatggtaaatacgggggtgggtgtttagttcaggggtgtaaagttttaccgtgtcacatcgggtattatatagggtgtcgcatgaggtgttcgggcactaataaaaaaactaattgtagaatccgccagtagaccgcgagaagaatttattaagcctaattaatccgccattaccaaatgtttactgtagcaccacattgtcaaatcatggagcgattaggtttaaaagattcgtcttgcaaattagttgcaatctgtgcaattagttattttttagcctatatttaatactttatgcatgtgttcaaacgtttgatgtgacggcgtataaaatttttgctagctgacgcactaccagacttcaggtctaccctgtaggccgaaaaccgtcagaataatatgaattaccatcagaaaatgcttttctgtgggtgcaccgtcaaaaattgccgacagaaaaaagactacggagaaattaaatttttctgtcggtttcctgacagaaatatcatttttgaaagcttatttttgatagaaaaaagaccacggaggaattcctgtcggttggctcacagaaaaaatcaactggcgtcaggtttctgaaagcttatttttgacgtggacccgtcaggaaaaaccatcatccaccgtcagaaaaaatgagttccacgcccaaaaaaaaaatacacatggcgatttggataaatatatgaacatcaatcacaatccatacatcaaaattcaagtttgcaaagcttacataaatagtccatctaagttcagtacatacaaattcattcaaaccggatttagtaatatacaaagggtccatagaaaagttaaatggttcagttacaattcatcaaacacatgtaaaagaaaattgtcttccagcagcagtccgtgttccgtggtgcttcaaccttgggcaaaggaagctaaaaggtttaaaaaaagaggttcaatttcataattttcttcattacaaaataaataacaatgattatgaataccccagttatagagaaacaaatagattagtacagggaaaaactgaagtgagcaacataaatttctcaactacaagcatgaaaatgaaatatggcaactgaaatgaaaagtgaccatgaaaatacttcctgtagtactctgccaattcagataagacataaatgctaggataataggatcagactcattttctatggatgcttaaatgacaagtttcatggtgcaaatgctaggacatcttagactaagaaaagatttcatccactgaatgagaagcataccttgattttcatcatgtgcaacgttctgtagatatttaactgcagcacttaaatattcaagctatggcatgttaagaaaaatacaaagtgacatgaacaaggtaaattataaagggtttgtacataagaaaattctaaaaacaagagactgaaactaatttattgttctgatggcatgtatctatccaacacatgtagcagtatgtgacttgccaaaagatatacaaggacttagacttgtgaagtatgtatatgcactactagagactagaaagcactaatgatttcatgcatacaacctgagctaaaaatatgttttcttagctactgaaacagagaaaataaaacactataatactcattattcacacaatccttaccatgaattgcaaggtaaaaatagcataagaaaagcatctgcattctaactaaatgtgaccaagaaagcatagtgcatgatattccactgatagattaatttcatgtcaaacaactcactaccagacacatacaaagttttatgaatagcagggactctagtgtgggagtacctgtcaatctgtcatgccacaatattaggtcttcacaaaatggctagagaaaaattagttggtccagacataattacaaggctgaaacaagaaacaaatcatttagatgtaaaataaatattatactctaggagtaatccaaaaaaaattaaatttctattatagaaactaaatcacataatgtagacaatatgggaaccaacttgtcttgcttaatattggaaaaaataataattagcaacaacagtaatggatcaactaatccaatctagattagttgatgaatgcagcaacgcaggttttgacacaagaacccaaccaatctagatctactgacattccactgacaatcattaaacttgttgtaaagggccaataacccaatccctagcaactaattgtgttgaaactatatctactactgggcagtcatgttagaataggtgtcaaatatactagtcctatttggttacagttggacttggagttgtaataggtgttagggggtggagttagagtcggactctgtaacccggcatctctcttaaatagagaggggggcaccacaatg

SEQ ID NO: 22297 - DNA, 21421 bp, Oryza sativa
agttggatgataaaacgacttgtcggagtcggacaaggctgactcgaccgcaattgctatggagtcggattcagagttatgtatggatacggactcatgatcgcatcagactcgtattgcttgccctttaaataggcagccgaaaagagagagccgaaccaaagcaacaaagcggcagcgattttttgggcggctcggcaggacattggtcagacgtggtacaaggggctcaataggcttgttgtgcagaggcttgtgacaaagtgcgcgcgtatgggtggaccaagccaggccgacgagatcgtgcagagcagaggcacatcgagggcggaagattggtcacatcggattatagcgaacgcggtttgctgttgaatatctgagattggatcacaagacgggattgtgaagacgaatacagacggttctgagcagggcgagtattctggtggcgacagaccagtcaggtcgcgggttggcaagatggcgccgacaggtatgaaatttgatttggtgaatccggaaattttggcttgtggcagactagggtcaaagatttgttagctcaacaaggagtttcaaaggctttgaagggtgtcaaaccggccaagatagaggatgacgattgggaggagatgcagttgcaggcggctgcgacaataaggctatgtctctcagatcgggtcatgtaccatgtgatggaggagacctcaccaaagataatttggaaaaagttggaagctcagtttatgtccaagactctgaccaataaactgtatctgaagcagaagttgtatgggttaaaaatgcaggaaggggcggatctgacagcacatgtgaacgttttcaatcaactagtcactgatcttgtgaagatggatgtggaagttgacgatgaagacaaggccatagttcttttgtgttcgttacctaaatcgtatgagcatgtggtgactactttgacgtacggcaaggagaccatcaaaactaaagatatcacttctgcgttgctggctcgtgatcagatgagaaagaataaagagggtgaaacatctcaagcggagggtttgctagtcaaagaagatcatgctgggcataaggtaaagaagaacaaaaagaagaagatggtgcaatgcttcagatgtgatgagtgggggcatataagcagggagtgtccaacactgaagggaaaagcaaaggctaatacagtgacttcttcaaatgactcggatagcgatggttgtgattttctcacgatgtcaagtgcacagtctaaggatgcagaagcgtggatattagattcagctagcttgtttcatatgacgccaaggaaggagtggttctcttcatacaagtctggtgagtttggttttgtctacttaggcgatgacacaagttatccggccatgggagtaggtgaagtcaaaatcaagctagaagatggaggtgaacatgttcttcagggagtcaggcatgtaccagggctaaagaggaatctgatttcgcttggaaccttgcatgaagaagggttaatattccgcggtaatcggaataggaagaccattgagatcatgaatggcaagatggctgtgatgactggagagaaggtggagtcgcatctttataagctgcgtgggtgcactgttgcaggtggagtccaggaggaagcggttgctgggatagcaattgcttttggtggcggcgggtctggcgcagactcgtcgggcggcttgcagtgaagctgcaaagaagacaacccaagtctggaggaccggtggatcggcatggtgattctactacttctaggtggcgtatattcgccaaggtggagtttgttagaataggtgtcaaatatactagtcctatttggttacagttggacttggagttgtaataggtgttagggggtggagttagagtcggactctgtaacctggcatctctcttaaatagagaggggggcaccacaatgtaaccatggcgactacaatgtagcgtagacacgcagggagatgatggcggcgtggccatggactcgtagtggctaggagctatattggttggggaggagcgcccataatcagagccccggggatgtaggcttcagctgaacctcgttaacaaatatcgtgcgttcctgtgtcgtcatctggcatgtcttgggtgatcgatgactgaagcgatcaggaaagttagtcgtctttccgctatatcgactaacttttataacaagtcacgtaatacagatgaaagccaaaataatccacaagtgtaaactagtatgacttaccctttttcatcctgaaggagaacggttggctgcaactttggagcagattaaattgaactcccagatatctccggcggcggctatctgaacaaatcggtggttgggattagcagcggaaacacatgctagcatggacagaggtgctccaaaccgtttcctcaccattgaaacacacatatttttggatgcttttacttactgaagaggaggggaaggagggcagcgcccattctcctgccggcgctgccggagccgagaaccgcgagatctggagcacccacactcggtacggctggatccgtggttcccagggttaggtcatccagatcaagaggttctgagcttgggccttggggtggctagcaccggcagtggaggggatggtggaaactcgtcaccggcaagagatggtggtgatggtcggctgcatcttgccgatggcgctgggcggaggctcggtagccgacccgccgttcgtcgaaggtatcgcacaggcgctcgccatgcggatctagagagaatagaggggcggcggcggctcgagggtttgggaagaggggtggggaattaggttttgggacttggctgcctgagttttatttgatggttcttgaggcccacttgtcagcgctttttttctgtgggtctgtgtgaaaacctataaaaataacacaatttttctgtgggtataagtaaccccgtcaagaaaattaatattcctgtgagttggccgcggaacctacaggaaatctagcggcccacagggtagctctcaagtctggtagtgacgggatgatcttgatgtttcatggtgcccgtatcaagcaactacttcgtactgttgtgcatcttaggaatccaagcaattaatcctccaacatctacagttctacgccatcgtcgttggctcgttgtgtgcgtgggcagcatagtacgtgtccagttgtaaaccactcatataaagtgacagactacctaagtaaagtgacaggctacctaagtttagtatagtgaacaccatagttggaaaaagtgtttcgtcccttaaaaatatttattttcacaattttattattttttaaatttatatatgtattaaatttgtggagtgatatatcccatatgatatctattgatattttttttataaaaaagttatgtcaccattccggtggcatgagtccgataagagcagtggagatgtatttttatctcttattaggtcttgttttcccgtaaaggagggatttgaaggagatttgttccatatctattagtagatattcaagtacgttgtgtttcactgtgcgcggtaatcattagtggaggatggataccgccacacttgttgtactcttgtacttgtaacatcattttctcgtaacagagatgcagatcgctcatgctccaccaaccataattccgtgcaaagaaaaaaaaagataggctagtcctaacttctgaatattacgtctaagaatgagactttgattaattaatcttttgaaatttcgaccaccaatctattataatattaaaacagtcttagaggcaccacgtttattgtgtaggctaaaaatagaaatacaatttaaaaataattgaaattcagaatataataaagaatattaaaagaataatctatgttgtgaagatgttgcggttttcgctggcggcgtaattaatacaccgtcaacgaagatggcagatcttcactggctcgtctattttacatgcggtccacttactcgaccgcttctaaaaataacttttcactacctatacagctgcccggaaaaaaattacttcgcgctataaaaaaaaatcctctccacccttatccttatcccttcactcctcaccacccactcatccattcctcccatcttctctcgagcgctgcagaggggcacgagccgtgccgtgggttatggatccgtcctccggaggggcgcggccgacggttctggcggcaggaggcatcttggacaatgacagcgagtgggtggcgaggctcctggcggctgactggcggctgaactcgggcgaggcagcaggtcgacggcgaagctaggtcggcggccactgtgaggagacgaggtggatctagctctgctcctgtcctccctacctcctggcgatggattttttttttcatattctctgtgatttgtgaatggatatgagtttaattaatggcttgtgatggattacaatgtttgtggatgaatttcttgaatggattatgagatttgtggtgaatttgggatttgtgaatgaattagggtggtagagaattttggatttggggtaggggattttggacctgtgggggattttagatctggtgggggattttcacttgcggttctctttacgtacccgccatcaaaattacattttcacaagcggctcttcttacattcccgccagtgaaattatattttcataagcggctaattttcgcttgtgaaaatactctattttcacaggcctttgattacttgcggatgggttggccttaccaaaaatataaaatggccgccagtaaaaagcattttgtagtagtgactaaacggatgttttctacttttctataaaatatataattatgttatgccttagtgttaccttgacttaaagttataaatttaaatgagaactttgatgccaattattccgcacgcacgagtatatctatcggatgtgattttcttaaatttggaacataaataaatattcttgtttgtaaggaagaatattttaatgaaaacaattaattcaacaggattacggtagatttgtagatgttttcgtaaactttattttcccatgataaacttaatcagcatatattatatatgcatggggtaattatatgataacaagcgaaacataacttaattttgtttttgaaattatgattttaatatctccagcatacatggtaaggtagataataatttgattagttacaaaaatttgttgtactataaagattcgttgtactttatacatgccgcttttttttttctgacagcccttccttttttttattcgtgacagtctcccacaggccacagcaaaacggatccagatgcctccgttcccctcgtgtttgttcaggtttaggatgctttgtttttttttttttgagtgatctgctttgtttggaagccaggccatgttcagaacttcgttcccctcgtgtttgttcaggataatttgtttggaagccaggccacgttcagaacttttttacttctgtgaccaggatcgattctatatccaacggttggttttttttttttaccgttgctctatctgacggctattatttactcagaagtctcagtgacgtgattcgtcctaagattatctcatgattctctttgcacttgagagatattggggtaacttttagcgaaaacactaattagcgaccaatcgcgcgcgccctttcgcacgtgactggacacgtgtcgcgcacgggaggagcggcggatcgcgcgtgtacgtacagttttcctttatttttttctggtttcttctgcggacggagcgcgtgtacgggttccttttttttcgtttttcctgctgcttccgtattttcgggttcttttttccttttatttcttttttaatcttttccaggttttaatacatgcgtatgcaaactttatatacgtgtatttttttttagatttttttacgtatgtatacaaagtttatatacgcgtatacaaactttgtatatgttttttgttttttcttggctttcggttttttaaatatctatgtatttatatatacaaagtttgtatacacgtacacaaagtttgtatacaacagtgtaacagtagtagcaacagtgtagtagtactactagtagtagtatagtagtagcagtagaggtagcagatagtttactgtagcaccatattgtcaaatcataaactaattaggtttaaaaagtttgtctcgcaatttacacgcaaactgtacaattagttttttttgtctatgtttaatactatacacgggaactaaactaggcctaaaagttttttacctaaaaagacagtagttgaaaggcctaactaccgtagcaaacaaaattgacagataaacttaaaaaaacccgtatagaatctaacaaattacgccactcatatagtagaataaaaagatccttgactaccaactctaagaaaggtaacactattgtgcgtaatatcatgctccttctaccataacatcatacatcaatattgaagctagatgaaagatatgaagataacctatgtgagattaaacaacttttttttattgaaaaccttatcatttcagtaatgtcaaaattgacaaacaaagtacactaaccctgaataaaacctttttcaagcgtctaggcactcctcagagcccgttatcaaaaaaatttctggtgcttcgagaaggagtgatatcctatatatcgatccctactaagcatagttaatgctatttcttttttctctaaattaagtctaatcaccttaattgtttttatcccttggatggttgatttaggtctaaattatctccccctttttcttttgttataaaatcatatcaccttagttttgtttttatgattaatttgtattaccttgtttcttttccttttaaacgatcaattcatatgtgatttaaattgttataaaatacatcatcaaatggtttatatatagtttttttttcaatagtcgatcagagataaaaattatacaaagtgtatagatattttttcaatagtcgatcaaagtcctaaccacatatatatctcccattaattgccatgtcggaaagattcataccgtgaaaattgatcttaatttcgacccagagtgtaggtcgcgtcgtgccattccaactgatctcagacccgagcccgatcgcgtgctcgggccgaacggctcatttgaccattttccatctatagctgttagccacaataacgtattccctacaatcgtaaatattagacgtttacagggttaaacttctaaaatattgatcatcattttctactagaatatgttactctaataggttcatgatattatgtatgtgaattttaaggcattttaaatattgtattgacgcaagtgtagattatacgtaaggcatttttaaccattcgagatgttgttgatgatggaatttaaagatattgatctgatcttattttaaacatcaaataattttcattagagggattaatgactatatatgtcacgctatacgttatattttgctaaactccctccataagcactgcattaattcaagccatcaaacctagagagacactctccacccacacccccatggcatccattccactcctgcggctgctgctccctctccctcttcgggagcacctctggccaagccaccaccggccaaacgatgccggcgtcggagccggcgatctccacctgatcttcgttgtacctggggttggctgcagcaacctggaggcacggctcaccgaggcgtaccggccgtcggtgcagccgagctgcggcgcgttgaaggggaagggttggttcgggctgtgggacaacagctcggacctttcgacgtaccactacggcgactgcttcaaggagcagatgagcctcgtctacgatcccgtcagcaacgactatcggaacctccccggcgttgagacccgcgtggccaacttcggcattgcgagagggttccactcgaagaacactttacacccgtaatatattcatattatatgttgttttaacattttcttatttgatttaaattaattttgatcaaacttatagaaattatagctgcatttctaacacaaaacaagcatattattaaattattctgaatattagttttaatgaaactaatttggtgtttgatagatttttttataaatattcaatcacatcaatctgctgatgatgtagtactgtagtaatctgtagtaattattacttagaatagttataatgttgcctacgctgatctactgtttttcttctgtgtgcctgatttgtagagaaaggtgccttgcaaagcttatagaatagctggaagagatgggataccatgatggagacaacatgcacggagttccctacgatttccgttacgctgctccaatccctggccaggcatcccaggtttactcgcgacacttcaaggagttcatggagcttgtggaggctgcaagtaggaagcatcgcaagaaggccatcatcctcgggcacagccttggagggatggtcgttctagagttcgtcaggagcactccattggcgtggcgaaacaggtacatcgagcacctcttcctggttgcgcctacgctcgctccggggttcatgggccccgtgaagaaccttgcctccgggccaaacgatattctctgcgtcccagatgctacggacttgtccctgcgaccaatgtggaggagctttgaggctagcattgccaactttccatctcccggggtctttgggcacgagccgatcgtgatcacaaaccagagaaactactctgcgtacgatctggaagatctccttgccgccgttggttttggcgacggcatcgagccttttaggagacgaatggttgcgaggatgagctacttcgaggcgcccatggtgccgttgacgtgcatcaatggagtgggaaatagaacgccacggcaattggtgtactgggatggcaacttcgatgaaccggcacaattggtgtatggtgatcgagatggggctgttaatctgattagcatgttagcgttcaacgaggagatgcgtcggcagccaggacagagggggcaattcaagtcgatcaaggtcgaaaacgcttcccatagggggattcttacggatgaatgggcgctaaagagggtcatgcaagagattcttgaagcgaatcgggattcttcgtaggctattgtgcttataaaacttctgtttgaattgatttacaagtatgtacaccggtggttccctaaattgggattctctagtattcttttgtgaatcggggtatgtatagggaagaaagattgatatatgtatcatccataccatttgacacatgaaaaatgttgcatatttcccattgtattaaatatttcttgcccatttatatgcaaatatccttgggtaccactacgacaaaacaatcatccctgtcaactcatttgtgccaataaaactaaaaccgccaaaaataagccatccgtgctggcgtgtaacaacaacgggaagcgataatccctcagagtgttatccaccggtatgtatacatcagtgactatgtgtgccgaatcttcttaccaactgtaacaccccgaattccatataaccgatgagaactgttttgaggaaatcctatgttcaaaactgtattcctttgtgtgtattaagtatctggttctcagggttatagataccacatacctaacagtagttgactaaatctcgacaggacccaccacataccatgtcttatacggaaacaaccttcggatataggagtagttccgcataaggaaggatgaataaagttctacatggaaacgacaaggactactcggattgtatctatattggtttccctagctctacttggacaaggggacacctataggtataaatacaaggcctcctaggaggagaggggacacggaacaatagatcaagacacaagagcaacatacgccaagacaagccgccggatatcgacatcggagataagcctatttagtccccatacggttcctacgactactgtcaggagggatctagcgctatctctgatctcaccggatgcggattcgaggaggaagactaccctgttgtcgactacgagtcagcacttcagaccgccaagtcgacaacagttagataggctaccccaaatattgtactggtgtgattatagtgaataagagcaacgaccgacttcggccaacaggagtagggttattacctgacaattcaggggcccgaacctgtataaaaatcctcatcctatctcttttactacaatctcgcatatatcctaataccaacgatctccatactatgcaaataccagaatcgcgacatcaaacatcaacactagtttcaagagctcaaatcaaaacaatcgttgtagcccgaaaatctcactctaaagtcctccctaaaataaaatctcgatgtcaaattcaaatcctatcttaaacccttctccacaaattctttcaaatttccgatatatcaaaattcactgaaatcaggaaatctcctttgcaaccatgtaggttgtcaagattttccaataataaattaaattctaatatctctccatttcatgtctttttccaaatttattcaaataattctaaatagcgaaccattccaaaagttccttgaaattcttctatttccctctcatctgtcaccttttcttaaatctactcaaatacatttcaaaaaccacaaaatctcattaatccctcccctttgaaaatgaaccaaattaatccaaagaacatctaaatttaattcaagactcaaacctcatatgaaatataccaaaactcaagcaaacatccttcactagaattcctataatatgtgcaaatttgtgcatcaaattagattccaatattgtagcgcccgttccatcgtggcgcctagtgggaaaattaaatcttaaaaaacctaattgcgaaatatgtttctttgattgttgtcaagtatccgtgcctttcccgatcttcatttcccaatctatcgtcgaattcggtttccaattcaaatcatcttccaaatcagatcctcccgcaaaagtctattttgcctccctcgggttcgtgggccgatttcttctccccttggcccatttccctctcagcccgcttcctctctcccttcccgcacgtgctgtgcacgagcaccatccgagagagagagctcatataaactgcgatatttatataaatactgaacatcaacacaatttgtaatatcttactttggccagtaaatatataaatttaaactattttaaaagacatttataaactgcgatatttagtttcacaataaatacagtaacacgaatcgttcttacatcatcaactattttttccccaaaactaaaaatgtttgattgtagtataactttaaaagtgcttatatctgtagagagtgtactacagatccaccgtcgcattctaaggaactacgggagtactgatgtaatattgcacgggctagttaaatgggatttgttaaacaacaacttattagctcctattttcatatgtatatatatgccatagatattagaagttctaatggatttaatatacaacttctttattttttttatttatagatactgttgtactttgtatacatgttactgttatcaatctagttccatgaccatacggcttagagattttccattaatactagtatacgaggtcgtgtattcctgcgaatatagccatcacgttatcctgtaatataccgtgtataagaaaattcattaatttaatatgtaactgaaaaatatattgtaaaggatgcataggtaatgttgggagacgactccgcgtcggacgtccgatattccaccaaatatcggacacccgactgtttacgcgtcatcacaccacctatgtatacagcatgcaaaaaagaaatcagtcagtcaaatgttccagttaactaacgagtgaaacatcaagttatataggttgaaacaaaaaatcatcaactgaaacatttaaaaagtttatgaaacatggtgaaaatacacgttgagacatatcactatcacatatgaaacaactaatgttaatggattgaaacatatgtttttctttcatcaaaatataatcatgtgatatcttgttgtaaaaatttaattacaaagaatacaacggtgtgatcggatagattggataattagtttaagagaaaaatcgttttgaaactagctaaaatgcatgcatgcatgcatgcatgaggtggagagagagagaggagagagagtagtaacagtttagttttgtgaaacatgctgaagacacgtattgaaacatatccctatcacgtatgaaacaaaagtgttaatggattgaaacatataattagtttttatcagaatataatcatgtgacatcttgttgtaaagatttaattacaacgaatacaacggtgtgattggattgtagattagataagtaatttacgagaaaatttgttttaaatatcgttaaaggtgcatgttataggcttggataggtgtatgtgtgtcacaggctgtatgtccgatttttcaccttgcttcggacgttcgaggagaagcgttttccgtaatgttgccctattgccgaggttgggctattacattgaagatgttctaatttttcttatgatatgtcttagttacaacgatcgatacaaatattatcattgttatggttatacatgtgaaacgtatattgttattgatgtttttttcacccattgcaatgcatggctaattttgctagttaaacatgatgatctccttgcatttattgatttctaaagagtgacaaaagcctgaaaaccagttatttttcaccctcaactatcgataccagatgaaaaaaccaccgagcacctttgcaagctgttttggtctacgtggcagcccaatcagcaattcttttctttttaaatcagcgggcccctctcttctacccctcacctctctatctatctccaaaatactctctcttctccctccctcaccaactaacctcgaggacggtggcgggcagaactcgaggtgacgaagggggcggcagagctcagaacgatggcagtcggagtgggcggcggcgaagagggcgtgtgcagccaccggcgctcgggacagcggtgaggttggagtgggcggcagcgtagcggatgcgatagcacatgcagagctccaacccatttgtcatcgcgctgtccagccccacccatgacaccctcttccctggcggcgaaggtacggcagtggaggcgagctcttcattaacggccagatccagccaatgtggctcccgccacttgacgacgtcggtggtagcggcgagccgatgcgggagcacgaggcggggatgggaaacgagcgcggtggacgcttccctactccgcacatggctgtctccgccgccacaccttcatcttcgaccgcgccgtcaccaccctcgccgccggtcgcgccgccagtcacgccgctctcacttccgtctccatgccaagcgcgctcgccgccctcaccgctctcgcctccgcctccatgctgggcgtactcaccgccctcgccgaggtcgcaccgctcttgcttccgccttcatgccaggcgcgcttgccaacctcttcgccggtcatgccgccagtcacgccgctctcgcctccacctccatgcttcgcgctctcgcgccctacctacatggtgagcgtgagcgtgtgcgggagagcgtgccggccgcttctgccacgtggttcagaaggggagggagaagagagaggggggggtgaggatctgacaagtaggccctagctttgttaaaaaatgtttgttgactgcactaccacatatgctattcgaaccctaaaccgctctcaatagtactggggggtttgtctggtttttgagtttaaggggtaattcagtcgactgttgtagtttaggggataattcgtacttttccctttagaatttactcagattttgagaatctaaagttgtggaatccagaaaataaactaaaagtcagaaactggaaaagccaacttttccagattttcacctgctagattctctccgtctgcttctcagaatcttaaactcgcccaaacatgacctaaatatcatgccacaatgacaaaagtgacgcaatattagatatcacctctctccggtaatatttgtgtaattggctaattggagaatcgaagagtggcagcttaattataagagtgttaacttacatgagtggcaaatagtcaaatgtcccaaaacttttgcggtatttttcggtggaactcctacaaggctatactgtagtatcaagcggagggcgaagaattatatccaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgccacacttgttgtactcctgtacttgtaacatcattttctcgtaacagagaagcagatcgatcatgctccacctaccacaattccgtggaaaaaaaagataggctagtcataacttctgaatattacgtctaagaatgagactttgattaaccatttgaaattcaaccaccaatctattatagtatttaaacagccttagaagcatcgcgtttattatgtaggctaaaaatagaaatataatttataaataaataaaattcagaataaaataaagaatattaaaagaataatccatgttgcgaagatgttacggtttgtttttgctggcggcacacttaatacaccgtcagcgaagatggcagatcttcattggcggtcgtctattttacatgcggtccacttacacaaccgcttctaaaaaataacttttcactacctacacagctgccccaaaaaaaatttacttcgcgctataaaaaaaaccctctcgaccccttatccttatcccttcactccacaccactcatcccttcctcccatcttctctcgagcgctgcagaggggaacgagacgtgccggaggggcgcggccgacggttccggtggcgggaggaaccttggacaatgatagcgagtggttggcgaggctcccggtggctggccggcggccgaactcgggcttttggtctgaaaccaaggagtataacgtatagcgatcaaaaacatttttacccattgcacggacattttctctagtgactccatccacaaacatgcaagttacaactaaaattctacacgtcacaccaaaaaacaaaattgaccgtgaatatattaactatttgttttttggttgtgagatgttaaatttgaacatacatattttatggagtgatatatcacatattaatacatcttctcaacttttctcaaattatttcataaccttttaaattgacatacaaacaaatttccctcagagtttaaaatagtttcccatacacatgcatagccaactcttgaacagagaaagaatcataagtacttcttacgagactaagtttggatccagggacttaactttagtccctacatttagacactaatttagagtattaaatatagactgcttacaaaactaattatataaatgaaagctaattcgtgagacaaattttttaagcctaattaattagagaatgtttactatagcatcacataggctaatcatggattaattaggctcaatagattcgtctcgcaaattagttcaagattatgtatggattttattaatagtctacgtttaatatttataattagtgtccaaacatccgatgtaatagggacttaaaagttttagtcccatctaaacagggtctaattattattttttggtagcctacagagagggtattgctttggaaagctcagagactggctagaagaattgagataccgtgacggggacaccttgttcggagctccttacgatttccgctacgccccgccggtccctggccaaacctccgaggtgtactctcgctactttgacgagctcatggcgcccgtcgaggcggcgaccaagaagaagcggaagaaggccgtcatcgtggggcacagctacggagggatggtcgcggtcgagttcattccgagcaccccacgggcgtggcaaggcgagcacatcgagcgcctcatcctggtcgcgcctacgctcccatatgggttcctaggctcggtggggtcgagttcgatcctcctcctgactgccacatccacggcgcggtccgtgaggcccatgtggaggagcttcgagtccgccatggcgaacttcccgtccccggctgtgttcggccgcgagccgctcgtgatcaccaagaagaggaactactccgcgtacgtaatggaggatttcctagccgccggttgaggcatttgtatccgcgcgggggggggggggggggggcgaaatcccgaaattgcggaaattgtccgaaattgcctaaaatttgagcaaaatttagttgaatttgaacaaatattacccaaattcatgaaaaaaatgaaaaaatgaaaaatttcggccgaaataatattgtatcaggggtgaccgaaatgaccgaaatttccaaccctgagccgccctcggcttcggcgagcgcgtcgagcctttcaggcgacgggctgtcaccaggatgtacagcttcgaggcgccgatggtgcccatgacgtgcatcaacgcggtgggcaacaagacgccgttgcaactggtgttgtgggacgatgacgacgacttggacgcaccaccggaggtggcagcgtatggcgacggagacggcgagatcaacctgtatcagcatgttggcgtttgacagggagatgggtcggcagccaggacaggagaagcgattcaaatccgtcaagatatagctaatgctaaccattccacgattgccatttatgattttgcactaaagaggatcattcaagaaattattgaggtgaatcaggtacattagtagatattcacgtacgtgatgcgcgataatcgtatatgtatcacgcgtggaattctgtgtaataaatgaatcccctggtttgtgtataccgatgggatggttgatagataaaaaccaaaaaatattgctctacttgtttcagggtagtggaaatatattgcatcccggcctttgttatccggcatataacggtgtttagattcaggggtgtaaagttttggcgtgtcacatcggatatacggacacatatttgaatattaaacgttgactaataacaaaattaattaattacagatccccctttaaactgcgagacaaatttattaagcttaattaatccgtcattagtaaatgtttactgtagcaccatattgtcaaatcatgtactaattaggtttaaaaaacttgtctcgcaatttacatggaaactgtataactagtttttttttctatgtttaatactccatacaagtgtccaaacattcgatctaacatggtgtaaaatttttgcctgcgaactaaacagggcctaaaacttttttacctaaaaagacagttgttgaaaggctaaatcctaactaccgtagcaaacaaaattgacggataaacttaaaaaaacccatatagattctaacatattacgccactcatacagtagaataaaaagatccctgactaccaactctaagaaaagtaacactattgtgtgtaatatcatactccttctaccataacatcatacaccaatattgaagctagctgaaagatatggagatagcctgtgtgggattaaacaactttttttattaaaaaccttatcatttcagtaatgtcaaaattgaccaacaaagcacactagccctgaataaaacctttttcaagcgtctaggcacttctcggagccagttataaaaaaaaaattctggtgcttcaagaaggagtgatatcctatatatttataaagttcatccctactaaatatagttaatgctatttttttctctaattaagtcaaatcatcttaaatattttgagcccttggatggttgatctagggtctaaattatctcccccttttcttctgttataaaatcatatcaccttagtttttttttatgattaatttgtcttaccttgtttcttttccttttaaacgatcaattcatatgtgatttaaattgttataaaacacatcatcaaatggtttatatatagttttttttaatagtcgatcagagatgaaaattatatatttttttaatagtcgatcaaagtcctaaccacatatatatatatatgtcccgttaattggcatgtcggaaagattcataccgtgaaaattgatcttaatttccctctcattaagccaacctaaaattgagatgtgcctactaatgagacattgaagtgaggtttaccaaaagaaatatagtacatatgtacacttctcccaattaaggaggcagtgaccagcgctatcattatcaacttgggatgcggcttccctgttcctaatttttgttcccatccctgtttcttgccagatgtcaatcgcttattggtttcgtattttctagtgggcctccacacccttgcgcctccgtcacacgcatggcgttaagtctccgtttaattctgagccatcagctatggtacggaggtaagctagcttcatggggttgccggcggcggctgatttggtcccttgcagccgagcacaagcgacgggcgagcagatcggcgacctcgccggcgagctcgagcaccacgcagtgcattaggcgacacaacatcaatctcaagtgcgggccaccaattcgattgccttgcttccgagttccagcttgagctcttggaactagcaggtacttgtctttgatcctaatcttcttttgtggttttgctttaaatttgttcttttggtacaatatcacaatgatattttgtagcataacaacattgcaaaaatattttgtagcctgaagaagtgaagataatttttgcaacctcagatccctagaatgtatagtttagtaactggcaagtgtaaattgtttccgtactaaattcaactcagattcaattaatttaacaaaatgtagagcataacatattgatcttacggtttctatttgcttcattcccaggcaaacggatgaatcatcaggctcaacaaggtttgtgaatgacgtcgttgcagcagatgtattgtccaagaacatgggacttgctcatgcatcatgcagttgtgatgcctttgatggaggtatcatgctgttgtttagcatagcaccaagatctggcgtcgatgccggtgcttgataagagagattaatttatcaagatgctaatgcatgtttagatgtgagttgtttggatgctggaggatttaacgggagaactgagacaaatggcgccataattctttttcccgccagcaattctatctatttggcgcctaaaatatgttagtaaagttaatggtgttgtttgtaagtattaaacggagatgtaatgccgttcgtgagacagaggcgcaagggtgtggaggcccactagaaaatacgataccaataagcgattgacatctggcaaggaacagggatgggaacatgaattagggacagggaagccgcatccatccacttgacgaggatgacaaataacaagcagatccacggtaagccacaaatcctaccaaccgcaattaggtgccaagttataaggaaaccaatattggacaagtatatatatgcttgttagtatagttagccaaaaggctcgggacccgacagccgacccaagcatggcacggttcgacaggtgtcgggcccgtgttggcccggcctgacctttggaccatgcctaggcttttgccacagcacgatgggtcggccaggcacggagcaaaatagacaagggagctataatagacttattcaagcaatataaagcaaaatagacttattctccaaccatataagagacggccaaaagatataggggatgcaaaatagacttaatccagccatataagacagcccaaagagatgagggaggtaaaaaagacttttttctagaagagcacgatgggatttcatgcctttaggtcagtccggtacggcccgagtcttattgtgccttgcctgccccgttggtgcagcaagtgggtggactcggtccgaccaagagtatagtgtaagtcatgtcgtgccgttccgactgatcttggacctgagcccggttgtaatcgggccagatagctcatttgaccatcttccatctatagctgttagccacaataacgtattcccgacaatcataaatattagatgtttacaaggttaaatttctaaaatattgctcatcattttctactagaatatgctactctaataggttcatgatattatgtaaagtaattttaaggcattttaaatattgtgctgacgcagtgcagattatacgtaaggcatttttaaccattcgagatgtggttgttaatgcaatttaagcatattgatctaatcttattttaaaaatcaaataattttcataatagggattaatgactatatatgtcatgccacgttatattttgctaaactatctctatataagcactgcattaattcaagccatcaaacctagagagacactctccacccacacccccatggcatccattccactcctgcggctgctgctcctgctgctccctctcccccttcaggagcacctctggccaagccaccacaggccaaacgatgccggcgtcggcgccggcgagctccacccgatcttcgttgtacctggggctagctgcagcaacctggaggcgtggctcactgatgcataccagccatcggtgccgagctgtgcggcacgttgaagtggaaggggtggttcgggctgtgggagaacagctcggacctctcggcgcaccactacaacgaatgcttcaaggagcagatgagcctcgtctacgaccccgtcgcgaacgactatcggaacttccccggcatcgagactcgcgtggccaacttcggcattgtgagagggttccgctagaaaaacccttcacacccgtaatatatactacatgttttgtgataatattattactaaatttgtacttctttgataaatctgatcctaaatatgtagataaatatataatatagttcgttttatggcagttttgtgatacgccatgtttgacgaaactatcac

SEQ ID NO: 22298 - DNA, 1970 bp, Oryza sativa
catcgagctctcttgtggtgatgatttggtctgcaaggtagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaaatgaaatttggtatgtaggaagacagtaaaattaaactaactctgtgttgtatggcaacagtatgaacgtcttgtaatgctgcgccttcaggagatggacgagattgtcttctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcactccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcatcaactttcgccttctttgttgcccttgtgtgggcaagcggtggagctggggggccccttgactttgaaggtgccggaagaggagcttgcgggggagtaggtgtaggagcacgaggaggagtcggtgcaggatcctgaggagtcgatgctggagcctgaggtggagacggtgctggcggagcatgagaaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtctgttgggatggccatgcccgacgccaccttcatgttgtgagagattatttattagtaa

SEQ ID NO: 22299 - DNA, 529 bp, Oryza sativa
tcgtagacgcccaacagcggcggcataataggccagccgtgtaggcggaggatccactcggcggcgacggaggcaggccggcggtgaagtcgtagacgcccaacagcggcggcataataggccagccgtgtaggcggaggcaccactcggcggcgacggaggcaagccggcggtgaaatcgtagacgcccaacagcggcggcataataggccagccgtgtagacggaggcaccaatcggcggcgacggaggcaggccggcggtgaagacgtagacgcccaacagcagcggcataataggccagccgtgtaggcggaggcaccactcggcggcgacggaggcaggccggcggtgaagtcgtagacgcccaacagcagcggcataataggccagccgtgtaggcggaggcaccagtcggcggtgacggaggcaggccggtggtgaagacgtatacgcccaacaacggtggtgtgaccaaccaaacatataggcggagacaccagtcggcggcgacggaggcaggccggcgg

SEQ ID NO: 22300 - DNA, 1563 bp, Oryza sativa
ttccataatatacagggaaacgtaatacccaagtcatgatctgttacatatttcatatatataagttatcccctataactagtcggataaccatgccgtgtgggtatggggtacccataatctccacaactacactgtctgcgacggaaattacctacctggcgtgcggcggcgcgtcgaggcaggaacagaaggcgtcgacgtcggcgggggacgcggcgtcgtagaggccgaacgcctcgtacagcgggttggcggcgctcggcgccatgtagccgctgccgtggatgacgtcggcgttgcggcgcttggcgtcgccggggaggtcgaacagggcgcgcacggcggccctcatgccggcctggagctcccgcggcacgccgtggcccgacacgcggaagcagcccaggcgccgcgccgcgtcgcgcagccgcgcggcctcgccgggcgcctcgccggcgagccgcaggtcgatcaccgggatcttcgccgccatacggccctgcgcgtgcgtggtgccgtcgccggtttgttcacgtcgtctgatggagagtgatgggtgtccacggcatcgacttgatgatgtgctctgtcgcgggcgaatgaaccgaattaggctgtgtttagttcagtgtaaagtttggattttggttgaaattgaagatgatgtgactgaaaaattatgtgtgtatgacagattaatgtgatggaaaagaactgaagtttagatccaaactttatatctaaacacagccttattggcgccgcgtactgaccagttagcactcgctgtctgggcactgaatccgtgtgctccaaatgcagacgagcacaagtcagcgagcaaaggctgcttctgtctgttacgacatgataacgtgttccacactttcggttctccactttcgcagaagacgataatagacatcactatgggatttgagatttgaagccggacgacatgccaggctaccagctctttcatgtctttctaaacggacaaaacgaatgatcttcaatgttcaaacagaaacagatgcatgttcaaacggagcctacttcaatgatgtaagaggggtcagagaatagacaacagtcatcctattcaccataaagcaacgaaattgacatgagaaatttctaaacatgctatacacgtatacagattgttagttacattcataaaacttgtgatgcgtaacaggctgcgcaatgggttatattggtattgaaatctcatggttgttctaggcactggaacgtccatggacggtgtgatcagcttttccatctgtagttagactgaagtgtctgcttctgtcctctgtaccttatggctattccatcttggatttcttggtgaaaatattagcagctgataagcaggtaattcctagcaacaccacggctatgacaagaactacagaacaaaaaaaaaacaagaaatatatcaacacaaactagatctcacaaaaataattcgtaaatagaccgtgaaactggatgatttcaagagcaattgttatgtacttcatccggttcatattataagactttctagca

SEQ ID NO: 22301 - DNA, 25024 bp, Oryza sativa
  unsure (1)..(25024): unsure at all n locations
atctatataaatgtgggcaatgctagaaagtcttataacctgaaacggagggagtatgaagaaaagagatgtctgaaaagtttgagatagatatagacagcataccagcaattgtaccaaacaacaacagagcaagacggtgccacactagccatggaagctctgtttcgagagcgcaatgccgttggtacgaatgcccttgttttgtaatggcatgtgcttttgatggatccagttcagatataggaaactccacaccaccaacagagtttccctctacatctcttagttcgagtttaatctgggcaggcactgcattccaatctatttcgattgctccaaagtttggttgacctgataaatgcaacagcaaaacaccaattgataaagtaatacacgtgagatcaaatacagaagaaataaattagatggacacattattatgctcatgggtaaatctgccctcttgatacttattcagttatttgtttcgaagaaaggaaagcttaccatatgtgcatgatttgtaacgacagttagggctaaagactcgcaaggtagttggtgtcaacaaagccacaagtctcataagtggttgaaatactgatggcacggaattctcaacagattgggtaagaccacttgaggtaatatcatacaatggatattgagctccacagtcataacgagaaatttctccaaaatgaacatcaccgctgataaaaaacactccatttctctgcacaaagtcaacatatgttccatagaaataacaaatgcataagataagtatccattttagatgatactccctctgtcccaaattacaaggcctatttttttacacggtcttcaatgacatacttcgaccattaatttatgccatgttattttcctaacgaatatgaaataatatgaaattagcatcacatgaaagtactttaaaatataaatctagtgatataacatgcataatacttagcatatatatggttagtatgattgttagtcaaaatttaccgattttgattttccttgaaaagaggccgtcctataatctgggacggagggagtattgtctattgatagatcgcaaaaagaaaaaaatttaacacagctatatagaagagaaaaggtaactaaacttcacagtgtattacaagaaaagggcacctgcttgccaggagaatttttttttcttttcgcattctacataggccatatattgtgaattgttgataaaaaaatgtttctaaaaataatgcaggaagtacgccagctactactaaatcaatgaattttactttagcacaggtaaaggagaactgagttttcagtaaagattagaatcaaggaatagcttgtctgcataggaaagtaaagtaagcaaccttactgctatcgatcagtctgaacagtcgttctctttcccttggaaagcgtgcccatgactccacatagaacaaaggtccagtggtggcagatagatttgatattacctgcagtgcataggaagaaaattgtattattttgaaacaattctatcacatgcaagatgaagaatcaaaggcaaaacataaatacaaagaggtgaaaaatagtattgttacaactattcaatcgaaagcaactatagatcgaagattttatcaaaaattatctatgtaacaaatgatacataactttagctgggaattgggatactatcatctgccacgaaattgtccaagatggacagctggctatgtttgcaaaccccagacaagataacaagttttatnnnnnnnnnnnnnnnnnnnnnnnnnnnnnnnnnnnnnnnnnnnnnattcactatgattactcattgttctctggcagatccattttttagccagtattctagatccgctctttcaattaggacaaggcagacaatatcttacttgtattgaagatccaatgatggtgatctctgatcgaggaccatgcagttccctctccagccattgccactgaggatctcccagtacagctccatcacttgatagagggtctctgtgatatctggtgtccaacagaattacctatagtaatgtatggctatcttttaatacatgtaaagtaacaatggagcagtgcctgcaaccagttctgcaaatgggtgaaacttctcaactcatgtactagttatatatttgttgtggtgcgtcactatatggatttgaactgaatagtttcacccaacattaaatctgtatgtataggaaaacaaatatcaactagacacaatatacatctgtattcagtattcacatagtaccaagttgctgtaaaccttgatatcacatactaccacattttaaaagatgctatgaattccatttaaggagctgaaacaacaaaccaaagactactgattaacaagaagttgcagcacagggcactttgtaatccagaacaagaatggcaagtgcagaattcacagtgtgatctaggagattgatatgtaacatggttgcaaatcataaggttaacaggggaacatgccacatatggaaaggagaactgatacattcatgcatggggatgcttgcttgaacaaggggtttccaagaaaaacaaaattggcagaaaaaattggacacgatataactttacctttacccgttttccttcagggccaaacatgtaggaggcataaacaccagcttgctgcctcctaaataaacaagaaagagagcgctatgagatttctgatggtttacaactatgtattcagaccgtagaacctacacaggtatgttcatatatgttgtggaaaaaaaaacacaaaagaaagaaaggaattttcacacaataagaagaataaaggcgattttagaatacaataatataaataaatgacaacataacacatgaacattaggaaaataaaaatcagtttaaatattcccaagtacataccgagaactatcgtcagcttcattcagaaaatctaatagaagcctttgagaggtcaccttcccaccaaactcttttcctgcatcattcagtccataatcgtgatcatcccatgttccaataacctgcaaaatttagtgaatgatatgatattgacatagtgtttccaaccactaaatttttaaaagaggagctggttaaattggaaatgataacaatgtcgcaaaatctcagtttggatgatacagaaactgtcccaaacatgataaaagtaacaaaatgaacaagcactcttgtttgccattcatcctcagttggatcttatgatcctttctagcatggaagtgattcattaattctcctgcgcctgtatgatcaaggacgtggactcatgggagaaatgagcacctatacttgtttgtaaaacaccggtgacaagatcccacatgtcatcacgagcaccagacacaaagctcgaggtttcaacgcgcaattaccaatgcagcaaaaaaaaaacaaaaaacaaagaaagagcggcagcgagtcttgcacaagctctcacctgagccctctccctgagcttggcgtacccgggcttggccttggccatctcgtagcgcctccgcagctcggcctccgtcgacgggtagaaccgcggcacgttcctccacggccccaccgtcctctccctcccgaacacccggaacggcctcttgttgtcgccgtacacgttgtccccgagccagatgaacacctgcgggtcgaaccccacgacggcctcccacacgggctgtacgcacacacacacacacacacagacacaaatcccatcagatcattgatccgagatcagggtggcgaagggggggcgcatttcgtcgagcacctggggcgcgctctggttggcgcagaagccgaaggcgatcctgaccacgncggcnccgggatcggcgcggagggacagggatcggcatagaagaaatagcagaagcagggggagtaggaccaacgcccgcgtgaaggtcgccattgtcgaagtcgtagccggtcggtcggtctagcgaggtcgggccgtagtagcaggagcacgggagaaatggttggagctgggaaggagacggttacgggtggggggatattccagtttccaaaggcgtcgcgtcggatcctggccggtgttggttagtgtacgtgtggcgcggtgaaggggcaagcgggtggcacacgggaggaagaaccgaagaagctcttggagaggtactacaagaatggccggtttttttcttctttctttctttgtttttcttttaatgcgtgttggaactgtgtagaaattcacctgtgtcttttctacctaacggatgaatatatagggcctgtttagttccccgaaaatttttcaaaaaaacatcacatcaaatccttggatacatatatgaagcattaaataaaaagaaaaattaattgcacaatttgcatgtaaattgcgagacgaatcttttgagcctaattaggccatgattagccataagtgctacagtaacccacatgtgctaatgacggattaattaggcttaaaagattcgtctcacggtttccaggcgagttatgaaattagtgttttcattcgtgtccgaaaaccccttcagacatccggtcaaacgtccgatgtgacaccaaaaaattttcattttaccaactaaacatgcccatagattatatatacaccttatgttttttcaatgcgttattttttaaataagttcatttttgctccccaatatgtagtaaattaagttttttttaatcattatgtatcagtttgtaaaagtaaaaaatgtattggcaatagataaagagagtaataactatattttgggatttgagaaagtgactgtatcctgatttttttgttttatattgatatgtgtaggaggagtgaaaaataaacttatttttgagacgagtgtgtatgcatgtttcgtgaactcctatttaaaaataaaaaaactttccaggtcttgaaaaacctttttagaacatattctttttaacttagtaatagttgatttcgttcatttgcacattcgaataatttcacaaatcattcatttattgtttcattttattcaacacaaaagaacacataagcaatatttatttcccgtatgctattttaccttaaaaatatactaagaggttttagagggaaaaaaagggcaaaattttggtacgagggattaaaattgttgcataaataaataggtagtctttgaaatttaggaggttttataacattatggctctatcgtttttgtgattggaatcaagcaacttcgtaaagatgtcgctaagaaagctgcaaaaggcatcacgctgttatgaagctcaaggtttctctatccaaagctagaaaaacagtgtactgctagtactcaaacctctggagccccatcaattgacgtaataagtcaaacaaaagtcagaatttgaatttttaaaattgaatttaagatatttctaacgtaatttccttttagcatttgcttacgaggaaatatataaagttttatctataatttatttttttcataataaaccgttttgacttattaggtaatatgggaaccaaaaaggctcttaggctctctttatttaggcttagacttattggcttagacttttaagtcagtttattggcttatatgatttataagccagtaaatttaatgtcctaagtttagtggtggagtcatacatctatcttatataagccaaaaaagcttctccaacctagcttttggcttaatagtgtaagagtggcttatggcttaaaaaagccaaacaaaaaagctgcttgtttatttagtcttagactttttgacttataagttggcttataatcctaaacaaacaaagagggccttatacttatcgccagtttctagaacggtgaaataaactaaagtcaactcagggacagaattcctggatcaaatatcagtaagctagactgctggagtgagctcaacaagagacaaaattatctgcagaatttatgctacggatgtaaacagtctagtagtttcttcagcgcaggaaagctgtactgcaacgttgcttacggctacagtattgtagtagcttctatgcaaagcaaacgaaacaaccagagcagtgactagtctgctcatctctctgtatgatctagggacagcagagccaatttccggcatctgattccaacaacattttctctatgatctaccagccgttccaggctcaaaaagataatataaatagcacagggtaatccataccctgagagcaagtgtctactgtttatagataaggtaaggcgttaaaaatgcaagcctgcaactaaatacagccaagagctttgttgcatacaactcagaaactcgaggcattttcaacacaagtacctaagttacatcttgtctggattttaaccacacaataaaggtaagcacatgcatcagtttatgtttccccagatagctttccctgataacctgatgtcacctttgttgctcgtcatccttgcaaaggtgttggagtatttcgcttccggcattagtctccgagcaaaaggattctagtgggcaaggagatgcatcccatttcgaaggcttagaaacaaggttctccactatcacgcatgtcatgtatgtatcacatatgtaagttagtacacgaataggtcacacaggctctcaaacaggtgggagagactggcatctatacacatcaaggaatgttggccatggagcgcctaatttccttggaatggtagcagcgcaaaggcaagagcatccatcataaacccaacctaaactctgccagacatcatgagaaagttgccttcgatcctgcgagattttgcaacactgaaatgagatctgtaaactggataattcaagggagttgccactaaaatccttaagagtattaatcatgccactttttgtgaaaaaaaaaagaatagaacgcaaaaaatacagaaacgattgtgagcttctgactgacgtaatttctgaaacctagtggggttttttttacactagaaggtttttgtaacacaatgaacttggcaacacatttcaatcttgttgtttcagtgaaaaaatagaagagtggtttgtttattcaagaaattacaacagtgatgatctgatacaaccttgtctacaatgtttagaacttagaacaatacatttgcagatgataatgactcgaactacttggagttgcaatgaaacaagaaaacttcactctttttcttcagatatagatgagacatatacaagcatgtaaactagagaatatgagtgttggccgacaatctcttaccttcagtttttatagcatggagatctgctagatggcgcattgttggcctcccatgagggcaattccaaggggacctcaatcctgtcaaattcttaagtatctgaagtgcaaaagaaaaatgctccatcgagttagattcttaagtatctggagtgcaaatgcaagagggcttcattgagttaggttcttaaatataaaggaataattgtttctagggagtagtgagcactgatcacaactaaatcatgacattaaatttctgaatagacagaaaccatacaaggtttgcacttcttttataggagctcatttggaggttacttcatcgaaagctaatttactccaaaaattatccttaaaaaacaatttgatctgtggttaccttcttcatctcagtttttgtcaatggatcacctatcatggtagacattcggcaagccctcgaagccaacatagcacgaacccttgaaggacaaatagaatcagttctgtcgagcttgtaactgctgattattgaacagtcaccttgactgtcagcaagcatggagattaactccttcacatctaaatcaagggaaattagaattaaaccacttttcaacgcacataaaaatgtacatttcagacatgagaataagtgataccttgagcaccaaatgtaatattcttgctgaagggaacggcttttataaaatagcggttgcaaggtgaagcatgcagatcttctgctaaaacaaaaccgttctttctgacagataaaaaaaatagcaagtaaagctttgctcactcttaattatcaactactcactccattcataatataaggcacaaccacctttttttcgatgtttcataatattaggcatgcatatgcatgcatgcatgcaattaactagcacatccctctcctctttatttctttttttttaaaaaaaaaatcacccacccttaaaatctctaatcccattgggtgcatgcattgtatttattggagtgatcccattgggtttatgcgttagtggtagttgtgccttatattttgggatggagggagtattgttgagtgagaaaaaaacaaatcgtgcatgattccaggtgttatgcactaagtgggaaacaattgactgaccgacatgttaattacttcctctggtcataatatttgatgctaaggacaagatttggttaaactttttatattccaaccgtcaattttatatgactagaataggttcataaaatctaataagtttatggtattatgatagtagtactttttgaggcaaatctgcgtacaccatttcttttgtttttacactaagcatttgagaaattatcaatgtcagaatttcaaaagtttgaaaaatcttgtcctaaatgtcagtcaaatatttgtgaccgaaggtagtagacagaactgagttgtaatacgcaataaatgtaatacctgatagtgctcatgttcatagaaacgataacttcttcctctggtgataggtcaagtctcagtggtctgtatttgaatacaatcagatatacagtaccagagatacataacaaaaggtaataataaacctgatttcaacattctgaatacaaaccacaaaacaccctaccatttaataggtactgaatgagttcaatgtaccaaaataacagatggaaatgataagttttgcttactcactgaaggagaggctgtatgtttaaagttgttgactgtgaaaggttctcaaagttgtacttctcatcagcagcatgctagtaagaagaaaaaaacattaatcaccagacatgactacataaggtatcttgaaggtgcaacccagatatccaggggtttatacaatactatgacatcaattaatagaatatgtatagactatagagagatacctgatcaacaataaataggtcctggtccagctttccaatgataaaaccaagattaaactgcccaacaacctgaaggtgtactagttatttagtgttcataaacttctttagcaaagtactgcaaatagaaatatagaattcatacagcactttttttaatatttcatcctatttagaacaatgaaatcacaccactcaagtaaaaaacaaatgttcacaataataaaatgctttcagataaaattaacaaaagacaacatatgtcttgcgaggaacttgcaagaatcacacgacctatcgtacttgatagggccatgaacagaagcaagctatcaaagcaccaaaattatacaacaaataacagttatatagctggctggtcccactaaagaaacaaaatgtattggtacaacttaatttcatgattgacaaaagtcattggggttcctccgaagcactgagctactgagtatataactataaaagagttctttttgaaatagcacttaaacgacaaaaaggaaaacactcgcgcagggaaaataagcaacattatcacttggataacaagtgttctttcattgacagtatattagcagtataatctcacaaggaaccttagaaaactgataatattcaaatttgaagttaagtcaagcacctccatttctccaaagtcatctttactgaaaagcttatctaactcgctggtggctgcagctaaagaattcgattttccctcctcgttatctggtacatagttatccagtgtcgcagctttataacacctaggtaggaaaaataaactagtaattcataaagcccagcgcctggtgaaaacataacttttctataaaaatagtttcaagtgctaccttgttgatttctcaggaaaacttcctttttttgcatgtgatatcataaaactatgccttcttcttcttctaagatcagcaagtgtaaattgcataactggataagatgattgtccagaatgtgctgcagtgtcatgaccatcataatgagcatcaggcaaggaaatatttgtcagtttattttggggttccacttctgaacatcgactgggagcaccaaacttggaatggcatggatcatgctggttatcctgcgaggattgcagcatttcattgtatagtaaatctcatcaacatatgtttaaactaggttctcttttctttgaactggacacatgcccaatcacaatttagccaatcagaaaaaaagctattctacaaacattggagtacttgtttagtgatccaaattaagcagaagttaaaatagctaagagtagattgaagatgacttgtgacaacagatgagaaattcaccatgaacttctttaaaagataagatcacaaagcatacacacttaacaagaatgcccagaacaaccagtcaaggcaaataaagcaataaaagtaataaaaataaaagataatggagaaaattgaagaattcactccaaaaaattctaccttaccacttcagattctgtagcgtgaacatcacatggacgcaactgaggcacttcatcacgatgagaaacaatattaggtggttcagaatgctgtggtgaatcttctggcatctcaggtacaaaagattgcagggaatggtgccgcaaaggatttgttccttgaggtgcattaacctctggaatattagatactcttgaggttagtgcagttggtgaattcactcctaaatctgttctcctcacttgctccaagcatgttccccttctcagcactggagcttcagaaataagattgcaactgtcttcgtgtttccttttattttgtgatagaaatttcataatagaaggttgaacagcacttgaaggagaagactttgcagcaagccctgttctaacatgatttgcttgtgctggataactttttactcgtgtaggcgtcttttctcgttgttcataccggtaggctgaaagcaaagtagatctatcaagctgagcaggtgggcctcttgacaaggggctcacatctttgggtgtagatccagtggctacccttgttgtcactgaagaaggcactttctgattctctggtgtaacctcatcatcactatctgtttcatccatgtcatcgtcattttcaggagctgaaacattctccttttctgttaaacacatgtcttcatcagacccatcgatggctgggtccatttccttcccaggatcttcaacgctgttgatggagaaactgcattgttgagggcagtacagattctcaataccttcccgtaaagatagcaaaatggcatgctcagatgagaagaaaatttttctcttatcaggcgcaacattcacatcataagatgtggttggaatacagaaattcaatacagccacagggtattgcttggcatttgagcttctgtacagctcattgacaagtttggaaacctttggcatatccacaggtctgccattaacatagaagaactgtctatcccctgaattgcgaccactaccaggtccaggtttggaaagaaagccatcaacttggcagccttctgagattgtcacattgaagggctgcaggcacttgaaagtgttcagaccaaatacggtaatgatattatctttcagtgaactgctcccttgagtcctaagcaccgccgatttagaattcttgccaacagtatttgtgcaaactaatctgacccctttggcaatcaacgcataggcctaattagggaaagaaaaaaaataaatcacagttcttagcagaaccagaacgaaacatgtgtagagtaaaacagcagagtggtataaacatgtgtatcaggagatgaactagattctaataacatacatgagctttacgcaaattgaaatgcccgcaaaacgaacatggactaataagatgggcagctcacattcagcaaggagatcacttttccgtactccttccgaatgttcctgctgaactccttgctccggaccggcagcgtggagaacagctttttgacggtcacgggnggtcccgaccggccgggccatttttctctcgccggtcaccacgcccgagtgcgcgaactccaggcgcgtcccgacgggctcgtccttggtcctcgtctcgaccgtcagcttccccagcgcgcagagcgagctgagcgcctccccgcggaacccgaaggtggcgacggaggcgaggtcgccgaagtccgagatcttggaggtgtggtgcttcagagcgagcgcctgagaagcgcacatggcggtcagcaactaaatcgcgagagcgaagcagcaaatgggagaggagaagaggggggattcgtgcctggaaattggtgggggagatgccggtgccgttgtcggcgacggtgaaggagtcctcgccgtaggagcggagggtgacctcgacggtggtggcgccggcgtcgaggctgttctcgacgagctccttgacggcggaggagaggtcgaagatgacctggccggagcagatccggtgcaccgccgacttgccgatcggccgtatcgccggcgacgagccgccggccatcctcccccctccacctcgacccgcctaaaaccctacacagcgcggggtttttccctttctcctcctcttccgcggcgggcaccgatgatgatggtggtggtggtggtggccatccgcagccggagccggaggcaaaccgtcccgagggccgaggcccattagcctctcagttgggcctcgatgcggctggtgtgagtgagccggcccagccagctgctcgtcgaacggccgacaaattcgctacgccaaccaaaccggaacgggaataagctcatttgagatcccttaactttcactttgatgtcattttaaatcataccatttttttttaagttgcatatgtttagtttcttactaacttttgataaatatatcagaaatttggcaactgcacagtaataactaaaatttagcaactgcacagcaatatgtgtgagtagcatgtatgttggcaacaaaatgaacgcatccaaaatagccatcttgccaaaatttgacaatattgctaaccttaccaaagtcttggtattgtcaaaatttagtatggtttattttagcaccaaagtaaatagcccttaaatccaattttcattcttaaacaggaaaaccagatactctctccgcaaaactatgtcacatcgtaggttctttttttagaacgaagggagtacaacggatcttctaacttacaaaacaagtgtaaatgagattcttccatattattatcatcttatttgagtgatgtgatacctatgtataatttgactaaagtttttcctttaacatgacgtggcgaatccaactatgccgccgtggcctcgccacctgccgagccacttccgcgaggggggggggggggtgtcacgactcacgagtcgccgccgggtcaggtggagctgcgtggagggggaggccgaggtttgaccgcgcggccgccgtccaaggcagaaacgtgccgttttcgcgttggattcggtggcctctgcgctgtcacacccacccccttccggtttgtacgaattgcgttggcgagggctgcaaaaagttttgcaaagccggacaaaattgaagggcgtgaacgttgattctttttctcttttttttttatgaggaggaaaagaacgacgttgcaattttactcatgcattgtcgtttatgagcaaatatttttatagttgtaccttttttttcagagactgcaaagttgttttgttgttcgggacgttaatacggagtatatactatatctaccgatgtttggactttctttgagaagatatatactaaagctcttagttaaacggatgactatatcttgtactttggtcctcatacaccttatattatctttgtaataactagtttcatacacattatattgcttgccattttgggaaaatttgtctaatgatatctaaaaagtgtggcaatttactgcagggcatcgtgagtactaaaatacaatatccacttaggccccgttcgaatccaccgtaaggagaggataaagtttcggatatttgtggcacgcttttcaaactactaaacggtgtgtttcgtacgaaaactttctatatgaaagttattctaaaatatcatattaattcatttttcaagtttgtaataattaaaactcaattagtcgcacattattaccacatcgttttgcgtgaaacacttaatctttatcttcaggagattaaaacaccaccttagtaatgacaaaacccaagaaaattataccttcgcctttcttgttcattcttctaatattcctcttgcgaaggggtaccagtcgcgatggagctgatttgagccattgggcaccgcctcatgtcgagtgggccttgtgtttgccgcggtagtggtggagtagccttataggagcaggtcttatgatgtcaaagtggttcttaggtggtggctcttaggttagggaggatggagtagtgactggttctataaagccagctttatccatagaccattctcttcaccgagccacgatagggctagttcaagcattagagttcggattttgataatcggcaaatcgagcactagaagactcaaaggtaactagatatggcaacattgttgtcatgctcaccatcaatgccatcttgcgtgaatgaagaaacaagaggaagacagggagaggagaaataatgccaattagtaagaagggtagcgaagccattttagtcaaattctctctccaactttattggaaacattatcttaatggcctttagactgcgcgagtagaatatgacaattgttcggtggcttttagcaaatccatttttttcagagaccaccagtaaaaacctaacttttcttagtgttattgtgagtacaaaattttgtagtcgttggtgcatgacttaacttatcaatatttaaatttagtgtctataaatattacgtataaaaaaatgtgattcagtacaaatttcatgagatcgaatatattaatcgttatgacattcatatctttaagcttttacagtgatgcatgcgtcttcttgtgtatttcattgagtaaagcctctcttttatttacctttttctagtattttttctcaatctataatgagtttaaattaaatcatcacgggaagtacagcgctatagtacggggttgtggccggtgcacgattctaatatattggtactcgcaaatattatatataagtatactttaatagaattccaataataatactagagagttacgtctctttaaatcacacgacagagtgtgatttatgtcatatgggtttttcaaattatatgccatatacggtgtggcgttttcaggctctagggagtgtgtcctagcttctcgctcaagattgtaatcatatccctgtttcctcgcaaaatcataaagtcatttccacttcctcacagagggtgcacctaaaaattattaggacgatttatttccaaagaatatatcgcaaccgttatctctctctttcttcggtcacaagaaatacagaacatgcttaacgaaacaaaaacgttttctttttgcaagtggagaataacaaattagcaacaacaagctgggacatgtgaaaggaatccaaataatttacccggatactaaacgaatttccgaattcattgaggaccggaaacaaacaagtcctccgatataactagaggcaggctggctttctccaattgcaattttgcaacgagagagaagaaaagagctcgaaaaaaaaaagaaagaagaaaaacaaagcgcgtaaagagaagcgagagaaatcggagaggaagatgggggaagaggcggcgaagcaaatggcggaagccccgggcaagattgaatccatgaggaagtgggtcatcgaccacaagctccgcgccgtaggtaaaatatctcgtgaatttttcctgggatttcgatctcctccgcgcggatctgctacttttctgttgtttttttttcttttcttttctgatgtacgatttgctacatgcgtcaccaccaaatccccaatccatgcgtcttcccgatagaagttcatcggctttctttatatgattttatctctcaatcttgcgaaaaaaattatgttgtgtattctatttaggattccccttttccccaaattttgagattgattttcccctcgtgtttttggatattttctaactattttacgttgcttatgttatgtgtttgtgagtgaaggttgcctatggcttactgggatcagcagctcgattgcgtacaactggtcgaggcccaatatgaagactagcgtcaagatcatccatgcaaggtttgtgcctttgtctcatctatcttagcttcaggctcgtgtcttaccatgattaagaatacacggattattcatcttgagaacgctttgtaggcattgtgatttgtgaacattagcacaataagataaaaggattttgaaccttgccatgataattaaaaggtcgattgaacataatgtttgcacaatagaaaagtgattctgttgcacatgccttccagattgattctgagttatgaagtgacttgagcaacttcgatttcaactgaaaccagacagaattgctccaattgggtcatcgatgagcctgtaggaaggtttcaacgtatagtgtagcattgttcaacagactatagacagtttggctaccatttaccattgccagctgtagttgaatatggagctatggatccttcttttattccattggcatggtttggaagaactttacttccagttaattgtagagagtgtacttgttttttttattgggactacaagctagtgattattagcaggcagccggggaccactagagataatcaaaccacgtaggatattattatagtccacggggttcataatttgttcttcctgaacagtaggtcttttatttgttcgtttacaattatcccgccaagcaagtagatataagacctgtaaaggttcactgttgaggcttttctcctcctcttatcaatacaaaagtggcaaagtttttgcccttctttcaaaaaaaaagggtagacttaagaatgcaccattatttatttggtgaattatttgattttgttgattacattcaacactgaagggcttagttatcctttaaggttgcaatgcagaccattctgcaggaaacgcaggaaacttgaaatttagtaacttatctgtttaacttgatattctacctaggtggctatgcatatataattttatgacaaaacgttgcttgtaattactatttttatatgtcgctagctgtacgaagtaattcacgtgaccttttgtcactaagatatctaaggttggaagtgtatcagtattattatggactggttttcaaagattccttggtctgcaacaatagcttcgtttttttgtgtatagtgcacttacaattatactagtccatccgatccagcaagtcaaaacttagatcagcagaaatgcattgtccaattccatatatagcttgtaccttgtagcatttttgtcctgtgaaagtgtgcacccttcactgctggccctcataattttctctgttctgttccccattttttttgggctagattagataggtgcataaagcaatgacacctaaatagaagccatgtacatacggaccaccttctttatttttgaacggtttgattactattgttgagaccagagggttagaattctaagttgctattttccaacgcatctactagcgatattaccacctcttttttgaagtcagtcaatgtagtaatgcactgagtcatgtattaaatctttgaagttctgtttttcctcgtagatgtaaaattggcacgaccttaaccccatctaacgcattgggtggcaatatcagatatttggatctgaatgcctgtaccttttcatgtatgtaggcagtttatgtacgattaactacattccatatgattatacaccaatgagttgtgactaaagtcaatcatgctacaaattgacagcccacatacttaattaatataactgttattattgcaggttgcatgctcaagccctaacactagcagcgttagtgggatctgcaatggtagagtactatgacgcgaagtacggcacatctggaccgaaggtggacaagtacacaagccaatacctggcgcattcacataaagattaagatcttcatattcgctgttggatggcgggttattttaggttcattttggggttcctatgagctccccatgatgattattttgtctccttaactacaaatgaaacttgccagggcattcctgagcaacgagggtgtaatacagggttgatctgcatagatcaatttcagattgcgatatgtaacctcacttgctgacaatcttattttattatttttcaacgaggaaaagtgttcctgtcttgcattgaatctgtcttagttttctgcagttgaatctgccgtaagatagaatggtccacggattttgttcttactgtttgtaatgcaggagcattccccacccgtattcgcattttcaaacattcttaatcgttacatagttgtagatggatggcattttcaaacattcttagctcttgattggtacaaactatgtaatttcaaaagattttgttgtaattaggcaactctgtaacttctttattttgcttttataaagtatggatgaagctcaatacaaaataaagttacaactctcgtggttgccctacggggaaagcagctgctgtgcctgttctcagtttgttcaaggagcttttctacaaaaatcagcattttacattataatctgaaaaggacatggaaactaaattttaaattcttgaatgaatacacgaaccaaagagagacaaaacacatgcaattattaagaggttctttgttttcttcaaattatcagaacacggaacgtactgtctttccctatgtttgtaagtttcttttagggctgcctggagcaaacatgatttcttttaagggctatctggagcaaaacatatttgaacgagtgctttaactcgtgctgattaaaaatagacagaatgcaagagttactgaaggagtatgaagaaaatctctgaagattccattccaaaactatatacatatgttcaagcaaatctataaatcctgcagacagaaataacctgaacaagaattaatagatctcttctgctcttctacgcaaggatgacaaaggaggttgtaaccagtgacgccatccatctatctgaccaccagtgtagaggacatcttcaacagtaaattcattgcagattcaaatataagaatcacaaagtggtggaaataggaatccatgctacctacgcattcctaatttcgcctaagctgctgtgggttaactcttgattccagctttctcacattgcgggcgatagcagcttgcttttggccaggaatgtagctcttccgtttactgcacaaactacaaaaaattagtttttgtaacaacacaagcatctgaaagggggaaatggcatgtgtatggcattaagctagagagccaaggaagaaaattgcaagtttaaacgaacacacggacataatccaaagttttgtgtgatctttcataagatatttttgtttgaaataggcatgaaaagaaccaattcttcagatattgtatcaagttccgaccagtcacacttatctcctatacctgttatttagaatatgaaaataagaaagagatataaaacctgataaatataaggcctgctgtaagaaccattcctccaattgcccatgaaactctttcactagcaggcatttctcttgcccatctgcgaaaatcttcaagattccaagaggccacatcacttaatactggacgctcttttgaagatgtccatgaactagagatggcatcaaaacttgctttcccaccatagcagaaagtgtcatccactccacccgaggtggtctccaaagcttgcacagagaaaccagcagagcgacatagctctgtgccattagagacccatttatgtgctttgccacaaaggatgtcacctaaaccacatggagacaatgcctgataaagcagcaagggggagatatcagaaccgaacaacaaaataatatccaacaaaaatatcacaagaaagcagaggcacagctacttacagttctgcaagcaaaggaataaaaaaagagaggagctaccgtagctataagaaagtacaaaagcaattaacatgccacaactttaacttaaaaactcccgtggcatgtatattggtgtaagcacgattaataactgtttatctatgatcaaatttcacctaatattatctagatcaaactatgaattatgaaatgagcaagtataatctggcaactgcaactgtccttgtaaagtaccacatcggtatagcaagaaaattttatttagacacagcttaaagagatgccctttacctgtgttttcacatcgatagcgaagtacgcctctgagcaagctttgaaaaccatgtcacagaatgatgcacatataactggaggtccaggcctaacacccacccgtggatcacaaatcgaacactcgagcagttcccacagatgaaggcattcttgactaccttcaccagtcgatgcaagctttctcactgagagcagggcagaaaatgtctgggacacatcgcaacacgtgttctgccggaatactctacatagtgccagatctctgcgccccttagctgctcttccaggacgcttaccttcagatgagaaggcagggaatcgtccaccaggcgaaacacatacacctttctgttctcctgtgatgccagacaataatgattttagtcatagaagtatgactaccatggttttcatttgcagaggctcaaacaataattaaacatgcctaaattcattaacataaactactccattcgatctcaagccacaatgttcataaaaaactatagatttcactcaagtaccaccttggtgtccaggtaccattgctcatcctactcctagcaggatgcaatttgaagaaactgtgatattttcccctagtaaaggctggtaatgactgataacatccatcagaagtacaaacaaaaattcctaagcagtaattcctaaaatgcaaacaggcggcgtttaccatacaccaaattccacgcagcttaactcaatctacgagcccacagggacctacgctactgtctctgggtagaaaagaaacacacacccaatttcaacgaccaagcacagaacgcatcaaggatccactcaagggcaccacgaaccgtccaagtaacaaacaaacacatacagctaacgaccaacaaaagctacagataaaactaagcaagaacagcaccgagatcggaagaagagtcgcggtggggtggcgattgtcccgtaccagctgacgcggctggcgagcagacgaggagcagcagcaccaggacagggagaagggcgagagcacgacccgtacgcgacggcgcggtggggctcatcggcggcgacctccccggcggcggccgcggccggccgtcgtgcggcggcgtcagggccgggatgggatggggagaaaaaaaaaacaaaacaaaattccgcagcccactactcgtggattcggcttgcggcgtcaatccgggccggaaaaagtcaacaagccaaccgtgccgcatctcccgagccaccacagccgttcgatctagcgttgcgattcgggcagttccgaccggcatgggccgcgttgctggtcctggacaagttaatgggctggtcgcagcgggaggcccacctgagcgacacagagatatgagtaggctgtagggacccggacctccctaccacgcctcgtctgctttggagaaatttggatatatgctattgtcaaaagtgagtttgaatgttttaaaatatgcatcatgttgattccttacctattactttagtgattgtgtgaatttagacaaatataaagtaaatttttaatctaaaaaattaatcgaatggtagttttttttagcttttaaaataggatcaaatacgcaactgatgtttttttttttcaattgatataaattttgctggtactgttgctggccgcagagtgaattgctacttgggccgcaatgtagaattgctacttgggccgtcctaccaagtaggcaagcacactgctcgggaggtcgggattttcttttcttttttttttttccgtcgcttcttcgcgccgcctcccctcgacgccggcgccgccgctctcgtgagccaccgccaccgccggggccgccgctctcgtgagccaccgccaccgccggcgccgccgagcctcctcctccggcaagacgtctcatccaggcctctccctccccctcagacgccgcctctgcgcctccattctcgagatccgaggtgagcccttcttcttcctcttcccctctcctcttttctccagggttccgcagtgacaggacggaggaagcgggaggatgcaggaggggagaagagcctcgaggatgcatcgtgctcctcgcttcgtccacttcctctcctcctcctcctcctcctcctcctagggttgcgttgagtcggtgacacatgggacctcactccctggtttgcttgcagcggcggattgctagctccttggatggcagttctagcttgtagttcttatttgacgaaatcgtgatcttgtgaatattaacatggaacagttgtagctcgtagttcttctttgatgaatcttgatctggtgagtatcaacatggaaggagtggaagctaggtcgctcgctgctcactctacacagcagcatgttttctgatgttttacatttgctgaatactgtcaacataattgaacttttactttgtcattacttggtatatccacagtttgtctcgtcttccacctccggccaccggatttagtgccggtcatggttatagcttgattttgagtcctagggtgtgtgtgatcggtgattcgccaccagcggccatggggtggaggggcgagcaacgggcgtagcaagccgaagagccacacttgtaggagggggcagggggacggagccgtgggtggccggcgaattgaattgctagagctaggcacatcgtcctcaagggcgcgtctcggcacaaggcgcaggtacaatcctctaatgtcatcttcccgtagattctcactcttcaagtctcagttccttggttgtcactggaaaatcatactacgaaaatggaatccactgttgtgtttgtttggtggcatgcatatgtagatcaatatagcaagttcaatcgatgtaggctcgtctgggacactcgaaatgaaatgattttgcagaattcattttgaaaattctcttttcgaagcgagtcataaagaggaatatgcatgttttccccccttttctccctcttttttcgtgatcaggttagtggagagacccccctctgcattgttcaagacttcagactcgctactaaagtgtgcacacccattgcagctttcagggcttcaccactgcataaattctcaacatatgcttgtgttttttttactgtcaagtgtcaacgtctgtgccttttccctgactggtctcatgaatttcccaaatactagaacagtacaggatcatgtcttcaaagagaggaggaggtggccgccgtggtcgtggctgtggccgtgggagaagtgctttggctgaaaatgacatggactttcatgaaacctccacaccttcttccccaagtactacttctgataaagaggacaatgttgagtttactccgcagcaaagcccactaccttgtcttgtaagcccatcagtagagcatgtatccaacacattactcaatccaaagatcaaccaccgatcggacgcaatcttcggtgatcaggttaatctaagagcaattaagttttgtcatagttgcatgagtaacaagttcttgtaggaagaataaactttgcagtctgactgaggtcaatgtttttttgcaggctgtggaacagttgaagttgcgacatcacaaacctttaaaatttcatgagagataccgtccttatttgagggatgctggcttgcttgggctctcacaaatttgccagaagatgcctcagttggacaaggcattgatcactgcccttgttgagcgttggagaccagaaactcatagtttccacctggcttctggggagatgacagttacactacaagatgtctcaatgttgttagctcttcctatcgatggccgtccagtttgttctaccactgatcatgattatgcgcagatggtcattgattgtctaggtcatgatccaagaggaccatcaatgcctggaaaatcttttctgcactacaaatggctaaagaagcatttctatgaattaccagaagggacagatgatcagactgtggagaggcatgttcgagcatatatcctgagccttctatgtggggtgctatttccagatggaacaggacggatgagtctgatatatcttccactgattgctgatctttctcttgttgggacatacagctggggatctgcagtgctggccttcctataccgttctctttgttctgttgcttcctcccacaatatcaagaacattggtggttcattgcttctcttgcagctttggagctgggagcgctcccatgttggcagaccgttggtccggtctcccgtgtgcccagagacagacattccacaggatgtgctcccagttgg

SEQ ID NO: 22302 - DNA, 948 bp, Oryza sativa
  unsure (1)..(948): unsure at all n locations
nnnnnnnnnnnnnnnnnnnnnnnnnnnnnnnnnnnnnnnnnnnnnnnnnnnnnnnnnntgctagaaaggaaatatccacattttaaaactacactcacactcttggtctgcttatgtataacggtttgagtacttgcttatgtataaggggattccgacatgtctgtggacttgatataatccaatttaatctcttagatggtcaagttgggctctgttttaacttaccccgtgatggaccatatgtggagcagtataaggtctcaaaatcatgcacggttaaacatcccgaggctgtaactgatgcaaggtatattccctgccaatcagaaacacaagaaatgtgtgtaaacattttatataggaaaaatagataaatgtcatttcaaacattatagtttagatattccatcacaaatttatgcttagaaacatgccattacaaagttgatgtgttcaccatatgccattggatatccaaattgacctatttgccccatttttcttgctctctcctccctttcagtctctccaccatctcccatgttcccacagtttccacatttcctccactcccatctccagcacacctcttgagcatgggaggtgtgctggagacatgaattggatccctcaaaggtggaggctgccgttcaagatgtggacggcctaacgctacaagacaaattggagttaacatggacgtgctgccaacaagggagccacatggacagatctgctagcaaagtccatggctgccagtgctgcaaggaaggtgccagcactttgcaataggtgcgttgcatgcaaaggaccgtcatccaccctaccccaatggtgctgtcgatcctcctccaatgctgccactctatctcagccacctcctgctagactcagatgacagatctagtagaaccagatggcagaggcagctgcactatcgtagtg

SEQ ID NO: 22303 - DNA, 1305 bp, Oryza sativa
gggatatttcatgaaccatgttatacgtaaacagtaatttatcgtttgaattgtgtagtaggacttactgcagctttgaatgcagggcggtgtgctaagatctcaaacatacagcatcctgatggtaaaagatgggaaaggattagcatcataacagaaaccgtgaaaattactccaaaagctgttgtactgggaactcaccaagtgaccatatatcagatttgtaaccataaggtatgtctgctagtatttctgggcacatgtagtttggggttcccacaatctgaaaaacatagatgttgaattcattgagtggcaatggaacctatcagttcattcacatgtcacaatattttgaatgaagaaggtaggaaagtgtcctactgttcatatataattctataaataaatatatacaaatgaaataacactgccggaactatactgaaatggcatcacatatttctagaacaaaattccattatctataccatcataaaagaaggcaatggtggtggccatcaatgacgagcgggccttcatatgtactcaaggtcaaagtagaagggagcataaaagcatcttttttttcaactaaagagagaagtgggtacttacatatttaattttagaataaaattaaggggcatatttttttttgccaatttttgttgttcaatctcttttcatgattattaataagacaagtgaaaaaaaaattatatacagttaaaaatcaaagttcaaagctattgtatttcgtgatgcagacattaatttttcccacatgaatatgtaataccatacaatttttcttttgaattccgtaacaaagtacgggcattctgctagtacgattgaagatcataagccataaagaatttagttatgaaccactattcaaaatcaaaagggtttacatgaatggtgtttatacatgttatgatttagtgtgactttatgtaggtaactgcatagttatgtattctttgctacctggaaatgtgttttgcgagttatatttacacaacatgatagcacaggtttaagccataccgtcgatgcaaggtcctccatgagcaattttgctagcccaaaatcagctgttttcaagaaacaatgaatattcaggtcactacactatcatccaagaaaaaggaaagatgcagtaatttatatctatggtgaaatatatatttcttaccaagacggatgttattatcctttgttaacaaaattgtggaacactggaacagcacatgagcccagggcatgttaggtgatgctgatacctgatgaatcgac

SEQ ID NO: 22304 - DNA, 425 bp, Oryza sativa
ccggtcggtgaagacgtagacgcccaacaacggcagcataataggccagccgtgcaggcggaaacaccagtcggcagcggtgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaaggccagccggtcggtgaagacatggacgcccatgaacggtggtgtgaccgaccaaccgtataggcgatgacactagtcggcggcgacggaggcaggccggcggtgtagatgacgatgcccatcaacggtggtgtgaccaaccgaccgtataggcgaggact

SEQ ID NO: 22305 - DNA, 1374 bp, Oryza sativa
  unsure (1)..(1374): unsure at all n locations
nnnnnnnnnnnnnnnnnnnnnnnnnnnnnnnnnnnnnnnnnnnnnnnnnnnnnnnnnnnnaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatggatgtgtacacattttctataatgtaaatatattttgttcatatatatatctatatacatatgcatttgcataacatatatatgtataaatacatatatatatatatgtatgcatatatatgtattgaaacatatatatgcatggtttatatatatatatatatatatatatatatatataaaccatgcagcaacaggggcatgcaaaaaaaaaaggtcagctctatctttagtcccggttggtgttaccaaccgggactaaagatcgatctttactcccggttatttcacccgggactaaagatagcgatctttagtcccggattggtactcccggtttggaaaccgggactaaagggggttatgaaccgggactacaaagggtttcttcaccagtaagacttgggacgcctggccagggatcgtagcagagtaacggagatcgcaaggaaccccgtacatgttgtctccgtcacggtatcccatctcctccagtgcccctataagcttcgcaaggcaccattctctgcagatcaagcacacacaaaaaaaaaaacagcagcagcagcagctatgtatagtgtccactaggaattaatatagtgagaacaacattagtgtacgtaggcaggattgttttaataataagtactctctccgtttcagattataagacgaagtcaaactgtttttagtttgactatgtttgtagacaaatatattaatatttataatactaaattagtttcatcaaatcaataattgaatatattttcataataaatttgtcttgactatttttttcaagtcaaaacgtcttataacctgaaacggagagagtaataattgctacagacaaatagtacatcgcctgtagtttggtggtcttctattccttgtcttatatttgtaatcctttgataaatttgatcgtaaatattttgtcttgtgatagtttcgtca

SEQ ID NO: 22306 - DNA, 663 bp, Oryza sativa
tcaaagtagtcaccacatgctcatacgatttaggtagcgaacacaaaagaactatggccttgtcttcatcgtcaacttccacatccatcttcacaagatcagtgactagttgattgaaaacgttcacatgtgctgtcagatccgccccttcctgcatttttaacccatacaacttctgcttcagatacagtttattggtcagagtcttggacataaactgagcttccaactttttccaaattatctttggtgaggtctcctccatcacatggtacatgacccgatctgagagacatagccttattgtcgcagccgcctgcaactgcatctcctcccaatcgtcatcctctatcttggccggtttgacacccttcaaagcctttgaaactccttgttgagctaacaaatctttgaccctagtctgccacaagccaaaatttccggattcaccaaatcaaatttcatacctgtcggcgccatcttgccaacccgcgacctgactggtctgtcgccaccagaatactcgccctgctcagaaccgtctgtattcgtcttcacaatcccgtcttgtgatccaatctcagatattcaacagcaaaccgcgttcgctataatccgatgtgaccaatcttccgccctcgatgtgcctctgctctgcacggg

SEQ ID NO: 22307 - DNA, 450 bp, Oryza sativa
agagacacccctctaaatacttttttaaagaaaaattatgagtgtgtcaattgaacatgagactttagggttgaaattatagaccacttgtcactacactatcaggtgcatcttgtagcaccgccagtgtccaggtggcctccgccttcaaaaagtattcgccttgtttttgttcgcccatgcgaataattcctcttttattagagagcatgagaaagttgcttgaaatcatcgtagtgttagctaacagcaactgccagtcactattttctgcttcggttgctcttcccttctcttgtctagcaaaaaggatgatgtgatctgctgctaaatctggacaaaatttcccttttttttttgcccagatttaaatattgtttgaaaatttcgttcaacaatcgtgataaaaatcctgaaacctcccaaaattcagaatatgggtgccccaaa

SEQ ID NO: 22308 - DNA, 316 bp, Oryza sativa
cacggcacggtatgaccaaccgttgagtcgtgcatggacctcttcttcaacatggcgtgccggcccagcatgtcatggcccaatgatccccccccctctccccccccccccctcccatggacatagactatcggcggctagctgaaagagatgacggatgaaaaaatacacttatttctatcatcttaaggcaaactgccgcttagatcgggcatgcaccatatggcacacagcttacacctaaacataccttggtcctaagaagcatggggaatactgtagcctggatgcaatatggtccaccaataacaattga

SEQ ID NO: 22309 - DNA, 777 bp, Oryza sativa
tgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactggtaaaaggaaactcacaagcaagcaatattccaacccttattagtttgcagcagatgtgaggctaacattctcgaatgcgatgaagtataatccttcaggaaatgatgtccac

SEQ ID NO: 22310 - DNA, 868 bp, Oryza sativa
tgtggtaatttgccaatgaacacgatgtcgattaaaataataatttctaattgagtaggagtgagaaatcgcgtaaaatatcaaaaatgcccttggccccatgtcagctctccatctctctctttcttttctttctctcttctcccggtcgctgtttcctcggtgacaccgcccgacgaagcatcgccacgacgacctcctcttcctcccatgccgcctcccttcgttccaccttcgagccagccagcactcaagcacgggcacgccgcaccatcaccacccaccacccgcgcgtcgtcggcccgccccccctgcacgagaccactctgccgcgccggccttcccgcttccccagccgagccaccggtgcccccttctttttccccaccgttaccggccaccacctacgccacccctttccttggggccgcctccctcccatgccaccgtgccgccttcgttttttctccgccaccacaccatggcaccgtcgccctccccagcgcgtggccaagccaccggcacgccaccttacaccgggcacgcgccgagccacacccggccgccggcccgccgtgcacgccccgaccctccattcctcctctccaccaccgccggccctctccctaccgctgccagtatgctcctccttttttccccgtgccgcctccttctcccccccggtggctgccgagcccctgccgagctcgacccggccacatgctccgccgcaccagctgcaccgccgtcgtcgtcgccgccaccgccgtgcttgtgtgctcggtgcccccgcttgccggcgcaccgtgcgccgggtggccgctgcacctcgtcgtcgttggcattgggtacccggcggtgcgccgat

SEQ ID NO: 22311 - DNA, 1022 bp, Oryza sativa
caaataattgggtccaccgatttaagtgaaaatcgacggtgagattagacattgtcacgtggcggcctaggagcgtttgtagaagtgccacgtggcggcttgagagcgtttataggaagtttaatggacctttagtatataatagaagatagatagatagatagaagatagatagatagaagatagatagatagattacgaaacaattgctatacatttttgccaagcgtatgacatgtttcgtggtagaaatctaaacagttgccgtcttcgatttaccataactgaagtttccaaccgcgcagctctatttttactacaagagcagttttaatagtagataaattacggcaaaatagacatatatcgagagaatagataaaagaaaaataagaagtactgacttttatgtgtcatgcgtgtgaaattaaggcgttgatttaatctatgtgctgaacaaattatcaaaaggtgagtgttttggaaaatatggtgtgtcgagttttcggacggtgaatagttcaatcagctctaggaggccgatcaggtcagtggtgattggatggtctgaccgtgttgccgacagtcagataaggttggagtcgattttgggttgatttcgtgaaatttatagattttcttcatgtttgtgacttatagatggtttatattcatatgtgatattattgtgtgctgatgtaagtcaagttggtgcgagattgtactcacatatgaagtttttttccatgtgtaggtgttgcttgagactatgagagtatacccggtgatggattaaggctacacttggtagaagttgaggtctagacgatcgagaatatcacgctagatgctcaagctagagaacaatgagtgtggaggtgaagtttttcatatggcatacatatagtgttatgtgtgtatggagagagtaattaaatttggattggagtccaagtttgaaaagattggagtgtggagttgtatggggatactgcttccctggtttagtaggtttgctggtg

SEQ ID NO: 22312 - DNA, 3678 bp, Oryza sativa
ggattccagttgacctgaaaatataattaattaatataaaataacacaacagcagttaaaatctttgttataaatctataaaataggtagacttgcacttgcatcagaaaattgaagctcatcgaaaacttttctccattccatgactttctttctctgtccacgcgttgctcctccaaagttccatcgacaggcccggggcagcaagggtgttctgattcttttgttggggttgagttaatggaagatattcataaatccaagccttgagagaacaaaataaatctcattaacaaagataccaaatatcatcgacaatcattcaaatttattcaaacaagaacagtaccatgagcaaagttgcactgccgagaaactgggtagtagcattcggtgttacagcaacagatagtcctctgtacaaatgagcaagggctgcagatccccaggcatattcacgtatctttctaaaatcagccagaagaggtaaatatcttggtgatacaaatcccctcatcgtgtcaggaaataaggtggagccaacaaggtaaagaaggtatgcccgggtgctgtaagcaatctcgttgatagttggattttctggcaattgatgaaatttcctgtacaaccatgtcaatctgattaagccacacagttgctctccatttccagggctctctcctaagaaatgcaaacacatccgcctcacagcttcatcaccaattggctcagcagtcaccacatgaccagtcactggaattccaagaatatatgaaacatcacggagtgatggggccatttcaaatcccatgaaatgtgcagtatttgtttcattgttccatctctcacaaaaggctgtaagcaaagaacgatcaatagtaaatcctgtggtgagggcaagatgtccaagaccactagcattaactagttgttgctgttcgtcagttagaacccattcttttagctcccgtgtctgctggctgggaagcagaacaccatatcgctgtggaaaattgagtgtctgcatgtaattttgttcacgatggccaagtgaaaacaaaaggagaagcagctacataccgtccagatttgtgagcttccaaccggtctccgtccacttggtttttgttgttgtgttaccacaccttgagatgcaaggtccatttctcctggaaaacataagagggacaataaggtaattgttctatgatgcttggtccattgttaaacaaaaaaggaaaaaaagaaaaagggcagttgtaacttgtgtggataatacttaataaaacagtgtgtaaaaaaggaactatcaacacaaccagaacaacaaagtccataaataatgaagcaaaaacaaaaaagtgctctctcatacttgtttacgatatcagtgatagctgatgataagtaaattcacgcacaccatttatgaccaattattttgacaagttcaattttttactatattttgctaagataatgatagttgtcagcacaaagagagtcaagagcaaacgaattcaggtagtctgttgaattatttttctgcttactgccaatctaatagctggatataagaactaaccacacaaaagtgtgcagtatctcttgtaataaagagatagccggattcttcatgcaatttgcagggctagattatagtctattgaaagtagaaatgcatttgctatataactcttaggtttatttctagaaacacaattgtaactttcatacaggtatagtaaagaaagctctaaaatatatccaataaatcttcaccattataatctgagctcatcctgatgaacagtgacgatatttctccttttatttgataacgttgtaatttctagcccttgatagagaatatggtggcttctgttcagcctgttctaatagtaaataaatgctagtggtagtctggtggataagaatgtcgtgatgctcacatcaaagaaaaaagggggatgccgtgatgcttgaaaaaatagcatgtgagggcagttctatgtacctcaactgtcggcaaatgaagatcatgtagtaaaataggaagccatgcactaaatcatactacattatggtgatatttccatgtaataatgacaaaatgcaagagtatatagtaaggtcgatcgcttaacacaaggaaaggggtaaaaaaaggaaagcaggaaaacaaatatcatccatttctagtgtttcctttttacattcttcagtattgtactcttattattttattaagaaatgtaaacagtggcagagaggttttgacagagtcattggcttatgaattttacccctaagtaattgatagttgagatctaccaatgctaatcccttctcatcctaatatctgtctagctatccagcaaataaattagaaaaaaatattctaactatttattttcaataaatgttccaggatacactttaaaaaaatagctccagttgttattaagtgtgtatggatttcagttcagttcagtgtggggtacatggtacccagatacccatagcaaggcgttttgggccatgcggcatgaggtgggccgagtgccctaggcccacatggttaacttgtaaactaagaaagagataagggataagttggccaatcctatcccttgtaaatagatggtaggtacccggattatgaaggctacactaccatatctagccggttgcctccgcacctatataaggagcaccgggaaaccctcattcttccataagcgccacgtgctattcctacgccgtgctgcgcactccaatacagatctaatccactcatctggactagggtattatctcacgtcgagggtctgaaccagtataaacaattgtctccatctctcctagatctagtgcaccctataaattatattgccgatcataagaatcgacattcggctttacagcttcagccttatgaaaaatcaccgtgtaaagatagcacacaaaatctcaaacagtccagcacaaagcccacattttcagaccattgaaaaaccaagagaagacccgcacattcaagcataaccacaaccagaaaaacatccgatcttagccccatcatgatgctccagcacaatgaaaagagaaaaaaaaaggaaccactctacttccatgaaagtttatcccatggcactctattaatcgctgccacacattcagtgatcgaaattaacaacaatctataccctcaaggccacaacatatccagaaaaaaaacagtactaagaacagatgctatgtgctaaacgcacgctaatttcccacagcatttcattgcactcccccaagccatctaccacgggccacgtactacgaaatgctaaaagaaaaaaaaaacctagaccatggaactcgcacagatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaagaagtgcgggaggagcaaccggtcaccttactcgccggggaaacgcgccgccgccgccggcaccggcgacgacctccgttttggagcggaggagaggttggagaaagcgagcaaaatcttcgggaggggaagggagaaagaaagaaagagagagag

SEQ ID NO: 22313 - DNA, 15033 bp, Oryza sativa
cccaatattgagttcacaccatgagtttcattcacaaaggatcccttgctgcccgcctgccatgcactcctctaaccacatgtcaatatattattattccttattacaataccctaattactcgaataaagtaaaaaaaaaaagaacaaaggagcgaagtatagtgtagttactccttccccaccgaacatatctcgttccaatcttctatatctacttccctcctgctcacgtacaacaattccaccaccaaatctgtcaaccatgatggcgtacctcgccaccggcgaccactagaggcctctgtacttgggtttttgattttaggcagttccatgacgtgtcttaaaaaagagttgagttgatctggtgttgtcccccaccaagaccagaaccgccagcacgctgttggtttgcccagtttcgctgcatcccttgcctctgcgctgatgatgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactgttaaaaggaaactcacaagcaagcaatattccaacccttatgagtttgcagcagatgtgaggctaacattctcgaatgcgatgaagtataatcctccaggaaatgatgtccacggaatagctgatcaattgaacaaaatatttgattcggaatggaaattattggaaaggaaatggaaagacagaaatttggtacaagagcagccatcactgaaggtattaaaggctcagcctgctgttaccccaaaacctgtgctacctaagggggtgactgcaggcacaaattcagctgtgagcaagacactggcaactgcattatcctccaaagtatgatcacagtcatgtaccctcattcagtgatttttcttcttgggactttgatcaaagtactgctctctttgcaggtaaaaattaaattttctgtgcgaggctctgagctgacctcttccaaaggtgtgaatagaataaactctatgcatacaatctttccattgttgattgtatttgacagccattaccaatgcttttcaattcagacacgcctttgcaagcagttggcagaagagacggcacaattaaccaatctctcccttgcaccaaggttttgggcacgagctcctttgtttatacttgagtattcttatctgagtcttggtatcattagctaaacaattgtgtgatccccctcttgtcttgtcttttatttttaggacaatgctaagacaccaaggatacaatcaagtgaggacagatctgaatcaactggtatgtttatgatttccacgtaattttatcccatactgttttattttactaaagcactcaattattatcttaggaaatgaattgcggccttgcgatgatgcttctacttcacctcttgcttcttccagacaaggttggacatgctatctatttatccatctatttgtgcatgttaatttgcatactagtatctctgttctcaaaaggatgatgtcctagattcattgcaaacacagtcaaacctcaaaaatcttaaatcattaataaatgaaaaaataccaggatttaaaaatcatattagtagatttgtgaggaaaaactgtcatatggttatattttaaatattgttcccatactatcataaaaatacaaactgattccatttgtcatccttgagttttcggccatggcgcaattctgtcgatttcctgcacgtgatttttcggtcgtctcatcattgtttgtttttcatctgagtcctgtgcacactgtggtccgttgtctgcatccgagacccactcacatccgttgtccaacgtcccacgcatgaccctgcctcaccttggccacatgcacccctcttccgtgtgcccatggtgctcccctcctgatccatcctttcctttcgtccatctccctcttcctatgctgcgagaagcagagctgccacaagcagaggcaaagcacagagcgtgattcacttagctaagctgaacatgatcccttaatttttctccatcagataagcatcgagaagaagtggaacaaatttctggattgattcattgtttatgtgagtagttctcaagtctggtttagttacattacgtaaatgtttctgatccacacccttcttttcgtaggacgatgaaaaagaatggataaagatcccaagaatacatagtttgatctgaatactcataccttgagaatagcacatctacaagtaggatttcctctgtgatcgtaccaaaacatgagttccatttggattttcttttttatcattggatttcttcaatgctatagtgtcattcttctggcgcttaatgctatctattcccaattacaattgtgtacagccctacacccgttgcaatgcacggtcattttgctagtaaatatataacttgagaaagtaatgataaaacatgtgcattggagactgccgatgtcctaaatgacaaccatttgagaacagagggtagtaactttatcatctattctttccatatgttcctttgctaatatattgcatcttatgatgtgaattttcagaagaggaatatttgcctgaagaacctttatcaccaagcaaggctcttcgtgcagcaatgctcaagagtcgttttgctggtacaattgtcaaggcgcagcagaaagcacttctggatcatgtattatttctgaaatgtgtactgaaatttgtagatttcaattaggctattccttcgcataggacaagttctagtctacgtctgtgtagctcttgctgatgtgcttttttaatctcctaggggaagaaaatagaccctgcgaaattgcagttagaaaaggagaggctggaaaaaaggcagcaagaaggtaagaatttgcttagcctttgatagcagatggcatggagctgtttgattggcaatacattttttctttaagttcatcaagcattttgatattttatattcgcatagagttctcatctggacttaatatgggatggctgctctttgtgaaagaacttttagaacacattacggtgaaacttgattgacatctcaggcttcgagaaactttgggatcaaaacagtccgtcgagagactttggggaacataaccccggtacatgctagagaattgtttgaacagtacagtgtcccacatagacaagtttgttagtaggtagaaattttatagcaaggcatcatcaagagtcgttttttaacaagtcgatcaggcttccgaccatttttttgttccttgaagcaaataaacttaagatttggatatatagaataagaaaaaagagtaatctttttaccagttgtccccacatagaccacaggttggctaattcaatacactgcttcatagtaactttttgagtcaattcatatactttcacgctgtgaatactcctggtcacatcggatctatatctattttggccaaacgtaatcttgtttcaatatatcaaaactgtagtaattttgttatgaaaagcatgtccatgatattccacattatcacattgttggaaagtctaaaaacaactttattttgttggaaagtctaaatttactttgaagtgtaaaaggtggcatgttttctctgatgggggaatgggtttcctttaaaatgggaacgaatgctcataactatagtggtaactatatattgtatgtattattcttaggttatacttttattttgtattggcacgcatgatttcagttgcatggctttcttttcaatttacccataatgcagagaaagcaagaattgaggcccaggtgaaggcggctgaagctgctgcacaattaaagctagacgaagaaatgaggatgaagagggagcaggaaagacgagcagcacgcctggcactacacatggtattacatgctgccattttctgaccaactagtttgtatgcttaatgttgcacggtgattactcaatctcttctcctacgcagatgaagaagactgttgatattgacaacagtgacttccttaaggacctggaaaacttaagcaaaaagtgggagctgaatccccctggcaaacttattgttgattttgtcgacgggatcgatctaccacctggcttagggagtccgctagagaggcttggccttttcatgaagaaggatcttgaggaagaggtcgaacatgaaatggaggacagtgtatcaccatctacggagatcgacgtggaggaaggagagatcagcttctgtcaatagcacggctctaaaatatccattgtttcttcctttttttctttccccccatcagactctgaagcaacatgctcgcatggcttataaaattgtgcgcgagtgctgtgttatttattctgcctcaagacaacatcataacataagccgagtaaaatgaagcgttggttcatctagtttgtgttgtctaaccagaaaacaaaaatgtcagctgaacactgaagtggagttatcggttgcgtggacttcgccccgattttgtcggttctgtgaaaccctgtatgttgtaggtgttccacgtatgcaattctgtaaaaaaaggaaaataaaaaaaaagttgtatgtaatgtgatgttagactgttagtatataataatattatagttactgatgagtgtagatgtttgctattgctggtagtcgcctcttgctctcagcagtctactcgttaccgtgtgttgatgttgtgaccttgtgatgctgttccagttgaaaccctcagcgggcagatcccttcaagcacggctcaattggatcagcaaatcaattagagtagatatgtgttgctgatgatcagcaaatcaattagagtagatatgtgttgatgttcttttctcaacaaagtggccgtagtttagtggctcaattggatcagcaaatcaattggagtagatatgggttgctgatgatgttcttttctcaacaaagtggctgagtagatatgtgttgctgatgatgctcgtttctcaacaaagtggctgtagtttagtggtgagaattccacgttgtggccgtggagacctgggctcgaatcccagcagccacatttataaattttgcttttcaattttatttcagttttggaattctaatattcgtatttttcatctcagtctcttttaacaaaattccactacatctatcgcataataattgtatttctatgatttaaatgtccccaaataattatccaatagagtactaatgtcatttcaattttggaattctaatattcgtatttttcatctgtctcttttaataaaaaaaattactatacatctatcccataataattgtatttttaggatttaaatttatccccaaataattatccaatagagtactaatgattccattcattacttcccttccattctgacctatacactatttaataagaggcattatggtttttcttctcaaaccttaacactaacaacctagaattataattttttttggacggagatagtattactttattttttccgtctattttctattgatataatttttaattagatttaatggtattataacttttatggttttaaaatatattattagtattcacctatttaaagctgcgtgccattataatttcaagaccattgaataccatgccaatataaaacaagcaggtctataatgtgcgttgaatttctcccgtggaatacgctgttttgacaatagtacgttactcctgtaaagttcagaatgaaaggtggatatccctgtaagcaaatattagcatgatacttcattttaacaacgcaaaagaaccataaacaaggataacagtcttcgtttcaacaacacagaagacaaggatcattacagcattgcagacttgccaaatgtggcgtaatcgttacattcatccatgtgttatacatgcagaatggtacatactacaatagctcaggagtcagcgtagctgtatttgtacaagagccctcgatataacaaaatcacagtacattgaatactttcatcaagttttctcatctatagacccatccttttgggcctcaagtatgtcgagcctttcttcaagcccggcatagaaacttgctgctgctgcttagctctcttctctcgctccctctccttctcaagccgtgcggcctcggcttgttcttgcctcagcttctccatctcctcctccatcgcggtcttgtcctccttctgcctcttcttatggtcgaggagcgaggtgtcggtttccttaacagagaagaacatagggcccaactctgccagccactgcgggtcaacagcggtgacgcactgcatgtactctttggtcgtcaggacaagctcatggtagacaacatagtcaggggtgtaaccaaggccgtagagtgcactgctggggtggaggtggcatggcatcccgttccggcagttcacatactccccgacacccttcaacctcgcggcattatggaagtatgcagagcagatggcttttctcaccacatcccattccatatggcatgatgtcagtgggatcttcagggttttcagtatgtccaatagctgtgaccttacttctcgagcctttcggagacccttgacatggaggaagtggtcattacaccagtctccacgatattggttcgacttccattgcaggtagacattcagaagagttaaatgatcagattctggaacaaaaaatttctcccttgctgcatcactctcctctgctcgatctttgggacgaaagaagactgagggcaccgagagcattgacacaatggtcagtacttcatcaaggcactccagctgttctcccatgagaagcatctttgctagagttgggtccaacgggaattcaaccatcttccaacctattactgtaagagcaccaacattgttcaaggcacccaacacccagagctggtacatggagttgaggatgttctcctgcgggggtgggtccatgaagtcaaagtcaagcaagttttcgactttcagagatttcagtagcagaaccacattccccagattggtcctttggatctcaggcactgggttaggtagcatctcattctggtaagctgattctgtgaacagtctgtagcatgtgccaggaccagttcttcctgcacgtcctgcacgctgatctgcagctgctcgactaactggaaaaacctgaagagcatccatacccatccgtggattgtacaccttcatctttccatacccagtatcaatgacataaaaaataccatccacagtgagcgaggtctcagcaatgttggtagcaacaatgcatttgcgagtgccctcttctgccttctgaaagattttggcctgcaggtcagcaggcaactgcgagtagatgggcaagatggagagcttgggtacagtcttggtggatgatgatatcagctgctccaggcgctcagcaagcgcatagcaggtagcctcaatttcctcttgccctgtcataaatataagtatatccccagggccactggttatgtggattgtcatagcctgcttcactgccgcttccacatagtcttcacatggtgttttgctgaacatgatatttacaggaaatgtcctgccaggaatatggaagacaggcactctgcggataaagaaatgttacaagattagcaaaatagaaaatggattcaaatcttactaggaaaaagaaacagagcaagttatcttaccctccaaaaaattttgagaatttgtccgcatttagggttgcagatgtgacaattagcttaaaatctcgtcgacgtgcaacaaccttcttcagtatgccaaacaaaacatcagtattgagtgatctctcatgtgcttcatccatgacaataacactaaaaaaagtaaggaaaggtgctttagcatttgggaagcagtattttgatactgtatttagttctatcaacggtaagagagctatcagcataccgatatttgtcaaggtcagcatctttcaaggtttcccgaagcagcactccatctgtcatatactgcccaaaaaaaatcccaaacagaagcagaaaccatgttagatctccattactacaacaaagcatcaatcaatttttttaatttcctaaatggcataacattgttctggcatgaagtgtgttgtgttcatttgatgtaaaattcataatgctaacaacctaatagctaatgctgcacccaaactaggctactaacctaagcatattctagttttaggaaacttcctactaccaagtgaaaagacaagtcatcaaccaaggagtatcaaaacacaagaagcaatatacctttattatagtgttgggactagtcatgtcctcaaatcgaattgcatatccaactttatgtcccaactcagtctccatttcttcactaactcttttagcaacactcatggcagccacacgtctaggttgagtacagccaacaatgccggtggtggtatatccatcctcatgcagatactgagtcagctgggtagtcttcccagagccagtttcaccaaccaccacaactacttgattttcacgcacaacctgctcaatgaaatcaaaacaaggtaatcaagaacttgtaccactgcatccttttgaaagaaactaaaaatcaacatcttccaaaggaaacttgattttcaaattaattacaattttctgaagggcaagaattattatcttgacctttctccttgaggatagctgcataggtgtactacaatcatcaaaaccatattcaaaatattctaccgatttgtttttgaataatttacactatagaaaagcaacatacctcaaacataacaaatgctgtaaactagcataggaaaacaaaatgaaaactgcaaataaaatactgaaaatgagtttataaactttagttacaaacctgtagcaagtcatcccgtacagtaaatatcggaagatattgcctctgttgagaaagagattttgattttgcaaagtcgctaacagcttctgcttttaccttcatgtgctgtgaaaattttgcttcgggtttaaaatcaatctcaccttggtcaccaacagtagcagtatctgcatcaacctgatttttcaaaaaaaaaataagtaaagcgtaccagctaaacactattaggactatatatattatggcaaataatctacctgttcagccgttttctcaacacccaaaatatttccaagcttagatccagcgagctcccaaaagcgttggcgtgacttattcatgctctgtttttcacgaatttccctgaccaaagcagaacctttgcgtgcaactattgccatatcggaggttgggtccttcagtggcattacaggttctgcttgttttgtgaatacaactcgcccatccaggaatgggggttttgtgtctgcaaaaaattataccgtcagcatttttaagttcaacagcatcaatatattgtaaacaagtagtagtaaaaaaactttgtgaaacaagtatgcagcacgctaggtaatgttctattctcttcaaaattcgatacaatgtagcatgtacaacagagaaaacagagaacatagataactcctaatgcaggttagaagtttcagactgacatagacaggaaaggtggaaatatgtgccctgaaaatggtacataacacctctcctacatatgttcacagctcataaccgctattaattcaatatctgcttgtttcattctttctgcgacatagaagttccgagagtatctacaagaaggatcacatgaagcagccacatctactagcaaatgcacgtaatagtaaatgcataataagataaatagatgcaaggacctcatcagttagtacaactgcgagcttaccttaccaacataaatagtgtctattattttcataagtaaaattgcatatacaccattacatgagaaatagatagatgctttccaaacattttcgtagcttgtttagtgacaactataacatcgataagaggctgcgatattcgaagaacgtaccatgaacaagaagtattactttcctttcgtcctcatcatcaaattctgtctgcacctctgttcctctgacagctccagatctcaacaactgtctatcctcccattgagcattatcagcagtcatctgtgataacttcttgctctgagcaagggtcatcagactgccatctttacgagtctgcacccaataaaaatagtaagaaatcagaatacaagacattctctacaagttaaagatatgaaaaattattacaaaataactatatttactgaaaaactaagtggataattcttgaccatccaattttttgcaggtcttgctgcacatgggtttggcagtcttgaaaaaagttaaatgaatacaatttcctaatgatgatgcaattttcataatatacataaggaacttgaacaaggaaaaaacatacatctaatttggtggtattctcaagccttactttacttcttaccggtgcacttttacatgtctgagtacaaattatcggatgtttacagtaaatcacaaaatgcaagacatttttacaaaggcggagtcttgctagaagatagaagtatcagatccatacattcagtccagcgccacaatagcacgaccttatcatttactaattaatcagatatattcatggtttcatagaggctgtagctgcaataagttctactcaattactcagaacaaataagaacttatgaaggctaacacgaagtgcatggaagcacgggagatgtaaacaagcaaggaacttaccagccgctttggtaattgtgcttccctctttttgtaggaactatcatcttcaagatacatagaattatcaccatcaaacatggtgttgtgttcttcacaatcatacctggagtatatttgtaaaggttagaagaatgtgtaatcaatttgttgttgtataatgataagagaatgtcaaaaatcattgtactttcatatctctacactaccatgtctggatagaactatggcataaaatcagaattttgttacagatatatgaaaaacatcattgtgccaacttacttcagatgccattaccatttttagctattataaatggagccaataaatgcaacagcagcaattgaaaggctttgttgatcacttggtttgcaaatatattttttttctatcagacacctacatcatccttttgaatacaaaaaccagggaaatttttatgaggaaagaaaagtaccacgcacgatcagcattataatccatctcctgcatcatttcttcagatatctcatagttgccatcggcatctgaggggcttctatcagattccctgtcctgagataacagggtagaggttattgtcagaatgaccagtgaagaaacaaaatgagaacttgcaatatactataaagtgatccacaaacaacatgaaacttaaagttagttagacttctgtcagtaaataccaaatagactcaatcaagtctattgtttgattgaaagtacatgaaataattaaatgaattacatagtagcctaactgtaatactcttcagacagaaagaggcagaaaaattaaagcaacttagatcagtcacatggtaatttcgtaacattacttcagttatagtttaagtaatgctatacacacgttcagttcatagaaataaatatcgaacatccaatgacaattattctaaaaacacagatagagagaaaaaagtgaacaaaatacatgcttcattacatttatcattgtttcgagcactggtctaaatggttgaattaaattaccagcagagttaccacttctaaaaatcggcattccaggagattcaacattaaaagactgtcgtgctaaaaggaggattaatttctcaatagatgtgatagtgtttaggaatgtatgaatggggcttccaactctctacaatgtatatagcccataggactacaatcttcgtctactctacttcacctcctgggtgtatggatgtcttaaaataatcataccgaacttgcaacatatgagatgaatgcaaaaaaaaaaaacacctgatttttcctgtataaaggcatgttttgatttttcctacataaaggcatgttttgtgaaaacagaatcctgacttacatttgatgcagatgtagacgaaaaagtaagctggtgggatcttccaccagaacgtggataagaagacccttttgatgaaccagaagcgcgaattggtgcaggtgatggagatacgttatcccatggggatgctggatattcaaaacaacaatagaagtatgatttatttgatttaaattaaagaagaaaagtgcaaacaacattgaatagctgagcttttgttacctgcataacgtggcgtattcccacctagccaaggagacactaagcgtgcatcaggggatgcagctgcaagcataggagatggtgaaggatgttgtctatgggaatttgagcgatcatcacggtactcccgacgaggtgtatcttcccattcccatcggccactgtcccaatcagatcttgctaacaatttgcaatcacagccacaattttatcagcaagtgacaagccaattagcctaagcatgaaaagaataagataacaaacatgataccaggtgttcttgagcttcttgagctatgctcatgccgacttcgcttgttcatgtagtcaacggatgtagatctctcacgttcatcacgcctattatgcgattctctatcatcatggtgtccccgccttccactgctactatagccaatggatgcagatctttcccgttctccatgtttatcacgggatcccctatcctcatagtcatcatatctacgaggagtgctacgagaatgggaaccttgagaacttctagatttgtgggtctgtaaaacgacatgaacagaaacagacttggttagtaaggtgaagagaaaataaaacagccagattctttatgaagttcccaaagtaatatgggacacaagtaatcactaacatcttgtcgataagatccatctcggtgactgggtgaaggaccccttccatcctcatcagtgatggtaggttctgaaaatggcgataacgctttagttacaatggacaatcatttgcatttgtaacatacaagagtgtatatatataggacctttgaaagaggttctctcatcagagttggctcctcgatagcggcgagaaacactgccacgatggccactgctcaggctcttctcatcactctccgcaggtcccggcttctcatcttcatcgattgaagtagcagctgccactaccttctgaggcggcggcttgaaggcattgccgccttctgcttcccgtttcctgtgcgcgaggaggtccaaacctgcaaaaaccacatctcagaatcagctcacccgagctctagattttgcaggcctcgacgatttctgagtcaaattcaaattgggatctgctcatcaagttttacacactaatctcgctcgcggaaatcgaactccctagcaactctagaaatccacttaaaatcaaaatttcctgaagtctcgtcaaatacagaagcagaagtaaaaccaagcaccaccatacctagggcggacttccccggcggcggccggtacatgaccctatccctgctcggcaggatcagcccctgcgcgcccgtgtcgtcctccggccccagggttgtcatcgtcgcgtccatgtccccctggaacaaagagagaggaagcgccatctcggcgtgagaccaaaagctcgctgactaccccaaaaccccaacgcgctcgaaacagattactcacctccatggtcgccggcgggcggagcggagggcggcctccgagcaccgggcggcgccggttcgactgggaatcggcggcggcggcggcgagagggaaagagaggggggaggggaagaggtcggcgggtggattttgattttggcccctccgaatctggagaggtgaggtgagggcgtgggggatttgggatttgttggtagcgggagggattgggatgtaaaaatcccaacgggagttttccacttgggaccctgtaggtttgatgttattacaagctgtgtttttactaggtcggttagagaattttgtactctagtgcaaagtaaatggtggtaacggttaaacataatcttggattccgagataattacttatttgccctctaaattattgaatgtattctctacttagaaaaaatgtccatgtgttgcaacgggtaaagtctattttaatcttattatatggtttagttaagataa

SEQ ID NO: 22314 - DNA, 12468 bp, Oryza sativa
cccacaaaaggattaattagagagtgagtgagaaagagctcctgctgctcctgctataccgaggcaactgagagtctgagactgagaggagagaggttgaagatgagggtatttccgtcacatatatgtaaaatatgtatgtcaatggcaccattacaatttcagacaaataccaatagcatagttctaaataaatgaatagtagtggtaaatttcaaaattaaaaaatttgtaatgttatatatctaattaaccatatttggtaatctttgaatgcgaactaagggtagagccaccatttctttatccattatatctatgacattaatctctatatatcccgtgcctcatgggatcatgcttgtgttggtactttagatccattgagtctacttctcttcctcaatgatataacagggcatatgcgagcttttgacaaaggtagtaaaatgacatgtcccgctcaaatgttaagcccttgaatatcttggtcattgaagtggggtagggtgctttaagtttcttgataattagcccgatgattggttatctgacaatgattatgacaatactatgtttaataaaacaaccaacaaacaagataaatgatcaatgaaaattttcaaatacggcaatctgaaacaagtcatatatagaaggaaaaatgatgagggtgcctaaagcaacaagtgaatttgacaagataaatgagtatacatagaaaatttgagataaatataggctgtgttcggcaccccttttccccaaccactctcccttgttttccacgcgcacacttttcaaactgctaaacggtgtgtttttgcaaaaagtttctatacgatagttatttaaaacatcaaattaatctatttttgaaaaaaaatagctaatacttaactaatcacgcgctaatgaaacgctccgtttttcgtgtgtaccgttccgattgggaaaaaggatgccgaacacagccatagttggcgaggcatccacaaaaaaaatattgggctttcatgttttggtgaaaagtgctcattttgatcgtcatatcctaccttagtataaagttggtatctgttaactcataaagctcaatatgtaagtgtgtcagatcatcacccatatctattttttctataaagttaagacccaaagctgaaacctcagtattccacgtcatcgctaattcttagccgttcgatcggtggatgagatcgcatatgaaccgttggataagaaggtccccggacgagatgttgagcagtgtgtttatgcatgcgttaatttagaatgcatgtaacgcaagcatgtatgggtgagatgttgagcagtgtgtttatgatcagaggccatgggccatggttagtgccatttattctccttctaaatctctattaattcttctagattttttaataatcacatacatgtaactgaacagaaccaacgccatttgagaggttattggttcgatatggaaatgaaaattggtcacatattggtttaatctaaatgcatatatatgcagtagacccacccgattccttttgagcaaatgcaatttcaatttactaggcatttccatcagttatccatacacaaagattagtcttagaatactacaactgaaagtatctcatgtatttccgcagcaatatcaaaccacctttattttacttttcaacgatcaaatcctatatgatataaattgttataccccccaccatcttaattatttgtagcttttttcaatagttgattaaaactgaaaattatacaagtgtagctattatttcttctaacatcatacaaaaactcccgcaacaacgcacggggtttcatctagtcttactataaagttaatgcccactaactactaaagctcaatatgcaagtgtaccacagcatcaccaactagcaattattatctaaaatgttttagatcacatgcatctgtgccatatcatcacccactagcaattattatctagagtattttaaatatcattcaaacatgacatatcatttacaattttattgtatttttagaactcaatatgtaagcaatgtcatatcattatctccacattattttcatattatttagatatatgcacctaccattttctataatgtataacatgcattcatctacatatctcacggtaagataggataagcaaagttattgctttcttatgtcctccttattttgactttcaacattgcaagcaatttgtagtaaatgagaaagataactataacttcgacgagcaaacttgtttcatctatgcactggtaccaacactctttgcatgactttttgttaacaacgtatacgtcgtgctgttggccccgtctaccagttgatatgccaatttttgttgagaagtaattgttatgtacaagtcatttaaagccgttgcatgtcaaccaatatatagccatcttaacatacaagcgcagtaatcctatgtgaaaaacataacgaaccactacatttcaatcgaatagggtatatttggtgacaatcaatagcacataattcattttttaatacgttgatgaaaaaagaatagagggagtatatgatattattgagctaaactaagattagttcaaatactcatcttaaaattccttagaaattaatgtagaattgatatttcgtttgttccaaaatgctatcgcgcatggaaagcaagtcaaggcgagggaacacctgctcccattcttcggaaactcgaggttattcgcgcaaaatctcctcccgtcggtcgcccgaggtctgacctagggttccggcgactcccatggccggccgccaccgtaacccgccgcccccatccttccctcgcggcggcggcgggggcgtgggcaggggccaccacccgcctcctccctcgctccaccaccaccgccttcccgccggcttatcacctcgacgacttccgggagccgccgttgctccccccgcaccaccgccttgacgacttccgcgagccgcaccacctgccgcccccgcaccaccaccaccacctcgacgaattcggcgagccgccgcgccaccacgtgttcgcgggccacggcggcggcgccgggccccccccggcgccgcacgtcgtggcggcgctggaggagcggctcggcgcggagatcgagaaggcgcacgtgctgcttggccagaaccagcggctggccgcgacgcacgtggcgctcgtgcaggaggtctccgccgtgcggcacgagctcggccgcaccgctcgcggccttgccgctgcccaggaggaaggcgaactccgtcttcgcgaggtgcgatgcttttctgatgcgctgattttgtctctgttttttttcccactaaatccttatgagaaaaatcgatctatagcacagaatcctgatgcttatcccttgcatatatttggtctgtttagttcggcaaaactataaattcctcttgcaaatttagttccaactttgacttcctgactcaattgcgctaaaattttattgcggtgggtctgtttgaagtgattatgcaagcataataaccaatgtcgtctattttggaaccctccaaattttgctttgtgaaatactaggtgcatgataatgcgggtctgtttgaagcgattatgttagcataagaacttatgttgtctattttggaaccctctaaattttgcgttgggaaatactgcatgatagtcggagccagtggtatactgtatttgccttgcattgtgcctttgtttgcaaaggtgagggattcagtgagaagaaaattggaaagagggcagtgtaggtacggtagggttaagggctgggcttgcaagcagagccgggtacaatccatcgtattcttgttttggtagtcttgcaagcagaaccactacaatccatcatattcttgttttggtagtcttcatccaccttagtgttgtttccatccgtctccccctatgctgataatgcacggagctggaggtcagcacttagaagtgcaatgcccgtaactccataagatgtgtgaatatccacattcatgaatcctgggtatggattttattcacatacaaggtgaaccgtgaactgctcacttcatttgaagtcatcttattcttctccctcttgcaagattggtaagcaatggaaatgcggcagggagggagataatgacgagtgagaaactaagaatagaggggagatggcagcaagctagagtagacaaggcgcatgtttatgccttttcgatgccaagcacaataactttccccttcggatgccaagtttgcacaacatttgtccacaagggaaaaagttcattttaatatttgacaaatatgcaacctgtcatggctaagttctagattttcttagtgatacactgaaatttgcatatcataattaatgagtaaatttaaacagcacagagcgttctccctataaatccagaattttctctatgcatgtgtttagttggagggattttggtgggttgggagggggccaacccatttttgtaggtgtttggttgaaggactaggtggaatgggatgaaaccaaaaaggaatattccatcaatatttgggatgagacggtccgccagaaatggccggaccgcgcctatccacttcacccgcgcacatcacgtgacccgcacatacctccatccatacagtgaccttatccttcccagccagagtctattttttccctgtttttacccacccagcgagagcgatgcaacaggagcgagagtggcgatggtagcgtgcgcgccgtcagagacggccgccactccttcctcctccctcctccatggtggctgccgcgtgcacgcaagtcagcaacggccatggctccttcctccctccatcatgcgtgcgggcgagctgccggcggccacgtgcacaagagtcagtgacggctgcggctccttcatcctcccttctcgcatcctcttgctcgttgctgctgcttgtcctcgcatcctctctcgtcaactgctacgagctgaattctggagctgaggagcagagctagcttggctgtgatgcttgattcgtgattttcgatttctgatagtggatagacatcaccaaagagaaagacatctacgtatatgcaaattaatagctctagcagctctaccagtatagtcaacatgatatatagttgtgaaaatatgtgacggtggattgacatcacaaaagagggcatttttgttagaaaaaaaaaaagctcggtgtgagaggtaacctcactaactcaatgtgaggaggtatctctatccaactatcccaactccatccctccatccctccatccaaacaggtgataggaccattccatccctttttatccctcaaaccaaccaaaaaaatagggttcattcccatccctcaaaccaaacagaaaataaatgacagggatggacccagcccatctcacctcgccctcaaaccaaacacatgctatgcgaaaactctgtttattggagctgtgtaagtattttcacactgcttgatatgatgtttgaaacttctggtcgtacaatggcatatgtaattctttccccccaaaaaaaatcttaactgatctgttcttaatatcttatttccttctattttccccaattatttccacatatcatcttaatccactgcctttaaatacatcatacttaaatgcatattttgtgttgagtataggttcaaagctgcatatctgagtgagaaaggttcattgaaattttcagttgaagagaaactgcattgtttggtaatattttcaaatgtggtcatgtcaagcttatgtctctttgacccaaagctatctgacttagtgagctagtaggttagttctgcccatgccaagtaaaattgacttgtgcctttttggattgtaacatcagaaataattttaataggtctatgagaggtcaatgaagatggaggcagagctgcgagcagtagaggaaatgagggcagagcttgcacaggttcgcctcgacattcagaagttgggtgcagcaaggcaggaactcatgggtcaggtccaggggttcacccaggacttggctcgatcagcagtggacctgcagcaggtggctgcgttaaaagctgagatccaggagataaggcatgaaacacaacatttgacgtagagccttgttaatttcatatgcactttcagtgttctgaaagagagcgatgtgtatttttagtctttttgcaaaaatataatctgtatatgcaaaattgttggtgttatctatttcccactgaatcatcttagctatctcctttgcacttgtgagaaaacaatccatcgctgttttgttttgccattctcttggttctatgaactcttttggtttgtctggtcaagttacgatctattataattaaaatttgaaatggaatgagctcttactttttttttgtccaaaatgaattccagttacccctggagtagtagagagagtgaaattccaagaataaccttatgtttttcaaccttatatggttgtattatttgacctgcagatctggcattgaggttgagaagaaaggatatgccgagagctatgagcagggacaagagatgcagaagaaattgatatcagtggcttctgaagtggagaagcttcgagctgaggccgagaagaggtcacgagctgctgtgtctggaggcaatcaaggtacttaacaaactctggatgcttatttttctctagtactctttttagtggttcgggaccatctgtgttatgtagggatacttaatgttttgaaatcagatcatgtcaaccaaagggcataatttgtaaggttgaccatgtagtttaaatctctttccgtgttgcacatctggaatataacttcatcatgacatggtgctcccatcctgcagtgtacgtcggaggctatgggaatcctaaggccgcatatgccgcaaatccttataatgctggatacaacataaatcaagtatgtctcttattctttgtttccgcaatacctatttgcatattctttcatcctcatttcttgctacttttgaagccacatccccaggcaaacactgctgattccggctcccagtttgggcctggctcaacgcacgctccctggggtgcctatgacatgcagagagctactggacggagatgatttttttttcaggtgtgttcagcaaattacaaaagcatacttttctgggacaaacctaacagctttcatgcaatggtgaatcatgaatgtattacttactagtatactctactgtgagttgtgctgtacatgtattacctccgtttcaaaatgttgcaacctaggacgtgatttatcctaatacaacaaatctagacaaaagttctatccagatttgttgttctacgatgggtcaaatctgtcaaatcccatgatgctgatggagactgcagatttgcgtcgatgtgcattttccacgctagaggcatccatttctggcgcagcaatctctttcgatcgatctatggacgagtgcgggcgagattcgttgagaaacataatggatgatttgtgatgtcggaattcctgtacaggaacagtcacgctgcaggaattggaggaattgtgaagattgtgcaaacaataaggtttcacaggaggaaaaaaagagttaaacttgtgaattatcccattaaacaacgcggtgttttattcttcatcattgtgaccatacgtcaaattcgacaactaatcttgtgggccaaataagcattttgaattctgagcagacaatgacgctacttatgcattcaacaggaaagcacacaaagacgttatggaacagaatcatcaatcaataaacatcattagagaaagcacacaaatacgttacggaagggaatcatcaatcaataagcacatcattagcgaaagaatttggtacataaataactttacattcgaaaggcatcatcatgaatggccaaagcttttagtctactgtctaatctgctgccaggaaaacatgtatactgatcacaagttactaaaacatgtacaaggtagaacaaagaacataccagtcatacggcctaaacaactccaaaaggaccaaaaatcatggcagtcccaaaccaaattacagattttagcagcgcaaatctagattttcaactagcatttggcggtttatgcttgcgggaagactttgtttggcgggatattttcacgcctctccacgtaggcagccgggaaccatcctgccacccccttgcattctccttcggcccaaccattcggagcaatctagagcagatacaaatgaaaaggcaattagatggtaaatttggattgaggtcttaatgcactagacaattcagcaccattgtttgttggaccaatcgattcaaccctacccaactttgtacatcatctggttattccctcgttgattgacaagctaatttattcctgaaagaaggacaatcactagctactacatgatcaggacaagcctccagagactaattggttccattgccagaggaagtaaggcactaattggtcatctagtctagagactattgaaaatcacttaagattctttctgcgggcaatgggggcagtgattaaactgattatcacactacttcgcagatgaaatgattattaggacactgacctgacgaacaacgacataatcaccaacaattaaactcaactccttttctgtggtaccattgaagttatgcaccgcctgcagcaacaagaaggttcaatgcacatgacatgtaaaatatggtataattgcttggtaatgtcagttactcatgttaacctcagcaaggaagtactgggccttctcagcacgcttatgggaatgaatagtaggcggtgcagattctctcttttgcttttcagaggacatctagaaataagaattatgcaaaattcagaaatgcaagagattttgacagtttacatgataagcagagtgaaaattctacctcagcttcaacatcatcaagtatagcagctaacctcaaatgaaataacttttctgcttctaccttcaacaggataagtgacaaaggataagaatcaaatgaaacaactcaatggtgatagatgaattatatgctagaggcaggcaacattaccatgccaaccaggcgctgaagagttatcctttgctgctgagattcaacagcggcaagtgcagcagcagcttcctttcctaacacagccatgcttgctttgtgctctatcattttagattcagactgttgaagcttcgtagtgtgctcagcaagtggagcttctcgtacccgttgcttccttctagcaatttcagcagactgtatgacaaacaagagggttaagatacataatggggaaaagtattctatgaagcatagaagtagcaatagtaagattgcttgcttgcaatatggaacaagttgctaatacatacaaggatctcagcttcatgtctcatccggctataacgttgtgcaagaccacgagcatcttccaggggagcgcctgcagccatagccctcaatggatctatagtctgaagttcaaaataaatggaagtatatttgtaaaatacattgaaggaccaatgcaatactacagatcttaaatttctagagatctttaattgaaggctaagccccagtatgcactgaaaaagaatgacaaaaactgcatcttcaaaataatggtgaattggtgatcgcttgcatgacaactatataaatcacgtgcaccaaaaggtaaagggaaaatgttgtatggtgttttatttccaggcttagatcaatagacctagaaaattgtgtctaagagagaagatagggcaaaaattgggaccaggcggtgagacatcattactgcttggttttaatgcaccgacaagtttccaattattgaataggatgaaccagcataaaaattcggattccacaatcatcagcctaaaggacttccagcatattcaatatgctggactgtaaatgagatctctagtggtcccttccatcagtacacttttaggatatactccaatgtaaagatatgaactggatgagatccatcagtatatacatatctaggcttgagtatgcatgtgcacttctcagcacataaacatttcattgcaaattccagtacattctctctactccagcctaagtgattgagtgctaggctgactgcattatgttggtgatataacaaaaaaaggacagttatttcttgctatggcccaaaaagtcgctaggcgccagatggttggaagagcaagtgcctagtgactaggggcaccaatatgcagtctaggcagctcctagaaccaagttgactagcggcttccaaccaattagcaagcatatgacatacaagaaagatactagaacatcaatataaaaatactagagccctcaaggctgggcagcagcataatgcaccatcaaatgccaaattgaggcagctaccctgtgcctagcaccgacttttagaacactggtagtagcaaggctctttttgtagactagtagctcctcgtacagctaccagagagatacacctatctattgaggcatacaagaataacaaaagaagggttcaaaataccatatatatgtacatactaagaaaaaccaccgattgacaacataaatgcagggtacagagaaataaacattactgtgcacaagccagcaaaatttgtctgtgtgagaacagtactaattaacatccaaaaaagttacctgagaagataaaattctattaaattcttcgtactctttctcaacatttcttagagcacctccatacagagatgctgcttttgcaagggcttcatcactagcactactttcacctccatatctataacaatcctctgaaaattttgttcctgtgaccaaaagaaagaaaaatgtataccggtatcactcgtaagatgttgaatttggggggattcgagcagatcatgcaatgctattctttttgaaaaaggattccttgcatacatttttaaccattgccttgtcttcacaaaaaaggtctcaggctcaagaaattcaaatttttatttgatagtcatattcttttgtcacatattcatcctctgattttgcaagttgagagaacatttctcaattcccaaaagccccttcacaacatttactggcagcccaatcaaaaagtggtaataaatattatcaagttagcaggatccgataatcgatagcgaagtttccattctagtacatttagctaaagatagcaccattcatgatgagcacgtcctactcctattatgatgtcatcacatggtttttgtgggtattgtcattcctcgttttcccattggtgttctggccacgtgaaacatgataaatcatgctctcagacaaagaaggtgaagtttagaagtttggatcaggtgattttacagccagctcatccctcaaattaaacacctcatattctggaaggtagagaggttctatcatctgatcctcattaatattcccaccattcaagcataaaaatgatggaaaagcatgcaaatccaaacatgacataataagctaacagaggatggaaggcatgaaccacatacccacttcaacatgcctgattccaatagaaaccaaaccttcagccgctcgaacaatgtccttttggaaatcctgttagcatatatgcacgcattgagtttaataactgaaaatggaattcttgggaagtatttcacgtaatcatgcaaatattctcttctgtattaatgtcttaaaaacattgtgtaatgaactgaataaatcagacatgtcaaatgaaatacaccagcaatatatcaataacataaatgcaagattaatttgctgccagctgatcatattacataggtatgtattttatgctatctgcaattctccttccttacccttccagaacgagtagaagtgtacaatttctcaagctgttgatgtctctgtaattcaacttcatcaattacaacagcgtctgaatgttcatagcccgtagtactgaactgctttatcacagcctgaaatgtaaacatgtaagcaaagaagacttgaccatgaatatagcacatgaagcactagcagacacttccaagaagaaaatatttagtcatttacagagagcggcatggttttataagtgacaactaagccaaattaaagcttcccatggatataattgcactatgacaattgtatcaaattgtcaattgggcgaccgagcctaataaaggaaggttaacgtacgtgatgtcttccatttgtaagaattgcgaacatacccgaccgacagactgagtaacttggataaaaactaaaattacacataatgttaatgtttacaagcatatgttgcccttcattacaaaattactcctgtattaagagtaaattccacaaaa

SEQ ID NO: 22315 - DNA, 3283 bp, Oryza sativa
accaccacccagagaacagatcaggcgatacaagaatagtaattcacagcttaaatctgatatcccagggacaaaaaattcctgcaacagcgagccatctcgtcgccatttctatttggttttctcatggcgcagaaccctccgactaagtccaaaacggaaacggagaaatcgcacccgctacaaaattaaccattccttccccctaacaaacactgagactgaagggccccagatctgggatccgaacctgctgctgcttggcgacctgctccttgaacttgctcgcctgcttcctcagcacatccatccctctccctccccttccctcactgaagcggacgtcgtgctgcgaccgagacgaggaagaagcgaagcgggggttgggggaagagcgcgaaggtagtagggctaaccctaatcctcgctagttagaaacggaggaggaggaggaactggaagcgcgagggggcggcgaggaaggaagaggttggccgtgtggcggccggcgacgcggcgggcgctcggcgaacggaggaggcggggcggcggagcgagagcagagacagacagaaagcgagcgcgagagccgagagagggagcgaccccgatgcgagagagaggagcagttgggccggagtcagcccggatgggtggatgggatggccaccaaccaaacaatttttcttttttctttttggtagaactagaaagaaaacaaattttaatactccctccattccaggttttaacacgttttgattttagtgaaagtcaaactactctaagtttaactaattttatagaaaaagtagtactcatatttttaacccaagactaatatattatgaaaatttattcaattatagatttaatgaaactatgatggtattataaatattactatttttttcctcaaacttagagtagtttgactttgaataaagttaaaacgtcttataacctgaaacggagggagtagtactaaaccatttacagatatactagtagtacaaagttattgaaaataaagaaaatatttacaaaatttatttgaaaaggtgctactagtactttaattttgaagtaaattgcatcagcggtacacgagcttgttaggtgagtgtaatctagtgtatgaacttataaaatactcgttttggtacataaagttatcttgcacgtgcaaactaaggtcaaaaggacattacataactaattttgttgatttatgtgctaattaggatactacgtaaacatatactccctccatttcgcaatgcaagtcattctagcattttccacattcatattgatgttaatgaatttaaacagatataaatgctagaatgacttacactgtgaaatggatgaagtgtatgagaaggttgctacttagacatacacatgttcaataaaaagatagaatgagatatagtgatgtagagaaagatataaaaaaaccgagcaatgatacaaggattagaaacaaacgaaattcaaaataaagtagagaacaaatttataaatatttatactcactatatgtatccacgccacatcttaatcaacatcagctatgtaaaattaaccttgccaagctattttagacctagttcgcacggatcagataagtttgtgtatcaaaacgagcattttgcaagttcatgtactaaattgcacctacctaataagtttgtgtaccaccaatacaatttactcttaattttttttatcccaatgtgaaatttaaatttttaaaaataatttttttatcgcagtttgaaatttaaatttttagaatacacttctctaggctttcgaaaactgcaactattttatttttaaaatccggatttttcaaccacacgataaaacgtgtgttatcttatatatatttattaatatgtatattttatcttaaagcatatgtaaatgagtaaatctaactctcacattgtaggatcgaacgtaaaatatcaaggcagccttggtagaaacaccaaaaactaaattcttttttccaaaattaaaaaaaccctcaaacttgatggagatgtgttggtcaaacagatcaaagccggtcaaaccgcaatgaagtcgtcacgaaaatgctcacccccggacgaccaacggggtggagaaaaatcggacactgtctgccactgcagcatgccagtatgcaaagaatcttttcttttcttatttcttcaaaagatttttttatcgtaaactatttatctaatctacgatctaattgcaccactaaattcgttacaattaaatctttataacaagaccacacatgattatatttcgacaaaaaaatattttaattttttattgatttttttaatgttgcatgtggtctcttttgatgtttcaactaatagttttataatgtttcagctaatgtactcatgatgtttcactgtgtatggatcaaatgttgcagtggaacgcgccgttgcaataaatcacccacatattttggaaaccctatattaagggaatgtggtttattttttgttccacaaaaaatgtttcacctagtgcactaacaatgttccactatttatagatctaatgttgcagtgaactgaaatatttcattgcaataaaaaacccacatattttggaaattaagggaattcatttcattttttgtttcaccaaaaaatgttccacttagtgtacttataatgtttcactgtgtatagatctaatattgcagtgaactaaaacatttttccgctatttgctgaaacattgtttttatataaggtgaaacaacaccagatttaaacgagtgaaacattttcgatctacttagtgaaacaattccgatatacctggtggaacatcgtgcaacatttaaaaataattcaataataagcactaggcggtttcctattgctcgatccagtgacggtagtgcggaggaggagggaggaaggggtggtagaggctacgttttgggtcgccacctaaatctcttgcgcggggtgcacaaggttctagagatcctataatccaccactcaacctaatttacaaatttcaactcaaaagtgaagttttaatatgctcaactttttttttgctctttgcaaacctttatgtgttctcttaagaaacactttcaaattgctttgatatatttccgaacgaaactcaaacaaaattaaaactcgcactactagaaaaataatttatcaaccaaaaaaatcggggcatcaatgcttaaattgtggcaatagatacatgttgccccaatcttaaaa

SEQ ID NO: 22316 - DNA, 2044 bp, Oryza sativa
tgccataaaatgatgtggcaaaaaatatatattgcacacttcacatcgttgcaataaataactatagccaccactccatgtgtggcattagttctacgtaccaaattaaatgtttcaatattaatttatcattctacctattttcttttgatatcttgtcatggctaggatttaaacccaagatctctctccctcacgcgcgctctccatgaccaactcacctacgcatcaattttgtttaaaaatgcatataattctatttgagacttcctaactgagatttgaatcatgaatttgagtatttaaaagatttcgaatgaaaaatttaagttgtagatctcatcgagagctataaatttcatataaaattcgtcctaatctgtatccatatgaaaagaataagttaaattatgatatgctaatttttttattgcaacgaatttgttgatcatggcaatagaaaatagtgaaaagtaccctgtactatgtaaattgccacaaaaattaaatttgtggcaatagaacatgttttttttgcaatagtaatgttttttgtggtgatagctcatttcctattacaacaaaaatactgaataaaacatgatcgtaaatcgttgcaataaagtatagttatttgccatagaaaaattatcattgtgatagtacaatatattgccacgaattattcggatcatgatttggataagtatcttaagagaaaaaccagtttaaaaatagttttgcacataaatcgggcgctgacgtcagcgtctgatttttccctaaagcatcggacgtccgacgcgtagccctctccaagtcgttagtctcttcgccagcttgctgttgttgtcactgccttcggtctgcctgctcctatggtgtacgctagaccgttgggatgtaaagaaaaccacatttattgcatcaaattgtgtttgcaaagtgcatctaaagcacttctctctcaactcatgaattagaattgaaaccccgatatgaccggagaggtatcgatcttcgctagactaaggtgccttttctacgttgaaattgtcttcattagatgaaggggacctcaatatttgatggtgctgttatgattgaaagattcttctctaggtctttgatgatcaaacatgtctttaatggtcaggggttgggaacacatctccaacatccggcaaccaaattttctctaccagaaagtcgatgtattctagtcttaaaccctcatctatttataccacaatgtggcttcctctaaccatgaatccaactagaactattctagtcttaaaccctcatctatttataccacaatgtggcttcctctaaccatgaatccaactagaactagtacttctaatcaccagcaaacctactaaaccagggaagcagtatccccatacaactccacactccaatcttttcaaacttggactccaatccaaatttaattactctctccatacacacataacactatatgtatgccatatgaaaaacttcacctccacactcattgttctctagcttgagcatctagcgtgatattctcgatcgtctagacctcaacttctaccaagtgtagccttaatccatcaccgggtatactctcatagtctcaagcaacacctacacatggaaaaaaacttcatatgtgagtacaatctcgcaccaacttgacttacatcagcacacaataatatcacatatgaatataaaccatctataagtcacaaacatgaagaaaatctataaatttcacgaaatcaacccaaaatcgactccaaccttatctgactgtcggcaacacggtcagaccatccaatcaccactgacctgatcggcctcctagagctgattgaactattcaccgtccgaaaactcgacacaccatattttccaaaacactcaccttttgataatttgttcagcacatagattaaatcaacgccttaatttcacacgcatgacacataaaagtcagtacttcttatttttcttttatctgggtaccgagctcgaattcgccctatag

SEQ ID NO: 22317 - DNA, 16825 bp, Oryza sativa
ctatataacaattaggctagaaaaagaaaaaaaacgtaagtaatccctacgtacatacgacttggaaaaataaataaaacttaaccgctatccatcgaaagttgggaacaaagaaaaatctactcacggtggtctttttaaatagtattttcgaaatcctttactataaaaacaaaaaaacaaaaaaaagcgtatcattcgaaaaagatcgatggtcttttgaaatagtattatctactatttaaagataaatatattactctacaaatttacgtaaatatacgtagttaaactaaatctatattataaatatgaaatgttcgatcttaacatacaaggctgatatatatatatatataattaatgttttgataatttcttatttcacatcatattttagggtgtcaaatatcactcgacaaatatacaatactaatttaaatttacatttgtgaaaatgaaaacaacacaatttagttgtttcattttacaccgttagattaattgtttctcctatatacatatatatgagaaatatataactgttgaccggaaaaagtactccgtacttatatatggttgaaaaaaataataatgcttatattgtttgccggaataacataaaacgtatttatgataaaggccaaaaaatgggcagtccttaaaaaaaatttctacaatttaaagataaaaatataataatcttcaaatttacacaaatgtaaatataaaatattcaatcaatgcttttaagtattctatcttttaaattattttaaaattatatatccaatttgtgatccggttgtattcctttaaataaataaactactaatatctatagccataaatacatcacaaatatggagccggcatgtaataattaatgttatgataataatttcacatcatattttaagtgtgaataacacttgacaaatatacaacactaacttaaatgtacatatgtattctccaaattactaaaggtgtctcatgtgattagaaacaatagatgtggaaaacaaaccagacaccgaacgaacatgcactacagtatacatatttgtcaaaatatgatacggtactttggagattatcgtggtaatatttagaaaatcactgtcttggttacgtataaattcttctattgttttgggataaaatttacctccttcgatttatgtgacaggggaatataagtaatataagtctatctttgatcagatgaagaagtatcattagttatatttttaatagaaaatatatttcattaatatataataaaattaaaatgttacctaaagtcatctatagcatacaaaacaaaaaatgttatataaagtttggaaactccaaattttttttaaaaaaatcacacacaatataaatagatatgaactaactctattattgggacatattttttctaataaatttgaggatatacaggttcaagtaatatgcccaacagttattaatgaacatacgtttaaagtagagtaaaacaatatttcaaaaatatcatccacacataaacattcataataataaaatttcaaataagattaaacaacatgctcgcgcgtatgcgcaggctaccttctttcgtttaatagccaaacttaagtataatcaccatactataacaacaaggggtgagattacctccacaaccctatacatatattgaaaatactaattcaataaatattatattaaattaagcaagtactgaaaaacacaacttaacatatacatatctggatatattagtagtgagaaaactaaagcatatacacaatttacttgtattactatatactacttcttaaaaaaaagtcgtcaccaccaccaccaccaccactgacatgttaaccataataatatcaatataactcgtgagtactacgttgctttatcctgcaatggtgtggagtactctctccatcccaaaatataagcaatttttggtagatatgatacttcttaggagtctgtccagattcatagtcctaggagtgtcatatcccctcaaaatcccttatattttagggttaattggatccatgccatcgtaaatatgccttattgaaaatatgccactactcttcacattattagctgggtgccattgaaaatttataaaattggaaccatgccactcctgtcactttttttgtcctcctatctcacgtcgccatcctccccgtcaagtcgccatcctcatcatcacctttccacaccaaagtcggagctcctatccccgccattggagtcggagctcccgtcgctggagcagagaggtgcagggccgcggggcgacgaccttaggcacgccggcgtcaacatcggtgaagggaggaggggagagacatcaactccaccgcgccgccggccatcgactgtcgatttccccttgtagccgccggccaaccgccggatccgcgtcaccagagaagagctcgaggttgtccaccaccagatccacgccgtcgtggtgggtggtgttgatggtggtggtgggcctggtggcggcggtggcagagtgtgggtgctggcagggcaagatggcagtgatcgcggcggagaacgagagcagacgccggtggatgagacgaggagagctctgtgtccacagcctccagcagcgtcatgcggctcggcctcctccctggcatggaagaaagaagcggaggggaggttgtcgctgcgcctgggcagcagctcctcatctctcccgtcaccgccaccgcgccccatgctccaacctgttgtcgcttgagcctgtcgatgctgaacgggcaagcggcgggacagatgaacgacagtgggacctcagcggctcggtggtggcttctctctcaccagatctggacagagatcctagcccgtcatcgtcgcgctcatcgacgagctcgagcagatgcgcggcccgctcactgccgccctcaccgaggagctatcctcctatcccgttccttcaccatccgccgtgccctcctcctccggctccctcttcgacagtccacgatcaccgcgtggagtcgtcgccgtccacgaccaccagctagccttcccggagcttgctggccagcttctggcgtaggcgtgctgcttgcagtggcatctacccgaagtagatgaaggcaccattgatagaaaatatgacggagacgacagaaatcatgatggagtggcattgttctaattttagaagatcgcagtggcatctatccgatttcatgaatagtagtgacatttttttcaatatggtatatttacgatggtatggatccaattaacccattttaggacggagggagtaggtgtgtattaatagtgtttaactgctcttgctgcaagatagtcctttatttttccattaatttgcttcttgccatcatgattaaaaaaactcacaaactatttagtttcttttagtttaaaatgagatagacaacataatttagtaacaagtacatactttataatcatataacatctgaaaaaaaaatctagcaatgccttttttttttgccttttaagatcaagtcttgtttttaccaagttgaagctaatatttttttttcaacgaggatgcacgagatatgttttctattttgaataatccgttacaacatataaatatttggctagtacattatacgataagaaagatacttaaattgtgttctttccttccctttcccaacttctaccactcgtttttcgcacatatgcttcccaaaccgatgattttttttacaaaatttttctatagaaaagttgttttaaaaatcatattaatctattttataagttttttaagctaatacttaattaatcatatgctaatgtaatcctccatgttacataccgaaggattagttactaacctaccataccgaacacaacgttaggctgagtttgttctgacggtcactcaacacatgactaattaagtatattaaaatttttaaaaataaatcaatataattttccaagtaatttttctataattattttcacaaataatatatcgtttagcagttaaaaacctgtgtgtgaaaaaaagaataattaaaagttgagagaggggagaaacgaacacaatgtgtgtttagttcgtgccaaaattagaagtttggttgaaactggaacgatgtgatagaaaagttgaaaatttgtgtatgtatgaaaattttgatgtgatgaaaaagttgaaagtttgaagaaaaattttagaaataaactcggccttacatttggggccataaaattgcatgtttatccatcctccacaactcttctctctctcaccgatctgattgtgctgtgcgcttgttcagctgtgctgctcggtttttgctcgctatgtgcacgaaaaaaaatcccaaaaattatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacagacagcgcacgcatccaccaccccccaacacgggagcggagagctcgccgccggcgatcgccgcaggattctgagggcttcttccggcggccacgggagatggttctgctcgaacgcacgccgttggtggtgcccgaggcagcagcagcagccgccgccgcctccagcccgctccggaggccgtcgcctagggttctgaggaaggtgcccccgccccccctcgatcccatcctcccctacctcaggtaatggctagatcagtatccatatcagcacctgttcccttcgatttaggtcctatttgggggcgtgggattccgccgtagcgctgcgtggaataatgcttggtttcgcctcaagttgtgtggcgtacgcatcgtactgggattctgtcccttcctctgagttatgtagttaattgggcgtgtgatttagattttgacacttcgcctctgcgattcctgttcaattgctcagtggcagtgtgcagttgaacttggacgaacggaaatgtgagaaatgggggcgtgtgtgttccgaaaaaaaaaaaagaaaagcaaagggtatgaccaccactgtttgagtgtctggcaacgacagaagtgcattttgccgagacattgtgactggtcactcgtaatgtccagtgttgggacttgggaaggatttagttttggagctgatttgttttgtgcagctaggttgatttttcttgtgaaggattagcttgttcatgtggagacggttctcttattcctttatcagttcttgaactgtcaagtaatgtaatgtgcccactttctgtgctccttctgtactaatgtgctgctttctgataggtccttttggtaaaaactttgcatatataacttatttttatgttcctggtactattatatctattttataaggtaaatctaatctttcatgcacatgctggtattcatgcataatttatctatgtatcactgcggtttgtttgtcctggtcagggccccagtcctggtgtatgcattcgtttatgttagtttctgacttggtattcaggtctatcaacaaggctatggatgagctcaggacaggcccaaaatttgaagcagcagcgcttgatcggctcaagatttgtgtaatggaatgcattgataagtatggtgacgattaccagtactccacagacccccgactcctcaagatctggatcctctatgtaattgtttggctttgaagtttcaattcttaccttatccattttctatccttttgctcatttcccccccactttgttctatgttaggcggatgcaataggtgattttgataaggcatataagcagttggaggagaaaagaatgtttttagagcatgcactgctctatgatgcatatgcactgtttctcttcagtaaggggaaagtgctggaggctggtaaggtgtatgaagttggtatttccaggttagtatgacactgaattatgtttttgttgaagtgaactttttgggcagcaacaatctgatgtcaaatttgtcatgttgatgtgatcgcaaatcatttccgtggaccagaaaagccgagccacttgatcatttgaagaagatgcatacgatatttttaaaacacttggagaagattgtagaagaagcagatgccgatgcccaggtatgataactgtgtggtggaatggacattagttgagtccttgaatatttgtcaaatgattcacatatttcatattcaattgcatttttagtaatcaggacattgtggctgtgttgtagatttgttagtattttagctatggtcagttggtcacaaggctgacaaacttgcagcagtaagaactaagaactgctttgatattgtttcttacatgatatttctctgtggtggaacatttgtttttccaaaaaaggttggcaagcaataggataattgtcttcacatttctgtgcatgtgaactgtgatacattctacataatttattcatttatttgcatgtttgcatgttgtgaacttaatatttatttggggctaatcacaatgatatctactttgtacttgccgatctttactagctcgaacatctataacatctatttcaactaaatacatgacggtttattttacattttcatggaaagagtttctgttctgtcattcctgcaactctatttatacaaaaatagcatgattctagttatttagagtggctttttttattatatgtttagggatatattttatttagtttaatcatagttgggaatgaatttcaggttgtactttccactgattcttgtggtgtatgtgttctattatgagtttgtctcggaaatatattatttatgctatgtggtacattgatagaatcgggagtgcatttgcacagctttaccatagtgaagtcagaacataaatatagggcactatcagcataacagtgccataccaaacaatcttcttatacggttcaattcataaataaatagagaaaatcgagcaaattgcaaaagcaaagaataaaatgaaatatcgggctgaagccacatgatgtgccattgaaagctacatccctgcccctgcttgagtggactaatcattactagataaagaaacatgagacatgcaatttctatatgttttcgaagaacaatatctatataaccctgttaagcttgtgaagtaacttatgcaaaaacctttttttgtttcttttacttgtcattactggccattattgtagccagcatatattatagtcgcctaatgctattcttctttgtggatgattcaccatactaactccatttttttttgttactgtctgctagccgaaaccatcgaaaatacaaaagaaagaacctattttgctggatccatggtctgagtctactatgaataatttattggagaacattaatgttgatctgaagaagttcgctgtaagttgcatttactctatatgattcgctagtgtttatcttagctctcatcttggacggttgcccgaatccttgacagggctatcataagagcaataaggtctatcatggaaaggtgccattaacttcgcctcagaatgttttaagaaacaaagtcattgaattaggtataaactataatttcttgcttgtcagtcttttaccaaaactataatcatttttgtagtttggctcctttatgatccatgctctgtaagtcacaatgaatacataataatgctccttgaaaaaaaggaagaaatatacccttttttatttagaaaaaggccatttatattgatgacataacaaaagtttagttacaaatcccttttgttgcaccaaggtggtagaaagtaccagatcaaaggttctcctggtactggtgcttttgcaaaagtttacaaagccagtgtcgatggtaatacagaagacctggttgctttaaaggtgagtcatacttccatttgtcttactgaagcctgcttttttcatcagattcctctactgaacttgcccgtttgcagattcagaaaccaccatttccttgggaattttacatgtatcgccagcttgatacgcgcgtatctgatattgaggtacagaaattatctttaagaagaccataacatttgtaattgtaaaattatgattcacactgcaaaataattttacttccagagaccaagctttggctacactcatgaagtgcatgtatacgctgatgtcagtgtgcttgtttgtgattacctgccatacggaactcttctggtaaaatactttatgtattaatttttttttttgagatcatgatcatgcaaaactagcattttgtgcccggattagtgaatctgtgtttgataagatgcaaatcttttgcaggatgttataaattctcatctagtacttgaacgccatatggatgaagttctatgcatatattacactatagagatgctgcgcatgttggaaacactgcacagcgttggcataattcatggtgatttcaagcctgacaatatgcttgtttgctacccaaggtaagtagaggtaaccagcttagctttcaagttagaacacttgatggagcttcctccctcttcctcttgtgatctctaactgaaatatgggcaaaacacacacacacacacacacactctctctctctctctctcacacagacacacacaaaactatccagtgaccattgacatcttacttttcataaaatcgacagatttattctagttgcaatatttgtgtgccgtccatttgcccagtgcccatattctcttgctatttgttttggacagatcttgttaccatgtttgtgggtgatgatgtctgtgctgtaaatattttactccaagcttcacaaccatctacaacttttataaactagatgttatatttaaactgatctaataacatagttttcaatgaaaatatttgacatggatggtcataacaacaagcatgttggtaagtggtcaatttgttggccccagatgttgggtttggtgggggcaaagatccttgctgatttactactgtttcaattactttatatgagcggttactggaatcttgcttgatggctccatcctccatgtttccgctgagatgacgattttttttgtcatttttgttggccatttgctgctattggcttgtttcggccaaaactcaattataacccatctagtacatgttacgcctgaaaaaaaaagaaagagtaaacctaatgctagtgtctgttcctttttgttctcgctatccaagtcttcacctcttcaatctttagcccttgtctcgacatgtaattttcgttcacccgcatctttgttttgcgtgtggtggtctgtgcagtggagaaatcacagacgaaaccttcaaaggcgagacaagatccgagcggaatcaggtcagcttctcaatcccaagttcccaacacgccgagaaacttggttaagatgttctggatatctcctgatgcttataggattcccattccaggggctctgccttgttgactggggccgtggcatcgacctgaacctcttcccatccggtgcggagttctacggcgactgccgaacctccgggttcagctgcgtcgagatgcaggaacagagagcctggacgtttcaggtatctgtaccctcccaagctacttactcaaaacctcctctcacctagacatctctgaaagcaacccctgcctgacgctgccagtttgtttgttggttggttgattggtttcttcctgcaggctgacacttacggcctctgcgtcatcgcgcacatgatgctacatgggacgcagatgagcatccagaagacgcccaggcccgatggaagctacatgtaccagcccacatcgccgttcaaaaggtgctttgatgccattgcctatacacctctttgataatttcctctatcccaaaatatagctactatgagatatttttcagtactatgaatctgaacaggtttagaaaatatctcatcctatgctagttagttatattttaagataaaggtagtagtaattaccatgattcgcagtagcgtaaataaatcagagattagattagatggcatatgtaacaggagctgtttgctgccattttgccccttgacaggtactggaacgtggagctgtggaaaaacctcttctccacgctgctcaacgcgacctccaacggcagcgacgcggccgtgctccggagcctccggatgtccttccaggagtacctgtgcagcaaccggcagctcgtcggcaagctgaaccagcaactggccaagcagaagacctccctgtgcctatcctgaccgagacatatacgcatctcgcgtttcatcctcatcatttttcccgattccctcgtgttgcctgtgtgtaaagtggtggagtataagataccttccgtaacttcgtagcacttcctctgtgcgtgcgtgtgcagcagtaattaacgtgccacatctccactttgaaagctgaaacatctactattgggccagatggaaatttcgtacagtatcttcttctccaactagcggctactaggtaccatgcgtctgtcacgtctagaggagttttttctttctttcttttctttttttctttttttgccatggtggtcgagatcgagtgagatttgtgggcagtgggcgacgagcgagaccaaacggaaacggacgaagcaacgagcgtacggctcgtgaagtcaaagggcgcgatcagataagatgaggcggtgatggtgtgtagtaggccacaggggctgggcccaattccagccgtccccggcccaggctgacggtcgctgctggcagttctgtttcgtgtggtcgcggaggccgggccttcgtcggtcggggtatcgtggacgtgatcccgtcgtcggaggacgtaaggtggggagcgtcatgcgccgcaactagctattcttacgacgtgttctaaaccacactagtggaagtacaaattattcgtgtcacgtttttatatttacgatttccctaaaatcttctgggagtagctatatttatatttatggtgtcatatttttcatcaataaatagtcaacatgtatttacattgtaagtatctaaattacatatgtaatttcagtgtatatgtaacgtaagtcataaaattacatatgtaaatccgaaaattacatatgtaagttttaaaattacatatgtaattatagtgtaaatagtatgtaactatgatgtaaccaacgtgtcatcatccatacaggaaaaatccgatgctaataaaaaaaggcaaaggattaataacgataaaaaggaaagctgcatccctcaagcctttatccaccgtacatcaaaccatcaacggccagagatccgactgttttcagacaagaaaaacatgcgacacataactttttacctcggtattgcttaaaaatatactatttcctaattaagctatttgctagctttataatggttaacttgtcgatatgagcaatttccgtttggttataatctatctattcatgtcatccagttataacgctcaggttgggtgaatattgttgtgctggacggtttcttccaaaacaaaacgtactctgctaacaaaaagtggctatagaagaacgtagatggttcgcgtattgcaaccatgcatctactagtaacaagtacacaccattgtatttagtaacagatctctgtcctaagttaatttattccgggacactgattgtactacggaattacttgtaagtaccagctaccaggtgtagggtgtgttttcacgctaaaattgaaaatttgattgaaattgaaacgctgtgacgaaaaagttagaagtttatgtgtgtagaaaagtttcgatatattgaaaaaattaaaagtttaaagaaaaaaaatttgatactaaaccaagccgtagtacagatggctcggtttgacttgccggccggccaggccggttgaaggatcactggtatatatgcggcggtcgtgcacgggcgcgtgtggtgcggttcaaggagtggccgtcatcgtggctactactttccgtcaaaaaatcgtggctactactatagccgaagaatgataaggatgtttgctgtgtgtttgacgccccgttaatccaacaccgtttttgcatataattgcattgcacccatggaccatggtcgcgcgcttgtggcagtcgaaattttctgcgtctgtgactgacgatgagaggtactcctgtagctagctagaagcgtcggaaggggtgaaattaaagatcgatttctggtgttgtacgtacgtggtcgctagatctggttggtgcctcttgcttttctgggctcccctggaaaactgttactgctaattttagccccatttatcgatcggcccgagttccataccatgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccggccgcgcgcgcccggaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcaactgggtggttgtgattggattggatggtccctgcagctggagctggggtttgtgcggggttgggtcgctggagatagctgggttcgctgctgttgtcgccacgcttgctggctactagaaggagtacgtactaggcgtggtcaccgtgggcgtattgtgcagcgagtagtagggttgtagggcatgcacgctttggacagtacgggtgtacgggtctgtaacacgcgcgcgcgtggtaataattaacagggaggaaccaaatagctatagatcgtaggggggaaatgagttacttgtcgtgataagagcgcaaaaaaaaaaaaacacgtacgactacgtacgccggtatgtaatttcaccttacgtatttttggctagatgatttggaccatcgaccaatcgatcgccgctaatatcaaacctcaagtataagagcacacgatcgattgaccacctccaattaatctccatgccaaagtagcaaaatatcacatcactcatcttcgaagattgtcctccttaaaaccaacaaatctaataagaaataatagaatgtgacatcctataatatctcagatctcatagtaggtatatttactttaggatgaaggtagtagccgtaaacggcgtgtgtccttgcgatgcttggttaataaaggaaaggaaattgataaagaattatgaatgatcaatggcactatttaattctcaggatcaaattaaccgaaattgtttattactctcaccgtcctaaaatatagcaacttttagcctttaaaatctatcccaaaattatatctacttctccaccgacattttttttcaaacaaatcacaaccttccaacattcaatttccctaccaaccttcacttctcatccaatcacaaccttcatcacatctaattctacctatttctcaatggttgtgtccaatctaaaaattcttatattctagatgaatagagtagcatattttagcgcggatcaactaggtggttgatcatctgtctgctagttagccaaaatggccgaaagtcatctgcgcgtacgtgggctgaccatggtttgcattaccatcggtaaccacacggttaccggccttaccgcagggtacggtaatagaaaaaccacaataactttcttaaatttaaataaatttaaaaataatttaaatttttgacaaattttacacggtttcgtacgatttttcacggttaccacagttatagcgtgttaactgtgcttaccgtctgataactgtgcttaccgtcgagacgcagtaaccctggccggctagccccggcggtttaggaaaccatgtgaccgaccgggcgagtcgtgccggtgggatcgtcgactacacggccgcgcacgggcatgcagcgcacggcagcgcaggcaatttttgatcgatccctcccgcgcgcggttcgactgttggagatgagatgagtgcgtacgtacgtgcagtgcgcagtacgtacgtggtcgcgcgcgcgcgccatgtcaggctggtggtggttaacgcgcgcgcgcgggccggcatgcggcatgccccagtagcgatatagatctcgatgccgagaccgacctgcacagttgcctaggtttgcatgcagagtgcaggctgcacagtgctgtgcacatgcagctagctagctctagctacgggcgcgctcgctgatcagttggccgatcgaattagcgtttcgcgccgtcggccaacgattcagtttcgaaactcgcacttgtggagaaatcgtttttatacggttcgtaacccctatagtcccgatttgaaaatcgagactatgaatccgggactaaagatccatattttagtcccggttcaaatactcgggaataaagatgggagcgggcaatagttttttttttcatttacttactatttaatctctaatttattttctcccaaattaggtgggatgcatattccttaatcaaacccaaatacacaaatcaatcaatcatatacactacagattatacattccaaatcaaaccccaaatcaaagaaacatcccaaatacacaaatcatgtacatctcagatccatacaatgagattccaaaaaagaaattatacatctcaatccatacaatgaaccacagattcttcatctcaatctatacatggatcacaaattctttgaaaaaaaaagaaaaaaaacgaagcaaagccgtcggctggctgagccggctgctgcctcccctcctccccggccgccgccgcgccggcccccgcctcgcgtccctccgccggccgggccgcccaccccctcctgctgctcacacgggatcgagttgggaagggataagaaggaaaagagataaggaggaagggaaaggataaggattagagatggagggagagaggagttggtgtggatgagaaaagagtggatgagaaaagaggataagtaatatggattatatagtgcgttttgatctttaattccggtttgtaacaccaaccgggactaaagagatccgatctttacttcctgttcgtaactctaaccgggactaaagatcctggaggggcctgacaacacctgacagcatgtgaaccgggactaaagatcatgtagtctcgttctacttataaaccgggactaaaaaccatctttagtcccggtttttactgcatccgagactattgtggtttttagtcgaccggccaaagatggtttctttactagtgtcgatccaatatatccacgtgtacgtctcggtgggttattctttgcagtgttacgtactctctccgtcgaagttttagtgttgaacacggttattaagaaagcaggtagaagtgagtggtgaagggttgtcattggatgagtagtagaggtaggtgggaaaaatgaatggtggaggattgtgattggttgggaagagaatgttggtgaagttattatattttgggataaattctgaggaataaaatttgttatattttgggaccatagggatttttttttgaactgataactcgggaattaatcaatctgctagctagcatgcactatatgcttgtagcagcaacagactcgttctaattaaatacgtgaaaaataatcgaagtcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaaccgttcgtcttattcaaaaacttctgtgagatatgtaaaattatatgcctacataaaaatatatttaacaataaatcaaatgataggaaaataattaataattacttaaattttttgaataagacgaacggtcaaacatgtgataaaaagtcaacggcgtcaaacattttgaaacggagggagtattatgccaactttggagatgattgattattctcta

SEQ ID NO: 22318 - DNA, 8066 bp, Oryza sativa
attcaaacatattgactgcacttatttagactagaggagtacataaaaaaaatatatgtatgcatcctaaacgtagagaccgaggatataattcatctttccttatataaaaaggtcagaaccgatgacactagctagctaaacaacatagtacaaatttggctagaggttttcctggtctcacttggatgtacatcatggtatggattcttagtacactagctcgtagtactatactactactattcttatatgtgataactccagcccatacagagaggaacatggatgcatgcttgctagctaggtatacatatggtcccagcaatcaaatattggaagtacgtatactagcttatcaacaagcactaagtaataataatactagtatagttgagaattttgacctgatacattcgcatgcttacccaaaaaaaattgtatatatccagctaacacgaccaatgcaagtcattattcacgagtcttaaatatatctccatgagtatgacttgtgagacgacaactaaaagacaaggccaagctttcttaatttgaaagctcacctaattaattaactaccaccgatcgatgtatccccagccttcttaattagtgcatcaaatgtggctatgtaggcgatgaagggtcgacaaataacgtaacacccaattaatgcaactttcacacacatgaatgtgtgtaggtatgcatgtgtgggctacttaactactccatttcaactctacgtatggtactccctccgtttcatattataaggctttctagcattaatatctagatttattaacaactatataaatgtggctaatgctagaaagtctaataatgtgaaacggaggaagtatatagtactagtagtacctactactatcacatatgaatacattgtgtataaaacatctcaattcatttagacacacatgcaagctaaaccctctagctgcttcaattccttcatcatcaataaagttcaggaataacacagcaatgatacaaagtgcaaagagacaagaacagaatgcttaaaccaaacacccacacagcccaatgcatgctgaagccggccggccatgtaaccctacccatgattgctagacaaggcatccttctccaagaagcaaagccacagacagcagtcaaaatcaaaaatcccagaggcctttaagaaaagtctggttaattaggtttactacctctctctatccatccatctctatctctcttgtctctcccaatagctggagttactagaagaatagatgatcatatatattctacttgcaacagtaaccacttcaactacgacaacaagatcactcttttcaaaaaaaaaacaagatcaagacacatgcatatgcttccctgaaatttcttaactgaatttgcccatcctgtttacagatctggtgcccactgatagatgatcatgtagctggcccattaatatttcatttcaattcaattctggtctatattattttctactctctatggcatctttgtttcatcatcaggtcatggagttggcaaattggcataccccatgtgatggatgcaaccatccaattatatatgcggcatatgcatagctagctagcttagggatgcgtgtgagattcttggcaggagccaatcctttgtttgggccatccatttttgcttgcaagatgaggatgacgcatcactcgcctataaataaattaagcccctgtcaagtagatttgcctgctgtcctctaattagtgtacttttaataataaacatagcattatgtattgttgtgcgattatattctctttccacaatattctaagttcttctaaagtttaaaacaaactaaattattgttaacacgacacctaacactgtcctggaatatgtctgcagtaaaccttgactgaccaccgactgaaatgacaatattcatatatttatgtcacaatttaattactaattaataaaaacagtgtgttacgaagaactttcatggccggccatgcatgtcccatgcccgtcctgtatatttctatgaaactgaagaccacctaattaaacaacacatacagactagataaatggatcagatcgatttcaacttgctcttttattcggatagaatcgtcagcattactgacatgttttccttttaaaaaaaaaggaattagatttcatggttatttattacatttatattaggttagatagattcaattaaacacatatagattgagaataagtgctgcagctagcaatcatgcttggaattttacacatactctctctttctataaaagttacacctattacttttgtcactaagatcaaggagtgtatgcacgcatacaaccaataagtaataatatgacttctggggtctgatcaaatatttaatttacctctccatttaagtcttggatgcataaagactacaaatatgattaacttatttgaaaataaaataaaatataaaatatgtctaactcttgtggatggagggagtacaagctagtgcgcccagcattttctgctgaagaacatcaataaattctaagcatttattttacacaacatttcaaaaccagcagtctcaggtggatggccccaaactgattgtgatttccaataaacattccactagaaaaacaaaaggaacagacagacattcccctccgatcaaacaagaagaaaacaagcaacaagtgaccgacattcccctgggattccgtgccggtttaattccacaaataatatataacaaaactatacatatccgtgcatgcaatttgcacccaagaacagcctaaacaatgcaatccgcgtaatacaattcccacataaactattagcacgcgtaggtgcccctcatgtgattgtgcgtacatgttcttcgatctcttcctacctaatcttttgcagtattttggctgtcgattagtacccgttggtttgtttattgcttcacacagcgcatgcacactgccccagcactgatctaatccctgccatgacagggcaagagagataattaatcatttgcatcgatttggattggaacgttaggggtgagatatgatagagggagggattaaacaaatgtgcttagtttgatgatggaatgtttttgcaggatttgtgtgtgtatggtggttgcgaggaagatccacctgttcttcacctacattcgattcttttactctccatccgctctgcagctagcgttgtggccgccatggagaccgagatagagagagaaattaagtcccatgcattgtttactccgatgtgttaggccgggctgcactgacattccatgggtcccatagagacagccagctgctctatctcaccttctcccttcacaatctctccctcttttcaccctcttcgatcatgcgtttggtcaaactaatcggttgtatatatgcactcttgatataatgcagaggtcggatgcattatactctttcattgttaactaaaagaaatacgctattaagtgctgtcccttttacatgcctaaaaaaaactacatttgactcttataagggtgtatattggcttggtctaaactctagaattagagacgtattcgcctctgccaagtgtattgatgtggacagtttcatctccttttgggctatagtttcacaatttgtgtataatttttgtctcggtttagtggtcacatcgccaattgtgaaacacgatggatggtggaatgacaaagacagttggagcatgccatgtcgtttgttgctccacacagatgaggctgcattgtgtggtttgcaacagagaggaggttaaagaacacacatcgtcctttgagtttagagtgacatggaacacgtacaaattatgctttagccacctctacgaccatgcatgtcttttatgaagtgatcagtggcagagccagcgacaccgtcgagcccgggtgggtaattaatggtgtttctccatgatctaccaatttttttatacgtcgatcgtaatccgtagtgaagatggcagtgacggagcatgggcggtcgcccaacctgttcaggagatgtccccgccgctagaagcaattgaaacgaaccagagctttgagatatttaaataagaaattatcgaagaaaaaacatatgagagtagtcgcgtacacatgctgctcagtttcaacttttaacatgttttgtttcatcataaaagtatagccaaattcgcaattatttttaacatctgaatatctagcttagatgttatacatacagatctgtatgtataacatcatggtatactacgtacgctactgttttatcaagtcaatatatgtgagacgtgcccctttatttagcaggcgccttttaccttcagtaaacaacaagtgatcagccatcacaatgatttgcatggttgaatcaacattatattcatctctgtactctgcattattactgttttacagagtactaattccactagaggatgcatcagaattattgcatgctgcctgcacgcaggaggaggtgcggatgagaacaaacaatgcatgcattgcatgctcaataatcatccacattttatatatatgcgtcgacaaaaaccgcacacatcttcatcctagtacaacgtaggctagcccatgcatgcatgcaagcagcatcctcacatgccaatcgatcgatcgatcgatcgagctgatgtctcttgtacaaaaagagtggaccgatcgatcgatctagcttagatggagccaccgtgttttgtatttctgcgacagcaattcaatcagaaaaaaaaatttcatcagagcagatcaagaagcagcagctacgagacacacaccttaacgaaaaagccatatcacgcatcgccatcctctacgtactttgcatccatatattttcgtcagaaacaacatatatactactctagctagcttctctctctctaaccatagccttgttccatccatccatgcatgcattgtctgccctatctagctttggtagctagaggtggaccatgcaaattgcaagcaaccccaagcacaatgagagagagagagagagagagagagagagattccaaggagacaagcatggcagatgggggaaggaggagagggagaagaaggagaggagatagatgcaaaatgtggtcctcaaagtactagtgctggtccacattctggcagcagcactttgggggtggtggggtggggaggagttggtcctcactcctcactcagtagtagtgggtgcccagtgcatggatgcatggatggaggtctggaggaggaagaagctaagccaaaggccggtgcatgctgtaacagtagtacaaatatgttgaaaattcagtacaccacaccacagtgacagtacccccactgattatcagctggatgctgctgctagctgctcctagctactacatggatgcccaattgcccatggaccagagagagagagagagagagcaagaggggtcctggaattaatctggttaaatcaggggagccatcatggctaatgaggctgattattatgatgacattgaccatgatgatggctttggggcaactaatccacatgcatgcatggccagccagccagggcatcatatcatggcgggctatagtacgtggacggccgtgcatatgggtcagaggccggactgtgttgggagagcatgcatgactaatttgctctgattagctagctaggtatagcagctctgacccctgcaagtctgacacctcaacctaatcaataattattcagtgatcaatatgagctcgatcgatcaagcagcgcggtgggggtgcactggtctaggatattgttgttcttgttcgaccgaacctccccctttttcttcgctcggagatgattgatgctgcgaaacacagacagaaatcttcgggcagttaacacggttgctttcgcgttaagaatgggattagttataagggtctatttaaaaatatggtgacaaatataattatagcataaatgtaatataattacagatgtgattagtgtaattacatatataatttaggaacttaaatatgtaattttcaaacttagacttacattgtaaatacagtaaaattacgtatgtaatttagagatttacaatgaaaatacattttttcatgaaaaatatggtgtcacatttatagcaaatccgtagttataattgattgagtgatactatggttcctgagaaggcatatttttgtaacgtaaaatttaataatatctcggtatacctcttaaatcacaatttttttaattgatttggtcatttttcattgtcgctagcttggacaaatgtactttaggccgggttaaattaaatattttccccagaggtctctgtagttcaattcactgttcttgtgctacagtgtactactatatatgcttcaattaattccgagtcatggggaaaaaggccaaaaaagaagaaaaatattacttgagcagaattgaatttactcggttattgattatttacacgcacacggatgcgtgcgcatgaatggtgacaaattttagtacgtaaaattataacagtatacaatcatgcagcgtgcatgcatgcaggcgtatgtatataccactgtagaaccctagctacatcgatgttgccaaatcattgctggcccatgcccgcttggcttggtcctagttgccctgtcactatatgctgagactgttgctgtcgacgactacgacgaatatgtactctctacatactccctccatactttaatttatgacgccgtagacattttaatcaatgtttaaccattcatcttattcaaaaaaaattatgtaattatcatctattttattgtcacttgatttatcatcaaatattctttaagtatggcatgaatatttttatatttgcacaaaaattttaaataaaacgaatagtcaaacgttgttcaaaaagtcaacagcgtcatacattaaaatacggaggaagtacgttacagagacatggatgcatatatgcatgacatgccttgtacgcattcatacacgtagtaatacgtacatggtgcagtacacgtatgcatgcatacactggcgacaggtaggagtgaacagtgccttgaacggcgatcgatcgagggactttcgatcgtacgtttggaaagaatccggccctgcagctttttaaattttatttaaaacttaattacattatttttaatgtggattttcacccgctcagaatatatgtataaaaattttatctataaattatttttttattgctaataaaccgtgttagcttatattagctctcggtaatcaatggaatgtaatgactggttcggcgtagagatgaaaaagtgatccacgccttgctagctcgaacctaccactacagaaacgatttttatctccgatcaaaattgactttgttaggcgggtggatgtcccgtctgcacctaggtgtatgtggaaattgatattttttatgcgggtagagcaaccgcatgcgatgtgggtgtttaagccgtccgaagataaaaagaaaagttagtaaaaaaattccaaaaaagtccgaaaccctagcaggtcccgcgtccagtggtcgtcaccaccattcttgtgcccgggcttcgtcctcgccgtcgccaaagcactccttgctgtcagagtcaagcgttgtatccatgcgcgtaggaagccgaggcggtgggatccgcgtgggagagggacagcccgccgggtccaccgttgccgagctcaccgccgaatccaccgtcgcgtcctccacaccactggatccaccgccgtcgtcccttccctccactgacctccccaccaccagatccagcgccgctgccctccccaccgtccgctagttccccgccactcccgctctcgcccaccgccgatggagagatgaggaggaaagaagaggtggagaggaagcagtggaggagatggaggaagtggagggtgaggatgaggagagagaggggtgacttgatattttaagggtgagctcgatctggtaga

SEQ ID NO: 22319 - DNA, 19571 bp, Oryza sativa
  unsure (1)..(19571): unsure at all n locations
aataatgtttcgatcatgcgtgcatgtgatctgtgtacgagctactggctacgcatgcaataatctggtacgtaccaataagcaagtaagctagaggctggccgactgtgtgtggccagactggttagatttgtggctatgtggcctactgtagatgacgtacatgcatactacattacgtgtacaatactattaaacacatgggattgtctggttttttaggcacataaaaacactcacaaattgtagtcacgcctaaatcataccaatatttttggataaagaataattttatatcatgcaattctttctccccacaacgtgccatgttagtgtgaactcgcctcacacacctcaccccatagcgctgtcaccaagcttgccagggccggaagctctccagcggctcttccccacctcctaataacctctcctgatttgacgctctctgccgtcgaccctgcccatctcccccctctagccccatagacccaactacgtacactactgtcacctcgctacatgctcttgtttgccatccaccatgaatccaccgtctccctgcccatccctttaagcctatgggagttgaaccactctcttccaccagccaaaatccccacccccaaaaccttaagtctaatccgtgggtcctctatcatagttaggtgtcactcatgatgcggaagatgaaaagatcgtaaagaagtttgatgttgtcatcgttgttaagccatggctaccatctccctttatctcacctcttttcttgcctccccttattctagatgctgcaggtgactgaaatttctcataaatttgaccacctgaaacaagcaattcactaagtaaatttaccatttctacggacacgttttttaacatgttagagttcagtctcacattggtggtgaaagtacaatatatcttgtttaaaagttatcccctcaactcgtaagctagctattaaaaatgtgtaaggtattttaagtccttcaattagtatcagaatatggctagttcaatgcatttaacccaatgaacattattagtatgagtgcaagcggtgccctgatggtacaggtgcatataaaatacaatcgtttctatataaacaaggtttatgagatgtatatcaaatatagttctagtgcttgtggtgcctaacagtatatatagttatatataaaaggaaaaaaaagaattacccctaaactatcgaggtcaattgaattaacccactgaactcaaacaccagacattttacaccattagctatgcaaaccggataaataaccccctttttcaaaccggagtatagttttggtcctatgtggcaatccagttagcaattttatttttaaaatccatgggccccgcatgtcatactctccccttctctatctctttaatccccatcctctctctcttctcccttccctcacctccatctctctctctctctctccccaaactgagcagggaggactaggccgacgacgctgcttagcggccggtggcaggaggggctcgagcccgtgtgggcatagccgtggccagtgatagaggcagcaggcgacgcatgaaccggcgggtcagcggcgggcgacacttggcagtgtgataggtcgcgatggcgcgcggcttgggcgacaccgtaggtgttgcccctctctgcgtcaccttgttcccatcggaaaaatcggtgctagcggtggagaaattaaggatgtggttgcggcgttggcatggttgccgagcttacacctgaggatggtgccgccaccactagctgaagcgctccaccttgaagcaaatccggtctccgccctcatgccgagcccgcctccctcacgccaagcccgcctccttcacaccattcccatccatggagagagcagagagggaggggagagagggagagagcagagatgaaatgacaggtggaccctacaaatctattactattatttttctgactggattgccacgttgacaccacgtgtgtaagctcttggtcaaaaccgcccaaaacagtcctggagggtaattcgtacggtttagaaagtccagggttaaaaatatatggtatttgagttctaattcgatcatcctcgatagttagagggttattcgtagtttttctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactaacgaccccatcgtggaataagccaaacggtatttttacaaatgaaaagtaatggtaatttgtaaataaaattttttatatacgtgttcttagagatccaaaagcaacaactgaaaaataaacttcgatgaaaaaaaaccttaaaatcaacatcaaatttaaattttggctgataagtaggagtatgagcataagcaaacagacgagatcgtaagctaagagcaggtacaatagcatagcagactataaacctgctataaacatattttaagaagataaaagatgatatataaaagcagtggactacagatttgtagtcagctgcagcacggactataagacgtatgtgtgtatgataggtgataccagatattgattgtgtagtatatttttatataactattgtatgaattgactattaagttgactatagataatttgaagccagcggtgagctataatattaaacttgctctaattaagcaataactcgcgctttcaactgacggagtgggtgcgtgtggtgggtgtgcgcgggcgaggcacacggctttgacccccgccccgccgggcgcggcggcgtgggtgcgtgttgcaatcaacaacggcaatttcttcggccgctaccgcttgcgcttccgtccacacacgccacgccgcccggccgcgtgcgcgcgtagacgtcgtacgtcgatcgaccgcgcgccgatcggccaaagccggtctactctcgaatcgaataatattacgcatggttcgatcgatcgatcgatcggtcggtcgtcggtcgattcttttcttctcagcaaagacacggcaggcagatgcacacaccgaccgaacaagaaaaaaacaaagacacgacacgacacgacagatgcagagatgctactactataggagagtaccctctcccccatgtgcacgctcgtgtccacacatgcgtgtaagttaattattgaacgcgacttgtcagttgccatgcacggccaccagtagtactcgatcgatcgatccctcaggtactaccacgtttcaattcgcgcgcattctcgtagacgccgagaggccggccggcggccggatcatccatccatgtttcgacagtttgaacatcatccatcacaccagtagcttagctagcgagcgcgacgacacacaacgtgacaagaggcaacgacacatgagctagcgcgcgcgcgcgcgcgcgtgcgtgcctgcgagatggctgcgccgccatattcgcgcgcgcgtgtgtgggtgcaggcgcattggcactgtgcataggtcgtcgccggctggaaaagagtagtagagtaccggccggtgggtcgttgcccagctcgttggctcgtgagaaaatttgctatattgtgccgtctccagacacgggtttcatcggaatgttattctgcggtttggattcgttaagttgtattgatgtatagcgagctagtgaaaggtatgtaaatttgcaattgcctcaaaggtatttggtgttgggggcgacgagtacgtgtagtacgtgtgcctacatgttgcactgcgcgcgcgcgcccacggtacgtacggacacgcagagaccctggctggtagggactagggacggagagccggagtacctaattacgtatacgtacggaggggctctacgtacccgacaggtgggtccccgttatgtatgcgggccgatcgtcagttcgtcaccggaggtagagcgatgatcattcacgtactacataatgactcagtctcagtctcataaaaaaccaacataatatcggatatgatacttttaatactatgaatctgaatatatacattatattcggttctagattcgtttttttttataggagggagtgagtacgtacgtgcgcgtcgctgggtggccgggttgttgggttgtggtttgtccgccaccacgctggacattttccggccggacggggacggccggccgccgggcaatggctcctcggaccggcttaattgcgttgtcggccgcctctatcggcacaaacatatgcgcgtacatgacacactctgcctctcactctctctttctgctgccctctcttctcctcgcagtggaactaatcattctctttttgaaacaaagtggagctaatcattgctggtttggcgaggtgttggccttgcttgggaaacccccccaatctcgggatgcgctcagatcgaccctcgatccatgcttgcttgcttgatggttccttgcatctctctgtctgtccactactctgtctctctggtgttcctctcgttaatttctctgttttcttgttgacacctcgcaatgtagtgtagtactactagtagtagtacagtacagtacagtacagctagtatatttgttggtgacacgtttaacttaacggatgggagcacatagctttgcttttggtaattagtagtacctccgtcctaaaatgtagctatttctagcacaatactttgtcctaaaatgaagttatttttctacctaccttctcctctcaaccaatcacaactattctttttcacctattttctcttttcaaccaatcacacaccttcttcaatcattctcacctacttttttaatacccgtgtcaatctcaaaaatacttacatttagggacggatgaagtaattagagagcttgatatgtaagtacatgtaattgtataacggatatggaccgaattaagacggcggagtgtggattggtggacggacagtggtcaacatagtacgcgcgtccgttgtccttgtcttaagatatgcattgttgattgatgaactgcaatataatggactgtgactgaactgagatatgctcggatttgatcgggtacatgaacgaatttaaaagactttttgctgcgcctttaatttcgagtcataatgtagttgcattgcagctcgttttcgtcatgttcttttcgtgtattaggaccacagttttcatccattacactctagggtcttaaaatatatatgtccttttttacttttcaaagtatacagttctttcgcataactaattaaaaaaacagtttaaattgcaaccagtaaacagttttaaaccagacgagttttgctcctgcatacacgtggcactgatgatgttatctttgatatccagctctttatgaaggcgtctatcctggcatgcacaaagactgtctttatgaagaccatttcctagactctgcttgtgtaagcgtaatccctggaatgttcatctgtctttaaaagactatgtgtaatgggaacatatatccaaatatccaatcacatctaaaacgactagttttttaaatgacatgagtaatttattgacgatcaactatactcggtgataggttattgtttggagcagagttaccgttgtacgagtttttttttctttttcttccttgttttttaatctttgttttttcctctcttgacataggtcggtctggctgagtgtgtcgggtaaaaaaaactctattcttctaatatattcagggctggccctaactttttggtggcccggtgcggaaaaaaattcaccattaaaaaaaagataatatttaaaaactcattgtcattaacgaatttcacactaataagtttaaaatacaatcaagcagtcacgatatactcgatcgtcgatcggtcttctgtttttttctctaagcccatcaagtctaataccatagtattaatattttggaggcccctaatttttggaggcccagtgcgatcctgtactgccctaaggccggccctgaatatattggcgtacaattttttttgcgcgttcgtgaaaaagataggttgttgtttggctacataaattgtttaatttcgcgcgcgcacctctcggtacgttcaacctgcaggaccaaaggcgtgcgtgaaacaggtcgtggtaagctcgtagtggtgtcgatgcgcggttcctgaaagtacgcacgtacgtacgcaggctcggtgctttgcgaattgcgagcggcgtccggttcccatctcgttcgtacgtgcacgcacgcaagagaggacgacagtgttacgtactggcactggctatatctatatagtacagtatatattttgtacagggactgtgtgttgcatgcatatatgcacgcacgcacatatgtaagtgtatcattacatatttatttacatgcgctagctacgcaactggatacgcacgtacacaatgcgctactagaaaaaaaacatttttatatgtggctgtcggtgaaaagggctcgggggtacgcacagtcgagggaagtatccttctaatctaagtcgcgtgaccacgtggcctcgttttcccccgcccctcgggtagcgctgaagtggccagagggcctcggggtgtcacgtcacacccctcgggccttcggggcgtgctaccccgaggcccttgcccggcaaccacgtggcggggagagcaagcggggcgagaaacgctgctccgtgccttcaatgcgcggcgtcccaaccgtcctgcgccgcatttaatgcaacgtgggaggacgtgcggcgccgctcgattgactcatgtcaatcaagcttgaccggtccgtgactagtcgcaagcgatgggacgggtggaagtgcccccacgttccgccctgtgtcaagcggagtaggggcaggtacgccccgtcccattgataacaatctggtccaggtggggttggccgaggcccaacaaattaaggttgtccggaccccaacagttcttcggcacacgcactcggggaaagacccagtatccctaaaagactagtccaataggggaagggtggctctcccttttaaggtggcttcatcctcccaagctaagtaaggtgggattattcaaagactcacagggttgccgcccgactttggcgtctttgccagcgggtaatagtggaggatgtcctcatcattcccacccccttaacaagggcctagctctgataccaaatgataacaatccggcccaggtggggttgaccgaggcccaacaaattaaggttgcccggaccccaacagttcttcggtacacccactcgaggaaaggcccaatctccctaaaagactagtctaataggggaagggtggctctcccttttaaggtggcttcctcctcccaagctaagcaaggtgggattattcaaaggcttacacggtcgccgcccgactttggcgtctttgccagcgggtaatagtggaggatgtcctcatcacccatcgacacactaccaggggcgcccctcacgcgcatggtgagccgccaaagtctctatgcatttaagagggaatgacagggatgtcccccgtatcaggcggagaatggtgctgggccccacctgggggcgctgaaccatcttgcttccggttgaaggcacggagggcggtctgatccaggataggtggatccccctcccatggaggagtaggtatggacggtgcatgtggtatccccttgaactataaaaggaggaccgtcaccaccgaaaaaggggatgactctcagataacttgagctcgaaaggaagaacagttgggtttcccttaaagctcaaaacctcttgtaaaagttaaccacaattctacacacaggagtagggtgttacgctcgatagcggcccgaacctgtataatctcctgtctttcacagaggctaggtagtgatctagcagctagactgcaagcggaagtacgctcttgatcatcgtgccatcttccccggccgaactaataaaggggggtctcacgaccgcccgctagagaggatctctcctcgacaatggccaaaacatatttttgcaggcggccataacctccgcctgcatccaaacgccggcggaaatcaatgatttttgcaggcagctaaatctacccgcatgcgaaaatattttcagcgtaaaaaaaattggctgcccccagccctacccgccggcgccctccccttcgaccaccaccaccacgagctgtgccaccacgatggttttgagagggagagggagggaaagggagctgcgcgcgccacaagctcaccgcgccagcccgccgccgccgctggccctccccacgacgtagttggatccgagaggggaggggaggggaggggagggaagccgccgtccgaatctgggagtgggagtgccgtcgccgccgccaatgatcgcgtcgcctcagccgccgccctccccacaacgtagccggatcatatccgtgagggaaggggaacgccgatgacctcccgcctccgccgacaacctccggcgcctccaccgctgcatgcagccatcgctgcccttcctcacaatgctactggatccgggatgggaggggaagggccgccagccggatctaggaggtgggaacgccgccgccgacctcccgcgtccaccgctgcatgcgtacgttgtcgccgcacggccgtgcctcgccgccgtccgccccgcgccgccggccataggcctccccctgcccccttcaaccggatctaggagggataggggaggcaaggcgcgtcaggggtggatgtcaccgcccccgagcgtcactgtccccgtgccttgtcgtcgtcgacgccaacccagcgcctcgccgtcgtggatcccgccgcccccacgcgtcgccgtcgtcggttcccgccgcccccgtcgccgaatgcccacggtcgctgagggagaggagagctgagggctgagggagaggagaggtgagggagacgagaggataggacttagaaaaaaaatctagtgatgtcgcgtctatttatatttcacgccaatttttgcagtggtctgcctgcgaaaatagattttcacaagcggatagcgagcttcacctcgtttacatttttgtaggtggtcatttaattccgagggttatgtccgcctggaaaaaaaactcacgtctacaaaaatgctttttctaagtagtgatgcaaacgctaggcgatgcttagctttcgagctagcgcattgtccattggattcacatttatacgtgcgcggtgaaaattagaactagctgatgatgctcactcgacacatgtcattgcagattattgcaccggccggccgatcgccggccgtgcgaggaagaagatgagatcagaatgaacgagccggacgtacaccgttgccgccatcgccggcgaggagagatctagagagagagagagggaggcaggcggatgaggaggtacgaatgttactgtgctggagcagcgtcatgggagatgtgaaggtgctcgcaccgacgtaccaaccacacacgcacagtgccccgatcgattcatcgctgcagtatagtactataccactgccgccatgctgcgcccccccagtagtgcgtactacgccgtccgtcctgatctcaacacacacgcacagtctctctctctctctctctctctctctctctcggtcagtgctacctcgagggctataagctaagccccatgcatgcattcatgcatacgcgcaacaagacttccacgcaccaggtgcgtcaacaggacgatattgtgtgatctagagagagagagagagagaggggccgggccggccgaccgatcggtcccggccttcttacaatctgtcagcgacaaaactggtagataccaaactcactgttccttcactttcacctctctctcctcatcctctctctagcttgctaaacggcctattgcagctagctagcagctattgcctgcatgcagcgtgagatcgatcatcgacagataggtagagctggacgagtacagatagatagatagatagatagatagccagtgcactcactcactgactcactcatcgaaagagaaacagagaggcttacctgcacgcatccatccatcgatccatgcaatggcatccatgcgttgcatagtgcgcggccggtagaagggagtagtagtggagctgtgagctgtccgtccacatgccctgtcgtcgtcgtgcacaagcacagcccacgcacgcctgttgcatgcaccaccaccaccaccccgtacgtaggacaccaacggcctcaaccggcctctctctaggcacgaactctctgtacgtgtgtggatcgagactatagtcacgtgaggactgatcgaaccgtgagtttgctatatggtaaacttatcgtccgtgttcaatccaaagcattagtttgaatcaattttcgttgttaagcctctcagccacaaaaaaaaaaagcatgtctacttgatacaaattagaattattaacaacatatttaaacttggcggctgtttttttactgccaagaaatcagttggccgttaaaaaaattacggatgcttgtagtgattgttcttggttttgcatgcatcacacatttggcaagataaagaaaaagctaggctaagctagcttgctcacactgagatttttcttttatttacctcgagggataatctggcgctcttggtagtacggaacgttcgatcggacggttctggctggccaatagatcgatcgatcaggcagacaccgttcgcagcacagaggcaacgctagctgcacccggctggccggctcccccaccgtggggcccacaggcaaggtgggtccacgtgtcaatctgccctgccgaccgatgagcagtggacggccgatcgacgccttgtcgttttccctccggggaattcttactcgtgcatctaatctactagtagtacgtactccgtccatctaattgattttggccttttccatttctccgtaaatatattatagggttttaaagtactgctttatcaatctatacaaccactacatttattgcttctttgctcggcataatcttttccagtgagtaaattttcaaggaaatcaaaataatttcagtttaaatcttaaatttcggtaaaataatatgcatggttaaatccctcgtatttatggacggagtattatgcagtcgcactgcttaattccgtgcgtcttttcctggggccaatctcacgggggacccccagcgaaattatgcaaaagtaccagcagtgtagtataaaacgagagcaagaggggacacacgagtaaaaagaaaagaaaagggaagtgactgcaacaacagcgggcaattgttcttctcgggggacgcgaaaaactttgggggcctcgggattctcactgtctacctcagcaaatttcttaattttagctatagctagctagagctaagcatagatggatgagctagaggtagctagctagccagtatctttgttcggtttgttgctactcctacatcgactggtcatttggttgagataatcacagataatataggggtgctgtggtgtgtatatacacccttcgttctaaaataaaccaacttaaaaaacgtaactcctattacaacaaatttagataaatattaaatatttgtacaaattcgttatactgaagagcaacgaatctgaataaatattaaaattttattcagatttattatattaaaatgaatatgaacaaatatcaaaattttatttagattttttatattcgaatgtgacacatatccttctggtttgagttttttttatgaaggaagtgtagcactgtgcgagttgatgctttactgtttggggacttgtagtctatcaggagcggccgggtcctaccgtgggattgtacattgatctgacagcgtcatttatgcacatcgatctaagattgacgtttctagaaatcgagttttacgttggttaatgaaattaacactgtggtgtgttttctccatcccctaaaaactaatctaagatgaacatgacgatttctagtataataaatttaaacaaaccttcgtacaaactgcagcgtagtttagatgtataagttgtatattcaccgagcttgagaagtgagtttactaaacaaagaaaatgatgttagggaaactaacatggtgtactgcaattctctgggacaggaaaaatatcttgaccaagattgaaatgtttatcaacagtaactttttttaatacagtatgtcattacagtgcatttctctttttaagtacagctccagccaacttaaagaaacatagaagttgggtacctctaacttaaaaaaacaaatatcatggagttggagttgcggctaaattaggggaatgagacattttgttcatgttgataatgatattatattgtcaatcacttagttttaagttacaaactccattttctgcaaaagtccaggacctttttatatacattcatttgtacttaacgataacaataaccaaataataaatcatgtatatgattatatatagtcaaattgataatagagttggatcccggagggcaattaagaaaccatagacatatcaaattgatatttgaaaaccaatggcacaagatagggctacgttgattttatggtcttattagtcatcaatgaagtcttgagcaggggtttgcaatttcgtttttcattttccaaaattcagggacgaaagaaatatggagtttaaaattcagggacgaaagaaatatgaaattcagggacgaaagaaatataatgttagtgagatacttctacataaaatggcgcccacaaatatttcatgtttgaattgtctaagatgacatctaatttggaattgatttagtacaaaacacaaatattcgaggctttttctgaatctatgatgtaagaataaagtagtcgcaatccaaattctacttttgtgcgtaacaattagtaatacacaaaaaataactaccctcacatgccaccgacaccaagtatatataaccatagtgcaaattaattaattaattaatataattattaatatatatatatatatatatgtgtgtgtgtgtgtgtgtgtgtgtgtgtgtgtgtgtgtgtgtgtgtatgtatgtatgtatatgtactcaacataatgctgcacttaatacgaacacaaaaaggggagtcccttgcatcacaaaccagtgatattttggactatgatgcttcctcaagggattgccaagaccacaaattaacctttgtaacaaaattggtagttacatgtcaaactttacctgctatatatgtaaaacaacctcccattttatcatttgcgtgcttccgacacaacgcatgtccatatacacacacgtaccctcacactcgatataacgctatcaaagttaacacggctcgacgccacgcacatacgcaccacacaaaaattcgctactagctagcacagtactagtagcagttagtacaagctaaaacacacttgatcaataacccaagcccccccaggctagctaagctaagctaaccagggaccacggcacacacacttgcataccgtcagtttgttgacaagctagcacgcacaaatggtttgtagcaaccgcggcgggcatggccagatgctatcacgactcgaccaccacaccactggtgctatatacaaatatatactaactccaactccgctcgatcaatccccgttatcgatcgaccacgctttctacgacgacggcatcgctatataactaggttttaaggctacctctcaatcttcctcttcttcttgttcgtctccccctcctcacccaccctgttcatctcgcgtgtgtggcggtggtggtggtattctctctctctctctctctctctctctctacttggtgaggaggaggaggagagtggtggtatcgccatcagagctcaataatactagtgcacgctcgccttgttttctagctcttgtcagcgaaccttcccccctgaaaaccccacccaccccctcccctcctcctcgtctgcttctcgctaccctctgtgtttgtgtttgggtttgtttgtttctctctctaggcctcgcgcgccgtgatcgatcgatttctggagtgatctgttgtttttttgtggagttgtgtgatctgggagatggctggagcggggggtgcggctacggctgcagcgggaggaggaggtgggggaggggtggccgcggggaggagtgaaggtggtggtggtggtggctcggcggcggcggcgggggcgggggcgccggacccgagggcggaggcgctgcggtgcccgcggtgcgactcggcgaacaccaagttctgctactacaacaactactcgctgtcgcagccgcggcacttctgcaaggcgtgcaagcgctactggacgcgcggcggcacgctgcggaacgtccccgtcgccggtgggtgcctgaagaacaagcggtcgaggagcggcggcgcggcgcctggtggcggcgtgggaaggggcgggcctgaaggcggggcggcggcggccgtctcgtcggctggcgccggtgcagctgggacttcgcccgcgtcgtcgctggcgctgccgcagccagggtcgctgccgtcgctgtcgtcggcgctggggctcaccgggggaccctcgctggcgtcgctgctgctcgggagcggcggctccgggggtgaccacctcgggctcttccaggccatgcagtcggtggtgtccgacacgaccgcgttcgagatgcaccagcagcttcagtcgcaggtggatcacctgctcggcctcggttacggcgccgcgggggcgcagatccaggcggccaagccgtggctgcatgacggcggcgccaccggtggcctcctcgccggcttatacgcgccgctcctgtccggctccatcgtgccggggctcgagcagctccaagtcaaggcggaggccaccaccggcgaccaccagcagaagtcatcggcggcggcggccggtgagcagagctgggacctgcagacgccgtcgtcgtccaacgtcgaggcgagcatcatggcgtcggaggcgctcatggccgccgcggccgcgtcgatgaacccggcggtaagcgccgccgccgcctccagggcgccgtccgcgcagtcgctcctctactggggcaacggcggcattggcgccgccgccgcggcatggccggacctcgccaactgcggatcctccatagcgacgctcttctagctagcccagcttgccgcgcgcgccgcctccacgccgccgactgtgctagctagctagctagctcgtcgccgttcgccgtcgtcgttaactctattttttttccaccttaattttccctgagttaatttcccgatctcttgactaaaaaataacatgtaatttgtggggaaaaaaaaagctgagatgagagagagagcacactgtggagagagatagagagaagagaagagaagagatcatcatcatctcataggcagaaaaatagctagctagagcagccaattcaccaaccaaacgaagaacccaaaaaaaattcctgcaagatttcatcgccggtggtcgatcaagaaggagatcaagaacacagatcgactaccgaccgcgttcttcctcgtctccggccggtcgatgatcttggaaaggcggcggcgagcggaagatcaatttgggatgcattgatgaacaagaaggaaggagagatcaacaaaatcatgggaggagaagagaagcaaagaaagtgtaagtgcactagctagtgttgctactacttgatttgctagctagctagctctacttggcttcttggcttcttgatctccttccttgggtggtatgtagtagcttattttgtatatagggcatacggtgtggggggatagatacatgagaagagcttgaagttcttgcggcatatccatggcggtgtggtggtgcaagaacatatatgggggaccttttctctctctctcatctcggcattttaatcggtgtgtttaattggttaattaccctaccttggctttgggaagtactctagatgtataagttataatagtactctttagatcaccaccttgcagcataattagagaactgtttttgagttctcatgcattggacttgttaagggtcgtccaattccttgttcctcttctagagtgaattttttctcttctttcttttctcattctcttgggggtttcctttgttcaaaactttgcttgtatcattgatgactttgtgagctatgagaaattaaaacttctgtttgttcattctgatggatatatattgtgaatttcttttcacagattaattaatttgctcatatatacatccctcctctgtgtgtacctaggattatagttctcttcacacatggatactccagatacatatatgtatatatgtagtgtgatagctagctagttactccatcacttttagtgcatggatggatgcatgtctcactttagtgatgctcttgcagctttaacacctttgttagctctctttttcatggcgacggtgttgcgtgatctgatctttgaattctgcgctggctggcttcttctcatggatgtgtttctttctctcctttttttttctgccatggatcataggattctccagtagtggtgatgtactcaaatttagtgctagtatcatggaggtgttgctagcttctggtcagaatctttttttgtgcatgctcttggctgctggagaggccaaaaacatggctgctttgcttgttcttacctgcatgtctcgtagcaactcggagacgcattttgatgcatgctggctatgttcacaccaactgctaggtaattacatatatatagtacatatcactcaggaaagggaaaggtagatagaaacaaaacaattaaatggggggacaaatggagacaatttatgtggagatgcatgcatatgggggaaatgggaaaacgatttgatttggaatttcgtttttttttaaatattgttgcttcagctatatatgtgttttaacttaattatagtagttatattaattatgaattctcatctgagtttagtttgttccttttttttaaaaaaaatactttgatgcttgttccaatgtgctaaatttctttacttctaggctaacatttgtcaaaaatgactttgcatttttttaaaaaatccaaaatacaaaggaacttgatgtcgccgaatttaagtatctcctttctgggccaacacctattaccttaaaaatcaccctttttttttacatatgagtgaaagaaattaattatttgacactgaaagaaaattagccttctgaaataggatgggttttgcattactaattaattaattactgacatggttttaaaattaatgttgaacttcatctagtatatataacagatcttacatggttgagaaattattttaggaacatataaccggtataagctatctatacgtctagcacatatatgtacgtactatataagctctagctagtgagaacatatatctatctatgtatcaaattaatttatttaattagcatgaaggtcggatatgtgatggacttattcagaacctagctagctaggtgatggaataatgtcgtgttctaggaatttgctttgctttgctttcctaattggctagctagctatagtttatttgtcatggctctccatctttttcgagaacacttgtcccattgatctcgcatccatcttattattacaaaaatcaccatatgcatgtctttctacctctgtagctcgcatgagttctggtaggacagttgtacaatcactcaaaatctaggtgtataatccgtacctactcatccatatcattttgattgttgaatgacactgtttgatgttgttgcaacagcttaaaacccataaatgccattaatccttttgttagaaccgtacggttgtataagtatatatgtcggttccacgtcaccaaaaatgtaagaactgacctattaactgtagatgggtacaacagtaatagtactcggaatacgcatatatcctaccttcgataattaatattatgcattttgatgcgtacttaatattacagtccttgctagcttggttgtttctacacatgaagattactctcataagtcataatatatgcgtgtgacatatacttgcatgcaacacgcacatattcattctgaaatcggcattatatttgtaattaatcatcgatccaagatctgcttaaactaaaagtacaatataattaaagttgaaatttatgcatagggataaaaaaaatatagtcacacatacaggccctgcaaaactacagtactggtgtgcatgcatgagccaatttatattagctaagcttaattaccagtggtactgtgtactactgtctatgtgctttacaaccaatgccattactcgatcgtgtactgaaaaaaaataagtacacgataaaatgtttgctnnnnnnnnnnnnnnnnnnnnnnnnnnnnnnnnnnnnnnnnnnnnnnnnnnnnnn

SEQ ID NO: 22320 - DNA, 2585 bp, Oryza sativa
  unsure (1)..(2585): unsure at all n locations
tgtaggcatgcattttctctttttatatacagaaaatgttgacaagatatatagagatccatgacgttttctctggttgaaatgtttttttttaagtaggatctgcacttcgtactaacaaattaaatcagtatcacaaaatatgtgaattggataattttactatccttagaaggtacctagaggtaccatattttcaaatgtaaaaatttgtacctctaaatattaagtatctcaagataccaaaaattttagtgtaacatttaggtacctcaaaattattttcttaacgactgtaaaattcctcatatgaattggtctctgtgtgtgtctatacacacaccattctcttcttaaggacacaatatatatggtctactccatatatatataatccatgtgtgtgagcattccatttctatcccttttgttctgtgatctcagctcgcaattatcatatttattaattatgcatatcatgcctaatagtaaaccataagaaggctgtttcgtatcacgtcaccacgaggactattcacaactatccacatctcacgattagtcaacaattagggcttttctgcagtggtgaatggttgtatatgcatccatatgcatgcatttctattttccatcaattgtgttagcatcagtagtgtttacttttagtgtatatatattcgacgtggcacatgcgttgttcagtattgttgtctaacagtgagagtgatcgataaatgattttgaattgtataattaaaacgggggtatttaaatttaaataaagtataactgtgaacagaatttattatgaagttctaggccgggtttgagtacgtacgtaagaaaaaacggcacatttatttatgatgaaaggagaacataaatagatttaatttgtatacatttacaaagtactctccaccactgcaatacacacgtactggaattagaatattgatgtataccaactttcatatatagactactaccttcatcccaaaatatttatcgttctaggttatttagcatatatgtactaaggtttaaagataaaaactataataccccttaattaataatgcatagttggatataggatgatggttggggggtaaaatggggagaaattttaggacaatttttaaatgctagaaagactgggacggaggaagtatttaagaaggatctcaccaacatgtccatcctaagtattttcctagaatatacatgcatatatacgtaggagctacacatctttgttcatcactaagtacaataattaaaattttttttaaaaaggtatttgatgaatctgacatgttgcaccacaacatacgtactgtagaagtcatgcttattcagtccaatgtttcttgccatcaatttggatcgatcaatgctcactatgcatggaatacagtactacacacagtaataattaaccctaccgaattcatcaccattctacgccacccctgcaggcttcgactgaataacacttttaaaaaaaatacacaagaacatattgcaaaataaaaaaaaccaaaactaatccttaaacttcatacaaatccttcattagaagtgtgacttgagctttcaattaatccttgtccaaatatatcaacaatccttcgttagaattcaacattgtttaattatacatgtagatcataagaataattcatataagtccactgactgtaaaaaatagatactcccgatggtttcatgctcacaactttgccccgaaggttgcgatcgaaagagatgtgggcttcagctttttcattgcacacaaaataaaataagtcattaggttaatcaattacttcatccgtcccatcatataaggaattttgggtggatgtgacacatccttatgtgacgtctgtacagattattatactagaatatgtcatatccacctataatctcttatattatgggacggacggagcaagcagcaactattacaagcttcaaaactagatttatataatttttaaaaaaacgtttttgtattatttttttacacatagcagttcataaaacgtacggtgagcaagaaaatggggtggtgatcgtctgatcgaacgagaatcaaagccatcgccgaagaaaaaccgcctagccgatgagagcgcacgcgcgcgcgcgcacacacacacaagcgcacaaagggaaagcaacagaggatcgatgtagttggaaagatcggcttggttgcaccggttaaaaatgagaaagaaattaggagtagcaagagaggaaagttgaatcgtctgacgcgggcagcagcggccgcatttgcagcaggcagcgagagattggaacgcgatccttgcggggtacggcggagtaactgggggctctgaattggatgaccgcattcacatcgtgctagtagtagtacatgatagctagcccttgctcccatcaataggtaactgtgctatctacaggagccactgctgccaaagaagcttatcatcccttcactcccatcttctgaaaatgcctgtagcatgcaagaacgaccatatattantgtgtgtgtgtgtgcgtgggtgggggggggg

SEQ ID NO: 22321 - DNA, 941 bp, Oryza sativa
ccctcgcagtgatcgcaattaatttttggtttctttaaatttgattaaatttattactgtaaaatttagtcaaaatttgttaatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcatcttcctcggtggccctcgttctccaagaagggccgacggcgacacagtcatgcttaaaaaggatggcaacaagcggatgggaacaaacagatccaacgcttcctcaactggatctggcgtcctcctagctagatatgacgcccttcaatcggatatgtgcatggtgaccagagatgcccgcaaggcgcggttggtggtctaatgcgtggagaggcgggttgttgtatctagggataggcaaataaggcgcactcagtgggcaagttggctagacccgtgtagttcggcgaaccacgatggcggtcgtgtgctcgacggttgtgcagtgcggacaagcaaacgtagaggaaggacaacaacctctatgaagctagttgtccatggccaatggtaggagaggaagtgggagggagagacggccactgcggagtggttcgctcgatggagggacgctgatatggcggaggcacggggcagtgctcatggaggcagaggtctgatctggccaaataacgacatggatggtagtggcatggatgtcataggctcagtcaatgggttagatgacaatctacctccctttattggctaggcttatttttcctccttaggcttatttcttcggttgtac

SEQ ID NO: 22322 - DNA, 3798 bp, Oryza sativa
ccgcgtgtgaagatcaattaccacaagtgggcctaatgtggccgcctgctataatatattttcgcaagtggatgagttatatggtccgcctagaaagacatttttttccgtatgaatgatttagaatgcctacatgctataacagttttcgctcaaaaaaataaatttcaaaaagaattttgaaatccctagcacttcttggaaccctaaaatcggcatccacatgacaacattcagagatccatccacattcacacaccacaaacaaagattcatccacatccacaaactacaacaaacaagaacaaacatgaaaaactagagcttcaatcaaaacatagtagaaggagtagcagaaccgagttcgcagaggagatgaggtggggaaggagacgaaaaggcagaggggtggaggtcccgcgaagcagaggaagagtgggtggagaagaggctagcggttagacccagggtgcgcagcgacgatttagaggcagaggagcctgccctctcgaggtcacccacgccggagcaggcctcccgttgctgcaggcgagaagaggcgggggaggggaagcctccccgccgcaccgccttatgggggttggttcgtgctagccgaagaaaattttgtcttttgcaagcacgaggtggaggtttaaacccatgatctactggtcacacgaagagcatactactgatgcgctacctccatttttcaaacggaaacaaacatacactcaagatacattgtagtaatgctaatattataatttaattagttacatttgaaagtatttgacaaaataatataaaattttttgtgataatctcaaagagtacccgtattttttctccttcatgtcgataacaaggtactctctctgtcaaaaaaaccaacctgtctataacaatgaatttggacaatcctctatccatattcgttgtattaggagttaaagtttgttttttttagatggatggagtatactataaagcatgcccgaccggccagcccagacacacgtacgtactggcacgcatgcatgcaaaatgcgcttgtgtttctccctgctcgtcgattaccgggttgactcggccgcgccctgcttgcgcacgcgcgtgtacgtgctgtgttaatttgctgctgccatcgatccgatccagcgtcgatcgatcgaacgatacacggatcgatgttttccttgtcgtgaatgatggcagccggagacgacacgtacgccggccggccgcgtttttcctccttgctgatgatctcacgttggaaggagagtagccaccacgccccccgtcagacaaaaatgacatcagaaactgcaacttcgggatttccccaagtgtgcctgtgtgtgacggcactgacaagcggggtcccatgatgtttttccaaacaaattaattaaggacgaagcggcaccagtctcggatcggataaacatttgcaactttttgcaaggttaacattttatcatgttcctcgtaataaaaaatggtcatgttttatttaacgttcgaaatctctcattatagatggttcatatggagtaatcttcggtaaaattatgacatacgtatagttccacacaaaagacactctaagttaatcttaccagaaaaggaagatttgtctgcaatgtagcctttgcatggtctctcacgtggaactgaataacacagccatcatttcctcagcaatttactctctccatccaaaaaaacctaagggtgtgttttagtagaaggggattgaggagaatgggaaaagcgtattgagtattaaatattttatttaatactcatgattaattgagtattaaatattttaaattttaaaaatagattaatataattttttaaagcaactttactatagaattttttttcaaaaaacacaccgtttaatagtttgaaaagcgtgcgcacggaaaacgagactcaatctcccctatctccccagaacgaacgatgccttaatttaggtgaggatgatcgttcatagtataacgaatctagacaatttgtttaaattcattgtactaagttgagttttttttttaacagtgggagtacactatgactctatgactggtaaatcgtgaaagaaaataaacatagcaacttaaaaaaaataaggtaaaacttttatatttatgtcttaattaaacaatttgaatttaaaggcaatactaaaaataaactacgagaaaaatcatcaaaattaattttaactagcatggtggcccgcgcagattgcacggctagcaccattatattttgtcatataataacatactccatatgttttctcaatgtattattcagatatattacaattatatatgtcatataattttaaattttgtactaccctgacgaaactactaatatataatatttatattgtattttatatacgtgttagttattaatttaatatcaaactttagttatttgtaaattatattcctatatggactctaggctcttcttccaatattatttatttttaattctgaatttttattatttctaattgtatttctatgtggactctaaactcatctttcaatactctttaatttagaagtattaattctaaattgtattcttatattgactttagactcttcttccaatgtttttataattttgaattttagttattgtaaattatatttttatacgaactctaaactctacttataattttattatgtttattcagaattttagttagttttaaattcttatatggactctatactctacttctaatatttcttatttttaattctgaattttagttatttcctaattgtatttctatatggactctagtctcctcttctaatatttcttattttttaattccgaatttcagctatttctaaattgtatttctatatagactctagtctcctcttctaatatttcttattttttaattccgaatttcagctatttctaaattgtatttctatatggactctgttttttctttttcttcgattaatgtgagaatttctagaccatgagagcgaacgtgaaggtttttttttctattcctttaataatataatagatttgtttttaaaattgtaactttggttgtggtaaaattgcaaacgatgccagttggggtatagttttacttttgacagtttttctaaaccatctaggataggatgcctggaataaccattcagtagcacagctctatcttaattacggccgagaagtatgacagggagagacaaaaatctcaccgcagattactagagtaaaaaccaagcttaactttgctgcgcggccatggtgaggacaaggtacgtgttcttagtactctattgaccagagggggagctgcatgctcgctgaacgctgaggcagagagcccagaggcgctggcttggctgccactgcatgcgcccaactgaatttgttaggttcccagggcggtagcgccaggccgtgcagatgcagatgagcgccgcacgcagcatctacaggacctgccggccggctgcggtgaaaattccaatttactgcacactactacccggtgaaaactctcgtcatcgatccatacataaacctaataatttagtaatagaaaaatagcaaacactgtttcagggattgctccctccgtgccaaaaacacttttggctgtaacgtttaaaatttttggcttaaaaatgcatgttcatttaattggaccttagaaattgtgaccaaaagtattgatgagggaaaacggtaatcatttcttctcactat

SEQ ID NO: 22323 - DNA, 1012 bp, Oryza sativa
  unsure (1)..(1012): unsure at all n locations
nnnnnnnnnnnnnnnnnnnnnnnnnnnnnnnnnnnnnnnagaagtatgacagggagagacaaaaatctcaccgcagattactagagtaaaaaccaagcttaactttgctgcgcggccatggtgaggacaaggtacgtgttcttagtactctattgaccagagggggagctgcatgctcgctgaacgctgaggcagagagcccagaggcgctggcttggctgccactgcatgcgcccaactgaatttgttaggttcccagggcggtagcgccaggccgtgcagatgcagatgagcgccgcacgcagcatctacaggacctgccggccggctgcggtgaaaattccaatttactgcacactactacccggtgaaaactctcgtcatcgatccatacataaacctaataatttagtaatagaaaaatagcaaacactgtttcagggattgctccctccgtgccaaaaacacttttatctgtaacgtttaaaatttttggcttaaaaatgcatgttcatttaattggaccttagaaattgtgaccaaaagtattgatgagggaaaacggtaatcatttcttctcactattctatccatcccaaaatataagaaacaatcacttttttttaaaagaaacacacattttacaacctttcataacaaaagatgtgcattcatacatgtattgcactagcaccttcctcctctttaatttgttttttatatcctttatcctcaaaatctctattcgtatggggtatacacattgttattatttggcaaattttactacaggacactgctattgtgtagttttagctgtgggacactgccaaaactcacttttgggggaaaacacttcataaatgtggtaatttgccaatgaacacgatgtcgattaaaataataatttctaattgagtaggagtgagaaatcgcgtaaaaatatcaaaaatgcccttggccccatgtcagctctacatttctctctttctttcctttctctcttctcccg

SEQ ID NO: 22324 - DNA, 2413 bp, Oryza sativa
cagtgtcctatagctaaaaccacacaaaaacagtgttttgtagcaaaatttgccttattgttttcattagagtgattcaaacgaggtgataataattctttcatgtctttacgtcagaggtatttgctgggatggaacaaggagggaatattagtttatcaagaatgggtataaatatattctttatgaaacggggggaagaagtaggttataataatttccctaaaagggaatgattagcgtaagtaacaatcctggtatgaatggttaatatcctctctatctctttttaaacaaaaaaaagctgaaaaccaagcaaaagaaccggaggattagttgattgattccatggacgccatgatttgatgcacccactcctaacgacataatacacgcatgttcctccccactaagctgtgggccacattgcatcacaacgtgccctttccgccttctctctctgccatcactaactacaccaaatggcttcaccaatcaccaatgtcttaatccatggaatgtcactcctgtccatcgatcgatcagccaatagtagtaacaaggatcatcagtacgctcatcaccattagttactaactgcaattaatcatgaggggatgaggacaactgtccttttcttattcactcacctcagactcagaggtaggataaacgtacgtactacgtactcatcacgtacacaagcattgcactatattcctagctatatgcaccatagagatgtgtactccttctgtccaaaaagattcaaattttagggatgaatctagacattcaaataacgtgcaaagtatgtgcttgtgaccctgaagccacaaggtaataacacttgggtttttaaagcgggatttttaatatagaaaaaaaatacaagattagattatcttagcactttaaatcctatgattaaaaaatacaagaaaacttcgaaaatgaccatttagatatagcacagaatacactggaatcacaagagcgataggcataggattttttttcaaaaggttagacctcatgtgaaaattcttctaacattcaaatttctatgttttgaaccaatccaaagaaacttcaacggcttgtttggtaactggatgaaatgggattgggagtttgatgataggattaagatgagaatttgatttttaatcccaatatcttgtttggtagaggtgatggaaattgatagagagtttagttgaagattaggtcattaataaaaacggatggctgagatttgcttagataaagtaaaggaggaattccctcccaattacctaccctacccaggtattgaaaaggtgggagttctttcctcaattctccatcctcattccaccaaaattctcatgtctcccaaccaaacaaaacacttaataatctcatccctctaaactctcaatccctcctaaaaactctctccaaccaaacgggctgcaaaggaatttaggacggctatttctttgatcggaaaatattttcattggattgagttcctccaaaaatttcaaaacaccctttgttccaaagaagcccttgattgtgaacaccctcgattgggaaaaggccgaaagttatcaccgcgtagcggtataagaaaacttaccaggcatggtaaggactctgtaaaattcagttactgtaaaattcctctgtaaatcctcttacccaaaaagagctaccagggtcttgtttggatccttcaggctattaaatagccctccggaatcttgttatttaggagtattaaacgtagattattgacaaaatttattccataacccctaggctattttgcgagacgaatctaacgagatatttaatacatgatttgctaccatgctgctacagtaatcaaccgctaaccatggatcagaagtagctgtgaaagagctactagaagtagctgtgaaagaaatggacgtgacaccatggtaaacgacacgtcttaaggcgtcgaaactgtcaacaagacccggcctggctcgctcacgcagggcttggatggatggacgccggtcactccaggctccagtgcccgtatctcgcattccggagattctcggttccacccatccatcaatctttccttcccaattccaaacagccaatcaatctcttcacgcttatcgcgacgcgcaccacggccgtgagctgagctgacacccaacacacgctgccgcaatcgcgcgaaccatcgacacgcagcaacacaacatcgtcgtgactggagacaaacgctcccgatgcttcaggtttcgagtgttaatactccagtgatcatcaagagcgcctgattaaatactgagctctgagccagtagtagtggtaagcagcacactgaaagaaaacgaccgaactgatctggggagccattgatttaaagcgggca

SEQ ID NO: 22325 - DNA, 9164 bp, Oryza sativa
  unsure (1)..(9164): unsure at all n locations
ggagacattcagacataaagatgagtgtaggtaaaagtgaccttttgttaatgtcgctgaatggactagttcttttttctcattggcttcggttaaacagtagtattagctttgttagtgttttgatgattctgttggtggtaagcagcctgtttgaaaacctcttgccactctatccaatgggagttaaagtgcccttacccccgaagtacaaaatggtatgcagaacagctgaaggcccttaaaccatgtattgcatagcgacctgcatcatccgggagggcggtatgctcagcgccgcgattcctctcctgcagttcctcctcaagaaggcgtagaaatagttgatcaccagcttcttgacaaagaaggactccttccgagctctgatgtcgccgtggcccaggaggtacaccacgccggactccttggccttgtggatgaacgagagctcgtcgtcgaggcttcccctcccatcgatcgcctcatccagcgatccgtcgaacgacatgctcgatccaatggttgggtgctcggtagtaccagccgcctcggcaggtggaacaccgagagaattgatactgccattgggaccgacgagagctcttgacgaggctgatgcaacctcctcttctgagtctgtaccgtcgtattggtcactctctagggagcgctcttgggcttcccgccgcatgaacttctcgagactctctatcagaagctgctgaaatgatatgtagtcctccttgcgtatgtccttgtacccatacctgcaaccatccatgaatgattaacatgcaacaagaagaagaagattacacaaggaatggctcaatcagtgcttaaaaaaggatagatcatagctacgtaaccggctcaatcatcacacactgcatcattttattcaagacagcagattacatattcaatatttcaatatccagctatatggatggggtctatcaggccagcttcttgacatataactactgatacgaactgctgggggtagatatgcatgggtagaaagttgcaacagctatatttgccaggacgaataaaacaaatgttaatcaacagacatagaatcactgctagtaaatattagcactatcatactttggtacggatatgcataaagggactccacaaaacaaagtagttcaatagctacagacaagtaactgaagataagtttttaaagaaatcaattttcattcactgaagttagtggcagagatagaccccatggcccaaaggaatcatttcatgtcagggactagaaccaaagctcaatagaacctctgacaagaatttaaaggagtatcaaaacatcagagatatagaggaaggcatagtccatctctggctcccccactgtgacaacagtatgatactatatcaaacatattacagctttaaggggataccagccccagctgcacattgacaaaactgtcagatgccaacaaagcaagctgtttttagcagattcaacgcattacgtgaaacacaaacagatggacacagcataaaacacaagtacctacatttattatctccaaccttcaatggagcacaaagagagaatgcaaggcaaatattacttcattttaggagatacttcctctgtttcatattataagactttctagcattgctcatattcatatatatgttaatgaatctagacatatatgtgtgcctagattcattaacatctatatgaatgtgggcaacgctagaaagtcttataacctgaaatggaggtagtagaaacatttgtagttactatcaagtctggaaaagaattgacatacatacctagcaatgcagcgaaacatatgatagctctttggacagacccgacgaaagagaaatcgtttcattctgaggtacaacaggaactggaacccacttgatgcagacaaaaataatcattgaatgaatggctggcattgtggcgaggaattgaccaaagattccaggaactcccctcgcaagttcgttataaagtaatccaattccagggactctgactgtacccagattacaacctagctccatcaacaaatccattgaaagtttttgcttaacctcagtttcgtacttcaacttggttccgtagttccatatgtacattatcaaatacagtacagcagcaaataccaaaagaacccaactcccatctgctacactgcccaatactgaagaaaagaaaattaactccagccccagggagagggtgagaaaacacagaactacaatgatgttgatctgccatatcaaaagcattatgatggtcaccaagactgtagtcatcatcatgaccccaagttcagctatgcctgcaatagttaccaggcattagaaagattatgcggtagcaactgtggcactggtttcagtagaaaacaggttacttagcagccagctctccatgttaaaaatcatttgttgacaatcttaagacagtgttgttaatataaaaggaaaaatcatacaaataacaattcagtgcttaatgatatagggcatcactttctagttagaaaattaaaaaaaatgatgaatttgctgtatattttatttttgtatggagcaattcacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagattccatttcattttgtgtgaaaacaatccatagcaatcagaaaatcagatttaaaagaggtacatagatgaaccagtttatcttactcgggatagataaaaagaagacctgctgattttctgttagattttccataagaaatgcagcttgccctaggtaacccagtagcaggcatggaagaacaagaaacacaaaggtaagctgcaacacattagacatagtaagtacaaggatatgaagtgcaacattgactcttaaaacaacagaaaggactacctgaacagatttgacagagaaatagcataaatcagcaaacattgcctcagatcctgtaagaagacaaacttgttaacatctttactgttcaagtcaaaagaacagcactgctcttttacataagctataaaataaaaggacagcagcttcaataggtttagttatgacctactacgaaataaaagggcaaagacagggtatatcaagtctatatagctcgaacaaaaggaactcaacaaagagtaaagtgcacgggtggtccctaaacttgtgtgggtgtcaactaggtccctggggtaccgagctcaaaatgaattattaggtccctcaacttgtctcgggtgtcatataggtccaaacgggttccaacccgctccgtgtgctgacgtggcatgccatggtggcacctacgtgtcagtagaacccatatgtcagccacatatagaaaaaactaagaacatatttttttctcctctctttttcatttatttttcaaaattaaaaacatcattttctcctctctttttaaattttatttttttctacatgattgacatgtggatcccactgtgtggacgtcatctcacggagcgggttggagcccgtttggatctatatgacacccatgaaaagtttggggacccaaaaatgcattttgagagtttaaggacctagatgacacatctatacaagtttaaggaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaacctggtctagcacaatatcactcataaaagcatatataatgatcattaaacacggtgaagagaaattcaatgagcaacgcatcagaaatatgtgaacctgacattgctggtgtgacaacaccatccgctatcaccatagaagtaccaaaaagaacaagcatcaaaagcagcttctttagcatagatgaagtctcaagacgctccttgatcttcaaagacctctccagttctactgaaggcacctggagttggaagcttgatatacgagtatcagagcgtagttggttaggaagcagactaacccttgcattcctgcatattagcgagtataaagcaaatgtccctcctgccatagatacagaacacggtttcattaaataaaaagattaaccaaaagtgctgtgttttagtctactcgtagtgacctagtagtacataatgagatataccttctccatcatcgtttccccataaagcaatgagagtatacttcagcaatggtattagaatcagagtgtatattacaagtgagagtgccccaagtacatcctccttcgaagtaatagggtacttgttgaacattacatcgaaagcatacaatggactggtaccaacgtcaccgaagacgacacctagtgtctgaacagccagcacaatactcctgcctacggtaatttcctgaaagaaaatgcatgattgagaaatcagtagagttcagatactcatgcatttagaatgaggcttgcacctcatcgtccaagcatcatatgaagtgatgatgtttggatttggagtatcaatgtccaatgagaggtacttatcaaacaacttgcatgacaacatagaaaccaaaatactgccttcattcatttctagatgttgttttagaataagtgaacctcaaaatttaattcacaaactaatttgtatttaatatgtgaaaatagcattagtagatttcacatgaaaactactttcatttagttatttgttaatacatagtgatttttgtaaatataaaagcaaaaagggcaatgataaaacaagtgcattggagattgtgtcgatgccctaaatgacaagaaaaaaagaacagagggagcagtaatcaaaattgacaaagtctctaaaatactactttggcagataatttctagtgtgataaatttgaaaaatctatgaacactatcatataatgatagacagttttcagcataaatgtactggtaatacatgtggttaattcaatttgactacattaatggtgaagaaagaaagagaaataaaataactcgtctcgctcattcatcaccagtagtttcacttaggtgactcaatgcaccacatgctgttctttccacagcatttagtttcacagaacaatttaactctgaaaagccaaaccaggagatgaaacaaaacttttcatgtcacggctccttattcacatccctaaggttctaacttctgatctcgagtagaagacgaacaatgaattgcaatagaaatcatgctccggcacatggcgaggtatgcgtccattcatggaaaaaggctcagaattttgtcacatcaattatgcatgttttcgtggtgttttttgcaatattgtagtatacattttgtgttgggttcacttagactgcagaaaatggctaaataaaagaatgtctgggacagaaatagaataacagtccatgtgatctgataagcattcacaataaactaaaagccatgactgaacaaatattatatcgctaggtcgcaatatcacatcaacacggccatcgtgatattcctgtggatattgtagcttataaacttctcacatcacaacaaagaataagacatagatatgctatgctgctacaagtatcaacaaaaaatggagactagggtagtaattacaattcttcaaactgtccacaatctgcatgtaacacttacatcctcagatgtgtcacctacaaacaacaagattacgccgcaaaccaagaatttcactcatcgatcaataacccaaccatcaagagcatgcgtgtagcttgtggaccgaattgcactggttcatcagaaaagcattgcaaacacgttgcatccatacacagatggatacaacctagaagaaccacggtacatgctataaactagtatgattttgctaattcactaaccagaccaaccgaatgaaattacgcagtccacaccacaagcatatagtgagctcagtatgatgttcttacagcccaaaacccaataataccttatcggctccaaggctgcaatctcaattgagcagcagcgcaaagccgcctaatctaacactatcactagagtactagaccacgattgataagtgtcaggaacacgcaggcaatacatcgaacagttggcgcgcacaaaagtagaggcagccaattttaagcaaggccccgtgtttcccgtgggggctcgggcgggtgcgcgcacctggtggcggttcatgcctgcgacgtcctgcgcctcgacgtccagcgagtcggcgcgcgggccggtgcgcacgagccgctggcggagcatctccgcctcctcgtagttgtcgtcggagtccgagcagccgccgcgggagcccgaggcggccgccggggtgccgcccccgccgtcggagctctcgatctcgtcctcctcgtaggcgccgccagacaccacccaccgcatctccgccgactccgtcttccgcagcctcatcctgccgccgccgccgccgccgctggcgctgccgctgccgccgcttcgggtctccatttgggtcggcgcgggaggcgccggtggccggcgcgtgggtgtggggcactggctccgggaagcggaggagaacggcagaaggggaggatcggagcgggggagaagaagacgctggagagtgatgaaacggaaactgcagtagcaggagatagctgccgtcttcgtcttttcccctcctcatttttcacccctcatttcagtgcacttaatagtcggttaatttatgtttttattttctcccacttcttttgaaaaatactccctctgtattatcttttttgttctcaaattttttaagaaaatactgccttcgtattaaattttaatgtatgtcgtcgtttacttttttatccacgtttttaccattcgtcttatttaaaatatttatgtaattatgatttattttattgtgacttcatttatcattaaatgttctttaaacatcacatataaatactcttgtatttgcacaaaaaatttgaataagatgaatggtcaaacgttggtcaagaagttaacaacgtcatacattaaaaaatgaagggagtagtttctttataaaaatataccctacactggctccggtgaaacgaaggagaacgacagaacagagggtcggagcgggagagaagaagatttaagagacttggacacctgagtgatgaaatggaaactgcagtggtaggagacagctgtcgtcttcgtcttttccccctctttctctctctatttttcacccttctttaacttttctttaacacaacagtcggttaacttatctttttttcctacattttttttaaaaaaaatactccctccatattaaatttaaatgtatgtcgtcgtttactttttatcaacgtttgaccatttgtattatttaaaatatttatgtaattataatttattttattgtgagttgatttatcatcaattgttctttaagcatgacataaatacttttgtatttgcacaaaaattttgaataagatgaatggtcaaatgttgctcaagaagttaacaacgtcatacattaaaacattaagggagtagtttctttataaaatgtactccatattggctccggtgaaacggaggagaacgacagaagtgagggttggagcaggggagaagaggacgttggagagtgatgaaacggaaactgcagtggtaggagacagttgccgccttcgtcttttccccctctttctccctctccattattcacccttcgtaagcttttcttcagcgcacttaacagctggttacctttcttttgtccatttttttttaaaaaaatagacctttcatattatctttttttgtccaatttgtttttttataaaataccccctctgtattaaattttaatgtacatcgacgtttactttttatcagcgtttgaccattcgtatgatttaaaatagttatgtaattatgatttattttattgtgacttgatttatcatcaattgttctttaagcatgacataaatacttttatatttacactaaaattttgaataagataaatggctaaacgttggaagtcaacaatgtcatacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttnnnnnnnnnnnnnnnnnnnnnnnnnnnnnnnnnnnnnnnnnnnnnnnnnnnnnn

SEQ ID NO: 22326 - DNA, 2373 bp, Oryza sativa
  unsure (1)..(2373): unsure at all n locations
ggcgaattcgagctcggtaccctacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttaatttatcctttttccctctatttttttaaatactcccttcgtattaaatattaatgtatgtcgtcgtttactttttatcaacgtttgaccattcggtttatttaaaatatttatgtaattatcatttattttattgtgacttgatttatcatcaaattttctttaagcatgacataaatacttttgtgtttgcacaaaaatttcgaataggatgaatggtcaaacgttgctcaagaagttaagaacgtcatacattaaaacatgaagggagtagtttctttataaaatatatcccacactagctccagtgaaacagaggagaatgacacaagggagggtcagaataggggagaagaagatttttgagacttggacactagagtgatgaaacagaaactgcagtggtaggagacaactgtcgtcttcgtcttttccccctcttactctctctctccatttttcacccttttttagattttcttcactgaccgttaacacttaacagacggttaacttatctttttttgcctccattttttttagaaaaatactccctccgtattaaattttaatgcaagtcgtcgtttactttttatcaacgtttgaccattcgtcttatttaaaaaatttatgtaattatcatttattttattgtgacataatttatcatcaaatgttcttaaaacatgacataaatacttttgtatttgcacaaaaattttgcataagctgaatggtcaaacgttgctcaggaagtcaacaacgtcacaaattaaaacatgaagggagtagtttctttgtaaaatgtatcccacactggctccggtgaaagagaagagaacgacggaacggagggtcagagcgggggagaagaagatttgagagacttggacaatggagtgatgaaacagaaactgctgtggtaggagacagttgtcgtcttcgtcttttccccctctttctctctctccctccatttttcacccttctttagcttttcttcattgactattaacacttaacagtcagttaatttatctttttttgcctccattttttttaaaaaaaatacttcctctgtattaaattttaatgtatgtcgtcgtttactttttatcaacgtttgaccaatcgtattatataaaatacttaggtaattatgatttcttttattgtgacttgatttatcataaatttttctttaagcatgacataaatacttttgtatttgcaaaaaaaaattgaataagatgaatggtcaaacgttgctcaaaatatcaacaacgtcatgcattaaaacattaagggagtagtttctttataaaatgtaccctacactggctccggtgaaacagaggagaacaatagaagggagggtcgaagcgggggagaagaggatgctggagagtgatggaacggaaactgcagtggtaagagacagttgccgtctttgacttttccccctctttctcccactccatttttcacccttcgttagcttttcttcgtcggttaagttatctctttttctccattatttttaaaaaatctctgtatcatcccggcatagggcttaataggattaatagaatactcatatcaacaagttgcaacttcttttccggaagtcaatctccaaagaactccagggttaagcgtgcttggcctggagcaatttgggatgggtgaccgaccgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgnnnnnnnnnnnnnnnnnnnnnnnnnnnnnnnnnnnnnnnnnnnnnnnnnnnnnn

SEQ ID NO: 22327 - DNA, 4543 bp, Oryza sativa
catcttcgtcttttccccctctttctccctctctattttcactcttcgtaagcttttttcagcgcacttaacagtcggttaacttattttttttgtccaatttttttgttaaaaatactccctctttattatctttttttctccatttttttaaaatactccctccgtattaaattttaatgtatgtcgttgtttactttttatcaacgttagaccattcgtataatttaaaatatttatgtaattatgatttattttattgtgacttgatttatcatcaaatattgtttaagcatcacataaatatttttgtatttgcacaaaaattttgaataagatgaatggttaaacgtaggtcaaaatatcaacaatgtcatacattaaagaaggagtagtttctttataaaatgtacccaacgctggctccggtgaaacgggggagaacgacagaagcgaggatcggagaaggggagaagaagatttgagagacttggacactggagtgatgaaacagaaactgcagtggtaggagataattgtcgtcttcatcttttccccctctttctctctctccattttcacccttttttagcttttcttcactgactgttaacattagtaatatgcacgtgctaaacgctatgttgcaactcctatttatctttaataattttaaaatttttcgtggtagcaaaaaaatattattatatgaactgtgcatttgagctttaatttaatttatctcatacatcaaatatttcacatatagtataataatatgatatactaattcatgcaaatatataatacatataatccgagggcttcacgcgcttccctgtcatagcgatttgtgtccatacgtacctaatgtaataatatgattgaaaatctccatttagtcagcaataatgctcgggagtaaaattatttacacgatatgaaccatgtcagttatgttccaaaaacaccgtaatctactataaaatccataccatgcagtaaagtactattattatttttattagatacaaaatacattcgataaaaaattgtagagcagcaagcaatagaaaacgtgatccttagcacgccaacgagggatgtaactccacgtcatatcgtagttctatttggctattctttcattgcttactaaacattaaacattatccatgcccatttggagatcaacaagcaacatatattcttacatagtactaaataattgtatttgcacagtcaatcatgccatgtaaaagccaacaagatggtaaaatcacccaaatccacatcacatacttcataggatcaaacatatatcgcatacaactcttttaatgatgtttatatagtctggtagtgcagccggaaaagtttactttgcatatgaaatttatgtcaccaagtaataaataggcatgtattcaaacaacgttgtattaaaatacaagtgtgtttgaggatacaataatacacatctccatcattgtacatggtataaaataaatataaaaaaacctcaaagttgaaagagcacgtagaaaatggacacaaaaatcactctgatcatccaatgctaccggcaatacaaaattttgtgtaaaatttgtcatttaaattatcctaatcattactctgacaaaacaaagatgttatgtctaatctatatcttgaatcagtataactccagagttcctatttcgcgcagatatttaactatttgtcacttttagatgtggcaaataactatttgccactggactcacatgtcatagacacatgtagacccacacgtcattgagataggggtgacaaatagttaaatgccaaatctaaaaatggcaaatagttaaatccctaccacgccttacgctaggcgagcttgggaatcagattccattgctcccgctgttttccccaccgcatcgccacctccccattttcttcgctgcattgcctacttcaacgccacgcaacccgctcctctttccagctcctcccagcctcgcttgtacagccccctacaacagtccagcttgaggtcagacgccactcctccgcccttgttcgctgctcctctccccatccttctcctctccgtaacacgccggtgagcaccccatacctgccatccgcaaagccagctgtcgctcctatgcaactgaggcactaacacaagctcgaggtcctctttctcctcctaagctgctagcgcaggagcaccaaatagctgcctcgtataactcagaatcttcatatataattgagaaattattttgggcaagacaagaatatggtaggcacaactacgcaaaacaagcattaattagaaggcactacacaatgtactttaaatttcttactgaaaaatattgtcataaatatgctagaagctcatttaaaatttccctgcaatgaccatagaatgcatgtccaagttgcatatctagctacatcaattgaatcagacatcaattagtgtgatcatacaccagtcgctattctgtccttgcgttagatccttgcatcacgatccttgacttcgtgttatatcagaagtagagcaatcaaagcaagccgattgagacatgcaaaacataatattgatatttgtcatacagaaaattgcatgcctatacttttatcctggcattctgcaatgacaaaaaatacaatgggcaaccaatcaaactttggaaccacccatcactgcatagaaatatattgtgcatttggactccctatcaaactttttcttagttcagagaacagaatgataatacgcatgctacaatctaattcaagtgccccgaaaaaaaatctcagcaaatttggtagcaaaattcagtaaatcgataatggtcacctaattatgtttgtgcttgaactgtccaagtggaaataaaacagggaaattaactcactcatttgtcaaaatgctcaactgaaaacgataaacttgaattgccagctatatcgaaaagccaaaaacagattattcatgttagctcagcaaccaaacctatgagatacgagatttcaaacattactactaatatttaccacattagctagaaaggcgataatccatcatatttggattgattatgggaatattgaacatctgaataaaaaatgcaggattatgcgatatttggcttttgtccagacctagacaatatgtgtacaaaaaatacacctggttgaatgtgttgctccagccctcaggccctcgtgaggctcatcctgcggcaaacacacttaaattgtttgctagaagtttgttactgacagcaaaatacagagcaagcagagaccagtaggtatttcctacagggctgttttcacactccatacggccaattcatgtgaagatggtagaataaacaagctatgaatcatcaaagcatcgatcctaataccggattaaaatgtacataagtaaatttcttctgtagctgcagctatttgtcctcaatggattaacaagaaggcaaaggtgatactgaccaattatgtgataatgcaatgtatgtctgtggagtgatatgtgcaccaatattcaaccgtatcactcaatgctcagtgtcaggatttttcacgagcaccttatatttataaaactacacacaacctatatggatgcttggtgttgttcacaacagcaagcccacaaggccaaggtctgagtggttgatacggcatcatttggctttttcacatgcacagctaacagctagaccatcaatctgtagcttcagggaacgaatatataagatgtagacacagtgtagaaagcagaaaatcggaaccgtaggataaccttgaagaggaacctgtcagtcttggctgatctatactttgctgtagcacaaaatctacattgcaaaagatatggagaacacaaagatatcattcttctctcagatcaatgtgcaaactaaatttataaacactttatcatatggtatctgaaagaagatgtatgctgccccataagttgatttcaaaatacaagttgatgcttagattatcatcgatagcacgattgtaatataccctgtagctattatattccgtcttgagctgcacctccttcctcggtgcccaggaacatcttcaaaaaagcaccttccaagcccaaaaaccatagcaaactattagaatatcacaaatcccactgaaaataacaggttagacagaaaccaagaacaatcagcttatttcctactccgacaggatgtatgttgtacctgtttggaatcggcctatgacaccttgtgcgtgggtgttccggcaggggcacggaggagatcgtcaaggcggccgtcggtggcgatgcggacgggagagatcggcgcgggcagagcagatcggtgagctaccgtcggtggcgatgcggacgagagagatcagctcgggtagaagggaggatcggagtggggggagaagaagatttgagagagttggacacttgagtgatgaaacggaaactgcagtggtaggagacagcgggtaccgagctcgaattcgccctata

SEQ ID NO: 22328 - DNA, 2723 bp, Oryza sativa
cagtcggttaaattatcttttttccctctatttttttaaaaaatactcccgtcgtattaaattttaatgtatgtcgccgtttactttttataaatgtttgacaattcgtcttatttaaaatatttatataattatcatttattttattgtgacttatttatcatcaaatgttatttaagcatgacataaatacttctgtatttgcacaaaaaaatttgaataagatgagtggtcaaacgttggtcaagaagtcaacaacgtcatataataaaacatgaagggagtattttatttataaaatgtaccccacactggcttcggtgaaacgaaggagaacggcagaagggaggaccggagggggggagaagaagatttgagagacttggacactggagtgatgaaacggaaactgtggtggtaggagacagctgtcgtcttcgtcttttcccctcaaaggtcccgttcatttctccaacaagagttggatgaagataacgattttcgtggcacgtttttcaaactgttaaacggtgtgtttcgttcgaaaactttcgaaagttgttctaaaaatatcatattaatctatttttcatgtttgtgataattaaaactcaattaatcatacgttaataccacctcattttgttaaaaaacttaatcttcatcttcaccttcatcttcggaagaaaagaacaccacctttttctcaccattttttctcccttctttagctttacttcagtgaccgttaacacttaacagtcggttaacttatctttttttcctccaatttttttaacatactctctccgtattaaattttaatttatggcgtcatttacttttttatcaacgtttgaccatttgtcttatttaaaatatttatgtaattatcatttattttattatgacttgatttatcatcaaatgttctttaagcatgacataaatacttttatatttgcacaaaaatattgaataagatgaatggttaaatgttggtaaaaaaatcaacaacgtcatatattaaaacatgaagggagtagtttctttataaaatgtaccccacactggctccgctaaaatggaggagaacggcagaagggaggattggagcaagggagaagaagatttgagacttggacagtggagtgatgaaacggaaactggagtggtaggagacagttgccatcttcgtcttttccccctcttttctttctctattttttcacccttctttagctttacttcagtgactattaatacttaacagtcggttaacttatctttttttcctcccattttttttaaaaatactccctccgtattaaattttaatttatgacgtcgtttactttttaatcaacgtttgaccattcatattatttaaaatatttatgtaattataatttattttattgtgacttgatttatcatcaaatgttgtttaagcatgacataaatacgtttatatttgcacaaaaaatttgaataagatgaatggctaaacgttggtcaaaaagtcaacaacgttatacattaaagcatgaagggagtagtttctttataaaatgtaccccacattggcttcggtgaaatggaggagaatggcagaagggaggatcggagcggggaagaagaagatttgagagacttagacacttgagtgataaaacgggaactgcagtggtaggagatagatgtcgtcttcggtttttccccctctttctctctctcatttttcactcttctttagcttttcttcagtgacggttaacacttaacagtcggttaacttatctttttttcctccaattttttttttaaaatgctccatccatattaaattttaatgtatgtcgttgtttactttttattaatgtttgaccattcatcttatttaaaatatttatgtaactatcatttattttattgtgacttgatttatcatcaaatgttctttaagcatgacataaattattttgtacttgcgcaagaattttgaataagacgaacggttaaacgttggtgaaaaagtcaataacgtcatacattaaaacgtggagggagtagtttctttataaaatgtaaacaatcggttagcttataatagttggttaacatagagtttatagtacgtgcagcaacacctttataaaacataattaattcatattaagaccggcaacaaggtttttatatgttggataggaatctaggcacacatagtcaaacctaaaagagttgttaaactgcagatctcaaagttaaggatcataaaaaggttaggaaaaataagaaagcggtggccgctagtgctaccgtggtggccggttagggcaagaaattgggggaagaaggaagataggcatggacgctagtgctaccgttaacggtggccggtgaccagcgttaactagttcttggagaggatgtaaagggtgaactgaaggtttgaaagaatcgcctcccgggccacccaatggagcgacacaggagtccaagcaactagtttttgttgtaccgacatgcactaaatttatctattgtatatgttattttgctataaaatattgtgtgaagatgacaataatacaaaactctcggttctatatacccatccaagaagatactatagaacttttgattttgatttatagtgcagccatgacctgccgaaaatatgattgtatgttcaatgaaagccacgtaaccaggtgata

SEQ ID NO: 22329 - DNA, 1411 bp, Oryza sativa
ggcgaattcgagctcggtaccccaactacaatgtagcgtacacataaggagaggatggtggcaaggccatggactcatagcgactaggtgctatattgattggggatgagcgcccataatcagaaccccggggatgtaggcttcgaatgaacctcgttaacaaatatcgtttattcctgtgtcgtcatctggcatgatttgggtgataaatgactgaagcgatcgggaaggttagtcgtcgttctgctatatcgactaacttttacaacatgtggtatcaaagcagaatgtttcaatattggatcaagaaaacatgtgggggaggaaacacgaggtgaggactgcgcatcgacaggagatcgtcagccgtggcaatgagatcgatggcgacaacgaggactttgtggaggtgacgtcctcgctcgcgatcagaccggcgatggcggaacgtgactggaagacggggcagggagtggccaaaggcgttcggagagatcggagggacggcgcgcccaatgcacgcggcgatcacaaatccgcggaggcagggaggccagtgacggaagggccaaacccgcgagcatgtggcgcagcgcggcagacgtgcagggccgagaacgatgtgatcgtggatggtggacatgagggctgtgactgcagtacgtgcaagggcacgaacaacatatatggagtatgtgctatacacgaactagtgatacacgcgaggagctgaggtatatgttggtattttttaacgacattactaaaaatataattcccagcaatggcgcagaaatattcctagtatattatggttacagagttcatctgcaagcgcacggatataccattgtagcatttcactcgagagtattacaagggtatcgtatttatttaatcccgtgaaaagatcatagtagagagaacctgactaataacttatatgttacttgtgataatccaagggtagattgacacacatgcagggagctactcattctcatactaaaatatctaagctaagtgggaagaaaatagaaagagagtatattcatatacttctagtatacatagtatacatacatcctagttaactgacatactagctaataccctctatccgatgccctcctggtacttcgagaagccacccgtgactgccaagttccttacgacagcccgtcatgaccatacaaccgaggataaatacggaggagtaccctccccaggaaattaacttagaactatatacacgcgtggaggaatacccgtactgagctgtcaccattagcggcccacatctcatccgcagcatataaccccaaataatgatatcccgtaatctagacaccacgcctaaagtaccagatactactctaatatcatcgtcatgacatagggtaccgagctc

SEQ ID NO: 22330 - DNA, 680 bp, Oryza sativa
  unsure (1)..(680): unsure at all n locations
nnnnnnnnnnnnnnnnnnnnnnnnnnnnnnnnnnnnnnnnnnnnnnnnnnnnnntcctacatatgttcacagctcataaccgctattaattcaatatctgcttgtttcattctttctgcgacatagaagttccgagagtatctacaagaaggatcacatgaagcagccacatctactagcaaatgcacgtaatagtaaatgcataataagataaatagatgcaaggacctcatcagttagtacaactgcgagcttaccttaccaacataaatagtgtctattattttcataagtaaaattgcatatacaccattacatgagaaatagatagatgctttccaaacattttcgtagcttgtttagtgacaactataacatcgataagaggctgcgatattcgaagaacgtaccatgaacaagaagtattactttcctttcgtcctcatcatcaaattctgtctgcacctctgttcctctgacagctccagatctcaacaactgtctatcctcccattgagcattatcagcagtcatctgtgataacttcttgctctgagcaagggtcatcagactgccatctttacgagtctgcacccaataaaaataggtagaaatcagaatacaagacattctctacaagttaaagatatgaaaaattattaccaaataactatatttac

SEQ ID NO: 22331 - DNA, 636 bp, Oryza sativa
tgtcaagtgagcatcatcagctagtcctaattttcaccgtgcacgtataaatgtgaatccaatggacaatgcgctagctcgaaagctaagcatcgcctagcgtttgcatcactacttagaaaaagcatttttgtagacgtgagttttttttccaggcggacataaccctcggaattaaatgaccacctacaaaaatgtaaacgaggtgaagctcgctatccgcttgtgaaaatctattttcgcaggcagaccactgcaaaaattggcgtgaaatataaatagacgcgacatcactagattttttttctaagtcctatcctctcgtctccctcacctctcctctccctcagccctcagctctcctctccctcagcgaccgtgggcattcggcgacgggggcggcgggaaccgacgacggcgacgcgtgggggcggcgggatccacgacggcgaggcgctgggttggcgtcgacgacgacaaggcacggggacagtgacgctcgggggcggtgacatccacccctgacgcgccttgcctcccctatccctcctagatccggttgaagggggcagggggaggcctatggccggcggcgcggggcggacggcggcgaggcacggccgtgcggcgacaacg

SEQ ID NO: 22332 - DNA, 760 bp, Oryza sativa
aaaaaaattactatacatctatcccataatattggtatttttaggatttaaatttatccccaaataattatccaatagagtactaatgattccattcattacttcccttccattctgacctatacactatttaataagaggcattatggtttttcttctcaaaccttaacactaacaacctagaattataattttttttggacggagatagtattactttattttttccgtctattttctattgatataatttttaattagatttaatggtattataacttttatggttttaaaatatattattagtattcacctatttaaagctgcgtgccattataatttcaagaccattgaataccatgccaatataaaacaagcaggtctataatgtgcgttgaatttctcccgtggaatacgctgttttgacaatagtacgttactcctgtaaagttcagaatgaaaggtggatatccctgtaagcaaatattagcatgatacttcattttaacaacgcaaaagaaccataaacaaggataacagtcttcgtttcaacaacacagaagacaaggatcattacagcattgcagacttgccaaatgtggcgtaatcgttacattcatccatgtgttatacatgcagaatggtacatactacaatagctcaggagtcagcgtagctgtatttgtacaagagccctcgatataacaaaatcacagtacattgaatactttcgggtaccgagctcgaattcgccctatag

SEQ ID NO: 22333 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnttctaagtagtgatgcaaacgctaggcgatgcttagctttcgagctagcgcattgtccattggattcacatttatacgtgcacggtgaaaattagaactagctgatgatgctcactcgacacatgtcattgcagattattgcaccggccggccgatcgccggccgtgcgaggaagaagatgagatcagaatgaacgagccggacgtacaccgttgccgccatcgccggcgaggagagatctatagagagagagagggaggcatgcggatgaggaggtacgaatgttactgtgctggagcagcgtcatgggagatgtgaaggtgctcgcaccgacgtaccaaccacacacgcacagtgccccgatcgattcatcgctgcagtatagtactataccactgccggcatgctgcgcccccccagtagtgcgtactacgccgtccgtcctgatctcaacacacacgcacagnctctctctctctctctctctctctctctctcgggcagtgctacctcgagggctataagctaagccccatgcatgcattcatgcatacgcgcaacaagactttcacgcaccaggtgcgtcaacaggacgatattgtgtgatctatagagagagagagagagaggggtcgggcccgccgaccgatcggtcccggccttcttacaatctgtcagcgacaaaac

SEQ ID NO: 22334 - DNA, 648 bp, Oryza sativa
  unsure (1)..(648): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatttgcacaaaaattttgaataagatgaatggtcaaatgttgctcaagaagttaacaacgtcatacattaaaacattaagggagtagtttctttataaaatgtactccatattggctccggtgaaacggaggagaacgacagaagtgagggttggagcaggggagaagaggacgttggagagtgatgaaacggaaactgcagtggtaggagacagttgccgccttcgtcttttccccctctttctccctctccattattcacccttcgtaagcttttcttcagcgcacttaacagctggttacctttcttttgtccatttttttttaaaaaaatagacctttcatattatctttttttgtccaatttgtttttttataaaataccccctctgtattaaattttaatgtacatcgacgtttactttttatcagcgtttgaccattcgtatgatttgggtaccgagctcgaattcgccc

SEQ ID NO: 22335 - DNA, 722 bp, Oryza sativa
  unsure (1)..(722): unsure at all n locations
nnnnnnnnnnnnnnnnnnnnnnnnnnnnnnaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaaccttgtctagcacaatatcactcataaaagcatatataatgatcattaaacaccgtgaagagaaaatcaatgagcacgcatca

SEQ ID NO: 22336 - DNA, 706 bp, Oryza sativa
gcgaattcgagctcggtaccctaaatggtttagtactactccctccgtttcaggttataagacgttttaactttattcaaagtcaaactactctaagtttgaggaaaaaaatagtaatatttataataccatcatagtttcattaaatctataattgaataaattttcataatatattagtcttgggttaaaaatatgagtactactttttctataaaattagttaaacttagagtagtttgactttcactaaaatcaaaacgtgttaaaacctggaatggagggagtattaaaatttgttttctttctagttctaccaaaaagaaaaaagaaaaattgtttggttggtggccatcccatccacccatccgggctgactccggcccaactgctcctctctctcgcatcggggtcgctccctctctcggctctcgcgctcgctttctgtctgtctttgctctcgctccgccgccccgccttcttcgttcggcgagcgcccgccgcgttgccggacggcacacggccaacctctttctttctcgcccgcccctcgcgctttcagttccttctcctcctccgtttctaactagcgaggattagggttagccctactaccttcgcgctctttccccaacccccgctttgcttctttctcgtctcgggcgcagcacgacgtcccgttcaattaggaaaagggagggagagg

SEQ ID NO: 22337 - DNA, 636 bp, Oryza sativa
atcagagaaaccaaaaaaaaggaaaaaaaagaacagcatgttactaccgatctagcaaaaatataatctgagagccaagtacaagtactactagtgttactgccaacacttgatcatatgttactgccaaaataaatgtttgttactgtctaagagccactgagtacatgtattttccatacaaagtgggaaggcaaaaagaaaactacaatactacttggtgtcaatctacggcctaaatttctcaagaatcgcaggcaataacggtttgttgttgttcaaccgatggtagaggaattcctgccgaaagtgtgttccatcctcctccataaaaaaacaacagaagatttggttcagttacttgggtttgagtacgattaagggaaatctccagattttcatcaccgtctctaaccacaacctttgttattgtcaaaatcttgccactcttcttatctgcatggaaaaggtagaaaaaaagatgtgttactacagagcaagaaggttgtcactgcaaattaagatatttgttactagaaatgtccatggaaattaaaatcagagtcatgcacaatataggctgcatattaagagaaaaggctccgctcccactgctgtcgcgcctagtggaaaggg

SEQ ID NO: 22338 - DNA, 916 bp, Oryza sativa
tttagttcacgctaaaattaaaagtttggttgaaattggaacgatgtgacggaaaagttgaaagtttgtgtgtaggaaagttttgatgtaatgaaaaattagaaatttgaagaaaaagtttggaactaaactcggcctatcactatcacaaacaacctttaatagcagtatctcaaaatgattatttgctaatattctctccatatataacctagcatcgaatgaggcacattataatacattagtactacgaatctatccaacattagtactatggtgtgtctagatttgtaatactatcatatgtctattcagtccattatgtatcacattcaaccataatttcttatatttgggatagtagcacactattcattgtcacggattgattatatggtaaattaaatactttaagaaatacatttagttggaataaaatgaagtggataaaagttcgttaaagaatagtaagcgtggatcaaataattctgaacaataagtaaggtgaaaaagatggagcaaatattcccacgagatcatggctgatcaaggtcgtcgggtcgcaggtccagtggtggggtcaaagctgtccgtaccacggtacaataaagacaagcacggccaaagccgggtttcacattaccctttgcaggcttttcacattaaccctttccagctaatttgatttcatcacgtaggaggataacactgtccacgtcaccccctgcctgcgcttttatttgtggccacgcacgagtcgagccactagcgacgtgaacgaaagccataccacattaaaggcgttcacactacatcattacgtggtgccatcatcaccacggtggggttattacggcagctcaaattagcggatgaatcaagacacagtggtttagaactaattaagcatatcatt

SEQ ID NO: 22339 - DNA, 551 bp, Oryza sativa
tttcaactataactataactatagtataattataatataatttcactataactatactataactataatataacttgtatataagtattaactagaaaaaaatatccgtgcgttgcaacgggtaaatattattttaattctattgttgttatacggtttagctagggtaaaattcactgtgggaattcgcttggatatttattttttagaaaatcataagctacaattagtagtccatatttcatctcaagttagcatgtgagttttttaaagagatttcttatcttttttatttccaaaagcaaatgagcttaaaatccaactcaaaaacatatctgtatttctaaaaatgagcgaacttaaaaaccgactcaaacacggacgacgtatcaaaatgccggcaaaaacatcctcaacttttataagtactagaaaaatacccgtgagttgcaacggatgaatactattttaatcttattatcattatacgggttagctaggataaaatttactggggaaatccgtttgaattttttttaagaaatcatgag

SEQ ID NO: 22340 - DNA, 712 bp, Oryza sativa
cgcctcctccttccccttctccctcgccgagaaatttcgtgatccaccggccggcgagatcctctccaagctgccgcggtcgtcgccgccggtggcgatgggcggcgaccactaccagacgctggggctgcggcaggacgccaccaaggccgaggtgaaggccgccttccgccgccgcgcgctccgcgaccacccggaccgccacgcccactcccccgacgcggccgcgcgcgccgacgccgcgcgccgcttccgcctcgcctccgacgcctacagggtcctctccgacgaccgactccgcgccgagtacgacctccgcatccgctcgtcctccttctacagccgcgcctcctcctccgcctccgcctccgcctcggcctcggcctcctcctcgtcggcctcgtatgactacggctacggctacggccacagacgcggaggtggtacctggcgccggccgcctccgggcggagggggcgccgcctcggccggattcgattgggacttgctgctgaagtcggtcacgcggcgagggttcctcatcaatctgggtttcgccaggtgaagctgctcatatgcgctgatgcttttcttgctttggctgatttgatatgccgccattgcgtgattgttgtgctgatccgttacattgctggcttttctcgagggaatcattgtggaaaaagcaattgccaagttcataaataatagg

SEQ ID NO: 22341 - DNA, 1224 bp, Oryza sativa
ttttgagcaaggtgacgggaagagcacaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagtgtactgctgactggagcagcttttcttgatggaagtattttagaaatctggaagatgaataattctggggtaagtatacaccttgttagcttatcattttatttggagcaccctgcataacgtttcttcaatacttctttttttccttgcatctatgtgaattatttcgcagctcattcaattgaccctctacacttttgaacttagtgatgtattgatcaaacacccactggctattgaattgagtggctactttgcacattgttgtccataaggatgtgataggctgatagcagatttttaggcatgcaattagtttgttcatttcatcggtaattatgaaatttgagctgaataaaagcaagtaaggagggagttaattggaaactttcactagtgtactctgaaaggtctagaaaaaaatggagataaatgtgtttaccaagtaaaagcggcatcacttcgatgacttgttcatatataaaatttcaaacagcagaaacagctttgctttttcccctattggttgtttactattgaaccttgcaacttgcaaggagccaaggactgaatgattaggacacttaattaaaatctatggcatttagatttgatttctaaaacctttcattgtaattgtgtaccatcgaacactatggaagagtttagggtgtcagcatgtgattttcatttgttttatagaaagagcaaaagttttctttcaggaaattaaaccatccatgtatttaacttaacaatgctggagagaagatagtatatgtttctttattgtcattgtttttgttttgtatgttgaaaagtatctaatctgcatatataatgtttgatttcacatggattacaaactgtattgtttttctcatatagcgcctactatgagagtcagagagtgtgtgtactttcttgtattgtgtgttagtagaaagtaaagggtgacccttgtatagtagattcaggttattctcacatcctatgctctagtatatatg

SEQ ID NO: 22342 - DNA, 498 bp, Oryza sativa
actgctgtctagtgtccaccacaaaggcgttactgctgaaattggatatggtaacgatagaaaaataggagaaaggaagaacaccctcaacatgccttgcctgcatgagaggtgacttgaaagtgcacattcctgcaaatgctcctacgacttgagtatttattttccagtttgaagacaggtttttcaatgcacaagttaccattctgggacaagtcaaatcatgctaactgggtgatttttgctaagaaccatcaatattaaaagtaaaaaaaactggatggcttaggcagtaattcaatggtggcaagcgctgccatatataaacttgcaaggccattatatagctaacaagaatatacgagtgacttgtgcattcaatcaccaagtaaacaaactttcaactgacttaccaaagtcgtgttttagcttatctgtcagagtggatatcctagactgaatcttggacagctttgagcttgcatcatcatactcctt

SEQ ID NO: 22343 - DNA, 1442 bp, Oryza sativa
  unsure (1)..(1442): unsure at all n locations
atgtatgccgcgttatccagaattttttctaaaaaaagaagatagaataaatcaatatgtaatatatttattgtacaaacatgttatcagggctatggataccacatacctaatagtagttggctaaatctcgacagaactcaccacataccatgttttatacggaaacaaccttcgggtatagaaggagttccggataaggaaagataaatagagttctacatagaaacgacaaggattactcggattgtatccatattggtttccctagttctacttggaaaagggaacacgtatgggtataaatacaagaccccctaggaggagaggggggacgaaacaatagatcaagacacaagatcaacatataagctaacatgcaccaagacaagacgccggatatcgacttcagagataagcatggctagtcccctacgatgtctacggatactgtcaggagagacatagcgctgtctttgatctcgctggatgcggattcgaggaggaaggctaccctggcgtcgactacgagtcagcacttcataccgccaagtcgacaacagttagataggctaccccaaatattgtactggtgtgattatggtgaataaaagcaacgaccggcttcggccaacaggagtagggttattacctgacaattcaggggcccgaacctgtataaaaatcctcgttcccatctcatttacctcaatcttgcatatatcctaataccaacgatccccatactatgcaaataccgtagtcgtgacatcaaacgtcgacacatgtaaattcaacttggacaaaaaaaaagntgatatttctcatttatattgatctaccatgttatgtttaaaataaaaaattatttatgacaattggatttacctaaaaatgagagcgaaatctcctaatgaataaagagttttccgctattgtctatctagtacgaatatgggacatatcgagaatcatagttctatcatatacttcatccattctaaaaaaaaccaattccgtatttagggatataggatgtgacaacgaatctgaatattcgttatactatatatgttatatcatagtatgaggttggttttttatttttggcggagggagtattagctaggatatttttagttagagagagtactatagctggtagtagactactagctaggttaggcttaggtgtagaatcattggtctttttggcgcgaaaaggtggggtcgtgggcgtgcactccactaacacacacaagggtcgatcacgcgcactagaaatgggcgggattacggccacgtatatacgaccatgcacatacatgcgtcgttgcgtttcactggcatccactacgatccaactgtttaattgcgccgtgattatctatcaatctatctaatcttggctggaatttcatcgatcgaaaagccaacgagct

SEQ ID NO: 22344 - DNA, 381 bp, Oryza sativa
ttttcggaaaaagtacgaattaccccctgaaccacaaaaccgaacattttacaccttcaactatttttaccgagcaaataaccccctgaatcaatccggagtagttttacgcctacgtgtcagtcagtctagtcagtaattatttattaaaaaagtcggtggggaccacctgccagattctctctgctctctatctctttcccctctctctatctcgccgcgttgtgccgaagaacttctacatgcgctcgcccgtcggccatcggtggagctcatgggatgctgctgaagcacgcggcggcggccagcccgtctagctcgccagccgggcctccacctacttgtcggtataacatcgtatcaagtcgctacgcggtagcg

SEQ ID NO: 22345 - DNA, 1095 bp, Oryza sativa
atgtgtttatagctagcttatagcctactatttaagctgctcttagcaccaggtgaaaatacagatcaaaacaaaaataaacttcactaacaatggaccagccaaatgaagaaagacgagaagaacagaggaccacagccaacagtgggaggaaatggacaaacaacacgctaagcgagcaccaattcgtaccagttcaggagctaattcaacgttaatgttccatccaatccacagaatccgcacgcggaatgacgcaatccaactaactatccaatctactacaagccaaaaacgcggacaaatcgaatacccagatcttcagaaactcgtatgcatcgctcatccatcgtcagcgtttcttgccgcttctaacgcgtcggtggcgggcaaatcaatccatccacagtacgaaaagtactactaccaacatccacaaacagccaaacgtacctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgcctgaaaagttggcaagaacagatagatagatagatcgatcgatcgttcgtctaaaatgcaccggaatcatcggatcgaacatggaccaaatctctttctaccctaatctccctctacatatttcaaaggatgttcccaagcgcatagatgaaacttctctctcttttttgaaaaccttaaattgcggatcaagaacaatagatcaagaagaggaaaaattaaaccgagagatcgaggagggaggcagggaggggattggagacacgaatgggaccttggtgtcgagcatgacggcgcagaggatgccggtgctctccatggcggcgcggaggttgtcgagcgtctcctggtggtactcgtgggatccgtgggagaagttgaagcgcgcgacgcacatcccggcgcggagcagccgcccgatcatctccaccgacctcgacgccggccccagcgtgcacacgatctt

SEQ ID NO: 22346 - DNA, 7296 bp, Oryza sativa
  unsure (1)..(7296): unsure at all n locations
agattggttgtaatagttccctctatctaatccgtccaagcatcaaaaagggaggagctcctgctgctgcagctagctagatagcaccatcgaacagtctgtgctcctctctattactagcaactaattagcacacgcaattactacgcaattagcagtagtgctctcttcaaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacctgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcgatctgattcaattagctagttgtacagtttaaaggcgtgtgctcagaatcatccatgaaatggatcaacgcgatcagtattcggtggtgtaagtgtaaaaatatatgcatgtatgtatgtatgtatgtatgtatgtatgtatgtatgtatgtatgtatgtatgtatgtatgacaggcaaacaaattaacacaggcgttgcaacaacatttagttataataatggataaccacatcaagcataaagtcgttgaagcgtagaatcagagagtccatcaggacagggaaattgcaaggcgccagtgccatcaactttacgttgacactgcaagtgctaatgcgtagtacgtctctcatcactgctcatgatccatccatccatccaaccactccatctgcgtgtgtgtatatgtgtactactctactttatacgctacctgtttgtactcccagctgaactgaagttttataccattctgttttcccaactgaagcttcaagctgaggttttgtacatatgcaatgcaccacaggctttacctagaggatgaagctgacaagcacaacaagtaactaatctcttgacagataccatactatcagatagattcctgttaccactcatagattgattgatcgaattttcgcacggggccttgtctggtcaggaacgtttaccggccatcatcttaagatgataagagcaagcgaaatgctagtcagcctcactcacacctttgcctgccttttggttccctgccctttcatctgaaacgtcacggatgaaagctgaattatttaatggagagcgtttatgcaacatctctttcttgccttcttttttcctccatttctttatacccttcgctttctgatattcaatacatttgaccgtatatacgggcatcacgacagccgcagatatttcacttaaaaagaccttcacaagtgtaaaatggagtatacattacttaaacattagctgcaaacagcacatgcactagctttccatcttgtacctagttgatcaagctgaaaaaaatattgggcttgcttttgtactccgtagctattacacgcagtggattatttttagcagcaacatagacagtattatagcaaaaaagaaatccaagttccaactcctacacagatggaatccatctcttaggtctccataattacctaccatttcacaagcaaaaacactattctagattgtaagccaggcaaattaaggtactccatccaggtgattctgatttctgaaagactaacatcttaaacatccatgaatgcttaagactgactgtaatagtgcattatgatatcagatatctacttctgaaactactacaccataaagttcttcgacatcttatctttacaccaagacatcttgttggagaagccaacaatgcagtactaaacagttactaatgcatgctcgccttgctcggttaccagtaagaaaaaaaatgctcaatcccacaagatgactatcaatggttgggttttaatcagggattgataccacaagaagaaccatgctgcagtagcatagctaaaccacaacagaaaccagggagtaaaaagcagacgagtaataagggttttgcaaaacgcaaatggcaacagcatagattatgtatggataacgctttcactcatgataccaatcagagaaaaacacccagaattcatgtttcatttttacccaatatttgcaatacagaatccctaaactcaaggatctgtagcttcctcacctagcctggtgcgatgccattagaattgtagaaatatgtcttaggtctcatcaaaattccaggttattaaatcatcacagcaaagcaaaatcgtatatcagttctttcctcatcacaaatcttccagggctactgagcaacttttgtgttgcccctttgcctcgccaggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctcctgaaccttttcgctctcttccagaacggcacggatggcttccagctctgaaaaagcaggtgggggtggtggaggagcaggggttacggggagatacatgggaggctgcagtggccagccaggaggagccttgggttcagaagctgggagttcccttgagttgtcctggggctcttgttgatgttgtttgacagtcttcttaggcttgggtttcctggttttctttttgatcttctcgtcatcacgagcaagctggtcgattagcttggtgctaatctggatggtgtagtcacccataacagaaagttacaaacagacgctgcaatagaagtaaccaaaaggaaaccaggttgaggcatcagcatgaagtttacttaagtagtaacacaatgcagcaagcacatacacaggaggtattgaaatgcagtcgtaaaaagcgcatgttcatcatatatgttagcataatacaatgaagcacattgtgctggttgtatgtgaaggaagatgagaaacatttatacagcttggttgatactgacagagagtatggagcatagaagaagaagctgtaaactaggcatgactgtgtgccaagttaaatcagagcaaacagtgtagtggcatttatcttgatttttttatttttaaaaggaggagtcatcccctaattcaagatcatctatctttgtttcttcggctgccagatctgcttagacaattggctattagaaggattctttgcataaaaagtgcatgtgcaggaaggtgggcgagagatcaattaccggattcgcggcaacaccgcgattccgatggcaaatcctaacgtcctaaaaagtaggtaattgaagggatagttggcgaggggatcgagcggatgcttacctgagcggtcgaggtcgatggggcgacgcaggagaaagaggaacggcgccagaggaggagagcgagcgcgagctgcggcggcggcggcgacgacggcgatggcccgtcgccctagttcgtcgcggttggggttggggagacgaacagcttttcctcttcctctgccctgtctctgtgtcgggctttctacttactattattgggcttttttcttctttgggccattgcgtctctctctctctctctctctctctcncnctctctctctctctctctctatatatatatatatatatatatatatatatatatatatatatatatatatatatatatatatatatatatatatatatatatatagcctgagaccttttcttttcttcctcccaacatttttttttcttccttccaacatctttgttatggagtttttttttctctaaaaacatttccccccccccaaccttatcgtcgtcatagtactgtgtattcactcatgatattttctttgattaatgccatgcgtgatgccatcaattccattgtctcttgacatgccaagagttcagagggacgcgggagctccttaggtaatcaatcatcctatgatgaggaagatatgaatttctcaataccgtagattaaagaaatgctgaagaacatgggtacagtttagccactcgaatctagaaccagccacgacacaaacagaattcaatctgatagtaattgatactaatataataaatttgtagcaacatcaaaagaggtgttcagatttcagctgctccgtttcttggccaagccaaactaatactaatctagtggtacagattcagtgattcctccttgtataggtctaagccattccaaaaacacatcacgttgatgcatctgccttttgcttcttgtccgtcccatggaatttcctcccggcttcaaccgcctccctgtcaatcagtttaagtaatcaacttcacttgtcgcatggaataacaaacacatacacacatgagttccaaaccaatcataacgacaccctatatatgtctatgttaattgctaaacaacggaggaattcattgcttttctttgctcacagaggaaggctttactacctgaacgcgctcacaagctcgccgttctctggctcaagctgcaccccctcatagaaggcattcgcggcttcttcgaacctctgttggtatcaccggaacaacttcagcaacaaatatataggtaggtaatcacaactgcctatcagttcccaaacttatcactgaaatcaacagacctgcagcaggcgcagtgccgcgccttccctgtagcaagctttcgcccagtctggcctcagcgctcgacatgctcttgcattcttcagagcacgttcagcttgccctgcccgtagcaagcaaaggcttctgtttgaatgcaacgtggcgtcgtttgaattaactcaatagcctgaaatgtagttccattccattctactctttgaatttgagttcatatgataacttatgcgcccttttctaaaaatacacgctgtcttgcggtttggttcttacctgtgtgtaggcatctactgctactaggtagtctttatttctgaaggcatcatcacctctcgattttgcctccaatgatctctcttttgcctcagatgacacctgtacagtgtcaggaaagcaccatttgcagcaatagttagatcttgagtcttacagttattaaatagttggagccttgaagatgaataaaactataaagtaaattgcaatgcacctcaacaagttgtggtacttgtaatctgtctgctttctgagttgtagcttcctttacctgtgcctgcaaaatttattcaaccattgggatcgacaaagaacttgcaactagtaatagatcatgagaagattgaagttgcaccttttcctcgactgatttagtgtattctataattccatcaatactccaactcgaaacacctggaattggtgatgtcaaaggtaaaagaagttccacaacttcacggttattcctcaaagcagcaacctgtattggctttagtccatcctgtagaagaatataatagttattcaaccattagcattacttagctctactgctacaccaaaatcaacagtcatgtctttcagtgaaattatgcagcccagtgctgtttgctcaataataatgcaagaaaggacagatgatgaaattgcaaaagcagttgccaatccagctaaacaatacactacagggttacaatagttattcactgcataatgaaacggtggaaattttcagagtaacacatgctgaccaagaaagggatattcattatcatacatggtgtggaacaaacagcaaacgcttgacaccctcttacgaatcattttgaccaatcaatgcacatgaacctggctattgacatttaaatatttaatgatacactgagaattctgattaatgtacaacttacatcatcacatgcattggggtcacttccagctttaagtaaacaatttattatttcc

SEQ ID NO: 22347 - DNA, 899 bp, Oryza sativa
tgtagcagattatatgatcggttttttatacgaatcatagatgtaaggggtgtagaagcaacagagcatcaaacaaaaccaagaacagaaacagcatatgacaaaagtaagaacagacactttgatcctcttatcaaaatcttttgatataggtagcacacatataagaacgtgacatactatgatttgccatgcagcaatctaatcaataacacgaaaaatgagcttgtctgaacccccattgcacaagccagattactaaacaaggaaatatagcatacagaaaccatatgaccaatgaatggcatcgaagtggataatatcctaaagtaaaagcaacagattttggtattttactcttgaaattagatttgtgtacctgaattagaatatccaagcatgggagggaacccgctgcaacagcagacaacaaaggcgtaataccatcatcgttttcagtatttggctgccaagcaataactagcttcagtaaaaaagttaaggaaaggccacatgaacggctgattgaaaggtggttgagtgctaaacaaagagaagcctgtccaattcaaagaaacataatagatacagatgctattagaaccaaaagatagcatcttcttaacaatagcaagcttgagaacccttggtggttactgttaaagtgtcagttgctactagtatttgacaatattaaaaggcgacatattaaaatttcagcataatgaagatttctgaacagaatgactagaagctcaggttcgttaaatcagtgagatatgaagtgagataggagatagtggatttattgaggagcaaccttagcatcgtgttgaagcaaaagtttgactgcctcttgctgtccatgaccagcagcccatatgaggggtgtgccggca

SEQ ID NO: 22348 - DNA, 1184 bp, Oryza sativa
agcataagcgaaacaacatatttgcaaatgaaaacaaaatcttaaaatcaactttgaatttaagtttaaaattttaaattttggctgataagaataagcgaaaagataggccagtcaaaaccaggggtacttaggggttgtttggatgctatactaagtttgccaccattcaccatattttttatgccacacttgcctaaattgtggcttacaaaaagtgagccacaacttagctagcaaaattggattgtgccacgctttggtgagttgatgacatgtgggacccaaacagatgagaaggaatcttgccacaagtgtggctatgaactaaacaatagactaacttggtcaaacttgactaacatgaggtgtggcaagttggcaatctttggtaaactttgggagcaaaccaaacatcctttttacacagtgacctttgttctaactgcaccgatggggctgatgatgcatattggaggcccagccaactactgggctcatcatggatttggggaaagcccacctaaatggcatatgccctacgtgggtttacgggtggagaaagttcaaatttggttcctcattataggtgagtttaaatcatatctctcaaccgcaaaactggatacaattagcatgttcggtaagactttgctgtagcgttttaagttgtgttgtacaacgtagccgttcggctacacaaacacatagttacaggaagttgttgcttgctgctggatagttataactcctgtagctactggctggttggctgcagcgtagccacaatgctgctgtagctaagccgtccgaacaaagccaatataggagtatcttttatctttcaaaaccagtacaaatatagttccaagatgctttagacggtgatttttagctgacgtgacatccacgtgatgtttgatttggttttcatttgacatgacgtctacgtgacgcctacttgacataataagtaggaaaaaaaagtaggacctgcatgtcagttacagtaaatataatcatttttttcattcctctctatcctctctccctcatccttttagtccatatgccgtctatatctttttgtcatggcagcaggaaagattgccaactatggagctcgcttgtccccccccccctcgtgcatccgccttggacactactcgtggcgctcctgctct

SEQ ID NO: 22349 - DNA, 1014 bp, Oryza sativa
aggagggaaaagacacacgcacgccgacgccgtcgcccaccaccccctgccgccgcgccgcgcggccatggggctccacgcgatcctcctcctcctcctcctccggatctccgcctccgcagccgcctccaggccgccgctcgacaccctcggcatcccgccgcaaggttccatcttgttctttttctccccccccggatctgcctgtatctctctttcttggtgcttgatgcggttcttgatttggtgcctgtgggggcgggggtggctggctgcactgcactgcagacgaggcgtacttcaggggcggcgtgatcaggtgcagggacggatcggggaggttcgccagggacaagctcaacgacgacttctgcgactgccccgacggcaccgacgagccaggttgcttccttgctctcgcctgaaaaagattatccctttttttttgccttagctttttgcgcaggtgttctggttttaggttctcgtgtttgtgctagtagctcgaatctacttactgtaggcaatctaagagagctgtttaatcgaattgtgtttactttttgccttggcgcagggacatcggcgtgcccggaggggaagttctactgccagaatgctgggcattctcccatcacgatcttctcgtcgcgagtgaatgatggtatctgtggtaagaggattataatcggtggccattctctgtatcattcaaatgtaaacacagtaaatgtacacaaaatcaattgtaaggctagagattagggtgcttttgttccgtaaacatagtgcttgagggaattcccgctatatttttttctaattacccatatgtgtttgtcgctgcctcttagattgctgcgacgggagtgatgagtatgatagcaatgtcacttgcaagaatacgtgctgggaggctggtaaagcggcaagggataaattgaagaaaaaagtagctacatataaaagcggagttgttattcgaaatcaggaaattcaaaaggcaaaagtggc

SEQ ID NO: 22350 - DNA, 1071 bp, Oryza sativa
  unsure (1)..(1071): unsure at all n locations
accatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttntagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctca

SEQ ID NO: 22351 - DNA, 511 bp, Oryza sativa
cctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaattt

SEQ ID NO: 22352 - DNA, 653 bp, Oryza sativa
agtgattcaataactacaaatgagaaaaaaagattactattagtagtagcattaaagaggtatagtggaccactctaaaaccacacatttttaaggacgaattctaagactaaaactacaattaaaagatggagggtgtagtgcataatccttctatcccaaaatgtctatttctaggtttttcgagggagtaaggaataaaggtaaaaataccacaatgccttctttaaaacacaaaagacatgaaggaatatgtaggttagtgggtgcgaggtggttcatagggtgggtctaatgggcgagcgtgttcgcaagccgtaggcacgttccgacagcccagcccccttagcccccctccaccccttaaccctaacctattgttgttatacaggcaggaagtgttcgctagcaattgtgtgcacgttcgcgaataaggctttttggattcataggattataattgacataatagcattgacctaggaatagctatatttttttagacatgtttaaattttagaaatagctacattttaaaatgggtggagtattacagatcaagaaaaatagaaaatgccccaggaaatttattaacgagaagtgttcaatgctcagcataaataagccaaagcgataagtttatctcttaaatg

SEQ ID NO: 22353 - DNA, 576 bp, Oryza sativa
gccttaggaatcaccattttgttactacattttaactgttttgttactacatttcctgtactattttactgtctgatttattacatgtgaacttgttcaagagagctttttccctaggaatctccatgttactgctgactggttactgcaagtatttttttactgctcattggtgtatgtatcgcgtatgaaataactgtcggctgtctaagatattgcatatgagttactacaaataattagcggtttcaataacaaaggggagcggttacaataacaaaggggaggaagaaagacaaagaacaaccggtgtcgaaacaagctgagagcaagcagccgaaagaccatagcaaaaggtgcagcgtctgtcacaaaattcaaggacacaatgctagaacatgtcctagtagaagcaaaagacaaaaaaacaatcaaccgccaagcaatagatgattatgacgaagaaaaagaggaagaagaataagtgtacaagtgatagatacattgcttctgacttgtaggacatttgtaatatgttactgccatagtatataactgtgactgtctttaagcata

SEQ ID NO: 22354 - DNA, 3022 bp, Oryza sativa
  unsure (1)..(3022): unsure at all n locations
agtgcagtgttaaaaaggctttttccacccctatgtaggaggggcgtgtagcaccggacaataaaattgggagattcatctctgatgctgttgcttcaatgccaaaattgtcaccagctgcttttgacaagcttttcaatgacaggattcaggttagtgctttagcttgtcggtatgcgagtaaatgaatatcattttcaattttcttgtacataatcattgcaccatttggtgatgcaggataatcttgcactggtgtacctgtcaagcatcacaaggacacagattagcatagccgagaagttgaacaccgccgcccaaatcctgtaatttccatgtagttggagcatctgggagtctgacttaaaatgctgttttgtttgtttttcattcgcacgactgaaaaattgggatatgatggcagagtatgcatttttgtacttgttatctgaggcctaaagaaaagaaaccatcatgtttcagatgataatgtttgtgttggaggttgggtgcactcttggattagtatttcgatgtagtttaaatatttgtgttagcgctcttgcttgatttcctcgaggagcacttttggaaggtgcggtcaattttgttgtgccttcattttgaggcagagataaaccacccagatcatcattatatatcccggcgaatttgggctatcttttgggagtcacctgtagttaagttgtactcccactgtcctaaaacaacttaacctagaatgagatgtgattgtccagatagagtcacatcccatcctaggttgagttattttgtgacagagggagtaaatatgagatggagtttgtgaaataaggcatcattcaataacctatgaattgttgggacagaggtagtataaatatttgttctccaccaaactagaaatggagtatgctgaacacagttcagttgtatacatttcttatccactccacttccctctaaagtaccaatcaaagctcatccaaaaataacacaaaggctgtgtttaattccattcaaacttccaaaaattccatcacatcaaatgtttggagacatgcatagaacattaaatgtgaacgaaaaaaaaccaattgcacagtttgcatgtaaattgcgagacgaatcttttgagcgtaattacgccatgatttgacgatatggtgctacattaaatatttgctaatgacggattaattaggcttaataaattcgtctcgcagtttacaggtggaatctgcaatttgttttgttattattctatatttaatactttaaatgtgcgttcgtatatgtaaaaattttggaaaattttggaggaggaactaaacacgaccaaaatcccaatcaaagcactagtacttggcagtgatattttataaagattttgtaatcccatgtggttcaattaaagatagatcgtattctcaatcagcaagctcgattattggtggtgaatggcagggcgcaagcggaggtccacagaggcactcgttgtgctgcaggctgtacacgtacgtcgccgtcgaagctcgccacgcccgtcggcacctcgccgcagaggctgacgttgaacacctgcagcctgctcagcttcgtcgccgtagatgatgcatgttgtggctcacgtccacggtgaccacctgctccggcagctccaactccaactccaacgcgttgcgcgacacgtcgatggcctgcgcggccttccctcgcccgatcgaacagcgccgccggtgagctgacaggtcgatgcgcgccaagttgacggcggcgaactccgccgggatgctgatgctccgggagaggtggttgccgccctgtcgctggggtggcattgcttcgaggcggcggcgacgaggagagtggagagcatgaggaggagcatcttattcttagcaagcagcatttccatttccatggccatgggactggctatatattcatggggctagctaatctgatcgaattattgagtttggttaggaggattagcactgtcattggaaattaatttgcaaaagatcaaccaaagcacaagtgaggaggtcaaaattgaagtcaaatatagtatgctgcacctccatctgcatctgcatgcatgctgaccaaagatggactttgctttgccaccaggctggctgctcagctcaaagtatcagtatggacatacactcaaaagattgattgacactaaatttcactcatgttcatcaagaatggaccttaattattagcattagctgggtgcttcttcattaatttatcctatagtttttggtattgctcagtgattattactacagtacagtagtggttacagtttcaaggtctggatcaaacatcaatggcaggcggcgagcggcgcaccgcagaggcacttgttgtgctnnnnnnnnnnnnnnnnnnnnnnnnnnnnnnnnnnnnnngtgggcacctcgccgcacatcctgttgtagctgacgttgagcagctgcaggttgctcagattcgccacctgcgccgggatgccgccgcggatggcgttgtggctcacgtccaggaagctcagccgctccggcagccgcagctccgacatgtcgaagctcagcgcgttgcgcgacaggtagacgctgccgagctccttcttccccgacccgaacagcatcgacgcgtcgccggtgagctggtttcgcgacaggtcgatctgcacgaagttgacggcgccgaacgccgccgggatcctcccggacaggttgttgtgtgacagcgtcaggaacgcttgctgcccggccttgctcagcagcagccgcgggatgctcccggtgagctggttgcggctgaggtcgatggagatgagcttcgggggcttggcgaggctcgccgggatggcgccggtgagcgagttgaaagagaggtcgagagactggagcgcggtgaacttgtcgccgatgaaggaagggatggagcccgaaagggcggtgcgggagatggtgagctcccttgaggcggtgagcgtggcgagcgccgccgggat

SEQ ID NO: 22355 - DNA, 2400 bp, Oryza sativa
acgaacacgagcacgtgggcgagcaggagcaggggcccgatggcgcgcaccatttcgacctccgatcgattttgtctcagcttatcttgaacgatgtgggtgtgggggtatatatatgtagacggagagggagtaatcagattggcgagttgttcagatggaaggagtttggcgccaaccgctttgaacaaaacaatcaaacgacgcattctacaatttgtgtcctcctgccccaagtgccttgttctacttctacctgcattatttgaacacaagtgcacgacaatccagcacacaagatatttagtccctgaaacaactcagcacacaagttctattactaattcatcccaaatgcttaaaaaactttttgacttctccaattctcttgtgtctatccccatatgtatcgatcgcacggtgaaatgaaacctcttggtgttgggttgggtggtcaaacaacaacacaaaacccccaaaagccactgacagtaaccggtaaacaagcgtacaatcaaatgtaaatctacacctgtaaaatcaacaatccataatcccatattaccttcgacaatacggttcatcaacagcaggactgcaaattgctgcgcatccaatagcagaacctgaaaaggatagccacagaagaaagatgacatttagtatcaccggataatcgaacaacacattacatttaattacgggcatgtatcctcttctgctagtcaaagaattcccaaagcagcactgcagcgccaacatgattattctcattaccagcatattgcaggcctgaggcctcctcgcctctgcctaataaaacactactacccttacaggattcctagtttcaaaccagcagcaaaactcaaagctgcaagcaagaatcacagaatctgcttttaattatttcgatgaacccacttattcgatcctcggtaacaacaatgctgactgctgagtgcatcgaaccagcaaggtttaagtatccaaaagagtccatagctccaagcttctgtcatcatatgaccatcaattaggtcccggtatgttacacaactgaaaaaacaaagtaaaattggatgtcatttggtacttcattcctagcaccagccaccaatgtactgaagttttcttgagttggaaacaggaacagaacagtgtattatagaatcaaagactcaggatatctaacacatatattgccatgccagacaaatgactcatagcacatacaaatcatgattaattagtagcataaatcactacgcatgccatttgatgaagacagcaatgttgaataaacagcggcagatagtaatttgatgaagatagcaatgttgaatgtaacagtggcatgtagtttcagttaacttgcagctcgctagggctgtattaaactgaaactgagttcagcaaggaaaaccttatgcttaagaactgaattcaagtctgctgtacctgcattatgaacaccattctctagcattctggaacatgcgcagccaggggctgggaccactcttctcaagctgccaatccttgggagaccatggatattgccacatcatgaagcaacgctctgggtgtggcatcatagcaagatgtcttccatcaggggagcaaagggctgcaatgccaagtggagagccattgggattgaatgggtagacttcagttatgttattagcatcgtcacagtaccgcacaggagccaggttagactttacaacactagctagaacattttcatctgggaagaaagctctcccctcaccgtgagcactccaaatgcccattgtagaaccttccattcctttgaacatgatagcaggagaggcccctatagagacactagtaaaccggcactcaaaacgaccagattcattgtgaataaatcttggctgggacatgtccccacctgaaccaagagaacctccaacgtctgatcctggtacccagccaagaagagccattagctgacaaccattgcacaccccaaggctgaaagtgtccggcctattgtagaaattctggaactgctgtatgaggggttggttaaacctgattgatgcagcccaacctttagctgaatcaagaacatctgcatagctaaaaccaccgacaaacgcaatcccacggtaatcctctagagaagacttcccagctaagaggtctgacattgtgatatcccatggttcgaatccagcagcatagaatgcagcagccatctccctatcaccattgctcccttcttcacgaaggatggcaacttttggctttgaggatgcagtcagcagtttttcatctgtaaatttgggagtgaaagacaaagcccatgatggtgatgttctgtgctttaatccttctttctcaagtctgacacaagatttcagacgt

SEQ ID NO: 22356 - DNA, 10394 bp, Oryza sativa
tttcagacgttgtaacccctcaagctggaagcttgtttcctcccagatatccctgagatctgaagttttttccttaagatgcagcctgccatcaacaaccagctcaatatctggtgatgctgtaacttttccaattacattagcggaaatgcctcctgcttgaagcttttgtttcacaacactcagatctttcaaatgcacttcaagtagaaggccaagctcctcggcaaatagtgcttgaagaaggctagaatcttctgagtcaatgttcagcttaacaccgcaattaccagcaaatgccatctcaagaacactcacaataagacctccatcactaatgtcatggccagctgaaataagacgctcaccaagcaattcctgaacggcctcaaaggctttcttcaagtacaggacatcatcaatgtctgggcagtcatttccaatttgatcaaaagcctgtgcaagagcagaaccaccaagccggcgctttcctttgctgaggtcaatgtgcagcaaaactccatccttgccaagcttcaaatcaggagttaccgtcaatgttatatcaggacatgtcacataagcactgatgaccagatttccaggagccttgacgacctcaccatcacattgagctgccatggaaagactgtcctttcccccatcaattgcaataccaagttgaatcatgcagtcagccaatgcaacagcagcatcatacatatttgcaccttctccatcaagctttgcagcatacatccagttaccacttgctttgacatcagaaagtgatgaaactttagcccaaaccagattagtcaaggcttccccaatagcaagtcttgccatggccttgggattaagtaaacctttcgttggctgttctccaatggcacaggcaccacctgttagatcagtgtatgtctgtgcgatcacagccacatctgcaagagaaagttggagaggtccaactgtctgctgttgtgcaacaagacctgtcacacacctgtcaacttttgtggttaagaaacgcttagagcatacagatggaagactcaatactcgcttcagagcatccatgattgttactccacgggcaatatctaagggctcactgactacagagactcgcttgaattcaaaggtcttttggggcatatctcctagaaccttttcaagctcgagatcctcaacaggggttggaggaggaaggccatttaacttcgcatgctccacagcagcactgtcaatcaaaacaatctttccacatccattgattgtcccaatgacagccattgaaaccctttccctttcacaaagtgactctaaaaggcttctgctctcaggcttcaccagaagtgcatcttgttcctggtactcagcaccccatatctccaagacagacaatgtatgatcaccgacaacaattgatcgtatatcaatttcagcgcccttaggatagattatttccttcaccacattgcagtttcctccagcaccctggtcatgaatgctgatgatagggttgctctctcccatttccgcacatgccctgaccacacgatataatttctgtgccatttcagcatctccacgctgtactgcattgaaatcgagctctgcatcattttgtccactaaccatgctggaggcagcaccaccacccataccaattctgtatgctgggccaccaatcttcacaactagcatgccaatttctggatcccccttagatatatgtgcatggtcaatttgcccgattgccccactaaacattattggcttcagccactcgcgccgttccccattaagcaacctcgtcccaaaatttctagtaaatccctgaattagaggttcaccaaacttgttcccatagtcagaagcgccatcgctagcatcaataagaatttgcaaaggggaggccaaattcgacagatatgaaaaggatggatcctcccagggtgcatatgcaccttcaattcggagattaccaacacaatagccagcagtagaagcaacaacaaaagaaccctttccagtggcatgtgtgtcccttatgcgaccacctgcacctgtttcagctcctggataaggtgccacagcacatggaaaattatgggtttctgctgtgaataaaatatcaagctcacgcatcataacagataatggtgaagtggagcctggaactgttgggcgtagctgatttgctggatatccctttattgcacttgagttgtcattaaatccgatgactgagttattatcggggttagctttcaggggactcttcactaactgaaacaaggttctcggcatggtctctccatctatcacaagctttccattaaaaaaccaatgcctgctgtgctcactgttggattgtgcaatgtcgaaaagttcaacagtggttgggttccgtttgatgtcatctctgaagaggtgggtatagtacttgatatcttgttcatcaaaagcaagtcccatcttcacatttatttcttccagagcttctcttcccctttcaatgactggaacaatacggacaggttcaggaactacatctgaatgaaatgatgtgagcttcccagcataaacacactctgtcattctatcatgaaccaaagcagtaaagtcgttaagctggctttcatcaagtggaccatagccaggatccaagcataaaaggtatctccttgatctctccaagcgaggtacttccatcaatgagagagatttacatattgagacggcattggttgagaacgctgttgaaaaagtcatccggggaccaacctcaacaatgacactataagggttcctagcgacttcctcctccagaaagctttgtgcttgtaacttatcaggttcataggtttctgctaagagccactgcagtgttgcaagcttctctgaagctaatgcattatccaattgaatgttgaagcattgttcggtctttatacccacaatattagaagaaacctttgcttgcacttgcctgagcagctcaattgtctcactgtcttgaagatatggtatacgatataattgaataactccagcttctgatgcattatcagatttgtgaaccaatgaactgtcaagtcccctggaaaccaaagcaccaggagttggcagcaatcggacattaggaactgaagctcttcgaacacctggccaacaaaggtgtctatggaagcactgctgagatcttctcagtccagaactccttgcagcaatgaaaccatttctttttccctacatagagagtagacacataagaaacacaacaatgttatggggaaaaaaaatccatccagtgttgtgcaaaggtcgcttaccagattacaaggaaagccttggaagcgtaatggattgcttactgacatttcacccggagatgccatgtttgaagaaatccaaggatcacttttgtgaagaaaaaaaaaggatgatctgcaatacatggtacaggaattagatattgactttgcatgatcccaaacttgcacttgcgatgttttttttgataaagtatagctaagctcaaataataccacgttgcttttgtccaaatttaaacactaaataatcaagaagggtgctagctatacccaattgattattcctgaaagatagtgatacaaaatctgcctttgaaattattgaaagacagagtttctatagcagatttaccacccatcaagctagaaatgagctgctatggccatacatagagcatggatagctaaaagaagatgagaaggatataggaagctaaagaaagcagtggacaatcgactgtggcgtactacaaattaactttgtacacatgaaacagtatataataaaagcagaggtagaggtgaattacttgatcgaacttgaagtctattggattcgattcttgacagcaagcaacgggagataatatataaagggggaccggggagataggaacggcggctgagcggttcgaggtgtacccgtgacgcagcgggaggtggacagaaagagtaagcggtgggagggctggcggtagcagcgcgcggaggaggtggtgggctagtgggatggcggcggcggcggcggcggcggcggtggcggcgcgggaaggggcgggcgacagcgagcgagaatgaaacgagtgacgggggtcgggggctccttccttttaatcgacggctctccatcttaaactcaagagggttctccaacaaattggcctttcccttccgctaatcgtggatgggccttgatatcctctttagatacaacagtgtttattaacgggttttctctattagcttataacaagaaataaatttggtgatgtgaaagagaaaaggaaaagaaaatatttttactacgcatgacaatgactcaaagggcgaagaaaagaaaagaaaagaaggatgataaatgttgtattaaaggaatttttgttgtacaagggtggagaaaagaaaagaagaaaaaaattattccggtgcattaatggttaaaagttcttgttatctcaaatagaatgttagtctctagtgttatgtatcaatacatacgacccataacagactctatctttgtatatgctattacatctgcccaacacaattcactaattctcgtcctgtttgtcagaatttcagatctcaaatcacgatatatttaaagtttttacgctaaattatagtgatttaactttttaaaaataaactcatctaaaatgaaaataaaatgatatattaaacgttatcaacgtaaacgtcgatctgcatccatagtttttgaacctaagaatacccagctttgacaaatcttgggatccaaatctatgccaaagatgtccatataaacgtagcttcatactcttagtatgaatcagacattatttcccgcaggcatctcaaccagggctgaaaatttcggactaaaatttccaaaatttcggtcattttgaacccctctaatacgatattatttcggctgaaaatttttagttttttgtgaattttggtaatatttgttcaaatttaactaaattttgttcaaaattttggtatatcagtgacttccgatcaaatcggttaattcgaaaaagcaaaacctgatcccaacctttaaaacatactccctccgttataaaaagaatcaaatcctatctatgaattaatctggataacactacgtctaaatttgtagctaggaattgatttatttttgaaacgaatggtgtacatactatgtgttggtggcctgagataggtactccatatcaagcacgaacaaaacattacatcacgcatgaacctgaaccgatcgaaggttcttatttatatactactcctagcttgctttgctttgctaggattattcgattactaattgcaagcagcaaattaagactgcattaattgtaggtggatgattatggtcctcatatcatataggagtatatcaatgggtgcagtgagaaagcggcgcgccgcagaggcacttgttgtgctggaagcagtaggcatcgaagctgggcatgttgccgccggtgggcaccacgccgcagagcctgttgtagctgacgttgagcagctgcatgtccgtcatgttggccatctgcgccgggatgctgccgtagatggagttgtggctcacgtccaggaaattcagctcttccggcagctgcagctgcgacatgttgaagctcagcgcgttgcgcgacaggtacgcgctgacgagctccttcttccccgacccgaacagcatcgacgcgtcgccggtgagctggttgcgcgacaggtcgatctgcacgaagttgacggcgccgaactccgccgggatcctccccgtcaggttgttgtgggacatcgtcaggaacgcttgctgcccggccttgctcagcagcagccgcgggatgctcccggtgaggcggttgcggctgaggtcgatggagttcagcttcgggggcttggcgaggctcgccgggatggcgccggtgagcgagttgaaggagagatcgaggattccgaggtcggtgaacttgtcgccgatgaaggacgggatggggccggagacggcggtgtgggagatggtgagcaccctgaggccggagatgttggcgagcgcggcggggatggggcccgtgatgcctgggaccttgaagaaggtgatgtaccggaggcgggtgaggccggcgatggcgtcgccggggatggtgccggtgatgttgtcgtcgcgtgtgatggcgaggttgatgacgcggtcgtcggaggggaggtagtcgtcgccgcagtcgacgccgtaccagtcgcagcaggggaattcgggcgtccagtactcgaaggaggcgttgttgaaggccgccttcacggccagcagagcggcgctgtcgtcggcgtggcagctcggccccgacgccgccgcactagtgcagctcaacgccgccaccgccagcaggagcaggacgacggcgcgcgccatttccatccaatataatcttaatctttcctttccttgctgagttaatttatatcctgagttggttgttggtacgtgtagtaagtatatatagtcagatggatcgagtatgcagttttggcgccaaccgctttgacttgaactcgttagtggaagactcacaactcacaagtgtgtgcgtgcttcctctcttctatctgcttgtttacttcgacgacgtcccccaggaatctcaagatgggccggattggcgcttcttcggcccaaaccgagtctactgccgccggagagaacttcaaggcccacgacctttcccgcttcagccgtctgggtctgggctggaggagcgcacttcaccctcgagtggcccagctttgcagcctggccagccactcagtgcttcagttgccgccgccatgtctgaggccgactccgccggcgacatccatccttgggaagaggcctcggcagccaagacaccgctctcgcccagctccctacacaccgccatgggcgcaacgcgtcgtgatgaaaagactcggcgtcgtcgacaacgagaacaaggttgaagagcaggacctcttgcggtacctggagctgtttaaatcacccctcgcgccgtctcatgtgcaggcacttgcggcgctgtgcagcgtggcgatccctgtctgcggggcggcctgattgctctgttttctggtggtggaagcccatgagtctctatgtcttgtagtcttttagtttggaatgttaggggcaaaaggtccctagtagctgatgttgttagaacttctagtgcgtccattttttgttgtcaagagtctaaattggctgttttggaccagcggttgcagaaccagtcttgtggtcctgtgttagactgtgcggatttcattcctgctgatggaactagagggggcctgttcacggcttggaggagtgatctcttctctgtttcttgcctgcataaaggaaggtggtcgctctctctctcagattttgtaatttggaaggcttaccaatgtctacgggccgcagtccgacggcgacaaaatcctttttctagaggagctgctggtggttggtgactttaacttgttggcctcggagggtgacaagaacaatggcaatgtgaatcgcagactgattaacaagtttagacaaactattgacgttctggagctccgtgaagtttatcagttcaggcgccggtatacttggagcagtgaacaagagcagccaaccttaaccaaaattgataaagtgttgattaatggggaatgggaggaaattttccaggatgcccatttgcaagctctcagttcgtccgcttccgaccactgccctctgcttttggcttgcgataacatgatgcaccgtccgagaaagtataagtttgagtctttctggaccaagctagatgggtttgaggaagtggtccggcaagcttgggcggctgcgccgtcgggctccaactctgtttcctccctccatctcaagttgaaatctactgccacatctcttcgttcgtggggggctaggcgaatcaacgaacttcggcagcagctcgcagtggctcatgaaattattcttcagctggacaaggcccaggacgaccggcttctctcggcagaggagcgatcgctgcgtgctaccttgaagggacgatgccttgctctcgcctccctggagcacattaggctccgtcagcgagccaggttgttattcctcaagcatagcggcacaacggcacaattttttcgccttaagatcaatgcacgtcgaagaaagaaagcaattcctaccctctgtcatgatggtgtctatgctaccactgaagaagataagctacaggctgcatacaactatttcctcaatattttggggacgcgtggagagcgaattcccagcacctacatctcgtcaacacagcttccatcatcctcctgcccaagaaagaggacccgaatcaactaactgacttttgcccaattagtttgattcacagtttcgccaagatcctgaccaaaattctagcacttcgtctcgccccgagaatggatgaattgatcgggcctgcacagtcagcctttattaggcgcagaagaatacaagagaacttcctctacgttcatggtgtagttaaaaagttgcatcggtccaaaacgcctgccatgctgttgaagattgacatcgcaaaagcttttgatacggtatcttgggaattccttttggagctgcttcgacatttgggcttcggcgctcgatggcgtgactgtgtttctgctttgcttttcacttcgtcaaccaccgtcaccatcaatggtagagacactcaaaggatcaagctagctcggggactcaggcaaggggatccactctcgccgttgcttttcgtcattgtgatggaggcatttgcggctctctgctccacggcagcgagccgtggcgtgctttccccacttgctacgggttccttgccacttcgcgcctcaatctatgcggatgatgccatcatcttcttccatccttctcggcgggacgcgctgatgatccacttcatactcaagttgatgggtgacgccaccggcttggtttccaacctagccaagagctcgttgaccctgatccattgcactgatgttcaaattgaagaggtcacagaggtgttgacatgcccaatcaagcaattgccgattgtttacttggggctgccgctttctgtgcgtaaaccgacgaaagtgcaaatccaactgatgatggataggcttgccaaaaatttggctggctggaagcccaagcttttatctccagatgcccgtctagccctgatcaagcatgtgttaatggcgctcccactctacttcatgtccgtcttggaactaccagcctgggcgatcaacgaaattgagaagaaatgctggggtttcatttggaagggtgatgaagatgctgcgggctcttgcagcttggtggcttgggagaagctttgcctctctatcgagcaggggggactagggatcagaaacctacgcctaatgggaattgcgcttcgcactcggtggatttggctgtgccgcgctgagccagagtgttcttggacgcgcattgcacctctagctgacagaaagtcactgcactgctttgccgctagtagcaaagtactgctggggaacggagcctctacctcgttttggtgcgatagcttgttgccagacggaggatcagtgcagtacagattcccaattcttttctccttcgtcaagctgagtgacatcacagtggctgccgctctctgcaacaactcctagattgcagatattaggggcggcctgtctgtccaagcgatggaggaataccttgcgctcgggtacgtgatcgccggtgacggagcgtggggctcctcaccgagagaccgcgcgggccccccttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtccttttatatctcaaggggatcccacctgcaccacttctacctactcttcttttgggtggggactcaccctatcttcccaaaaaagaaaaaactggcttgcgccttcgcctggaagctaaatcacagcttgtctttgagtgaggcccagcgtcatcactcgcctgacaccggggatctccctattactccctcattaatggg

SEQ ID NO: 22357 - DNA, 6185 bp, Oryza sativa
agcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtatatgaccggtcacacactgtgacctgtcacggaccgaacgagtgtgctgcgctgcattaaatgcggcgtggggcgctcgtccaacccacaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacagtagcccccggcgttatgccagggcgatcgccctcctcgaggaaagcgctcgggcgtgacgccacttcttaggcctggtgacaggtggggccggtctctacaggcgggcaggaatccagtggtcgcaaatcgcgcgcatcggcaagggaaaaaccgaccgataataatgagcggctttcttcaagaccgctacattacttgagtagcgcgcgaattgggacgagccggttcgtttcgcctggagatgtgatgatggtgcatcggtcggcgagcgtagttaacgtgcgcacgatatatgccatctcgactgccacggccgcacatccgcctcgtgcgccgcaaacgggcgagcgggattagtggaggagtgggcgcgagaaacgagggggcgagatagtgggcgcgggaagcgaggagccgggcatagcgttggtaagggtataaagacgccgaggaagagattcgtttccttcctctcgccattattccccttgccttcgccgcttgcgttctaacttctcgtttcctgtgccctaccttcgccgcactcactcgctctcaagcccctcctccgccggtgtcatggcacggggctccgcaccgctcgacggtagcgtgctgccgccttctcgcatcgtgagcgagaggcaggccgggctgccgcgccgattcatgccggaatctgccaccggccgggaggtggtcgcgctgggtgagggacgcccggcaccacactacccggggcggtccgtattcttcctttccttcgcaatggcagggctggtcccgccattctcttctttcttcatggatgttctggagctttataatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtttgcgatcccaggggctcacgggggccatggtgtacggcgattaccttcgtcgccggatcgcgccgctccagcggtgcgcccggggcgcctgggagttttcactcacccgtttttcgtcttctggtttttcttctgcctcagcgagatcccgtcgcgcccttcccgccattccaagtccggccggtctgaggccgaggagacggcgaccgcggaggcccggaggcggggagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcgtacgcagggcggcctgccaagtccccgacccgactccgcccgaggcaacgacgacttccgaggccgcccacgacgaggccgcgggcgcgccactcgggcccgacccctcgggcgatgcttggggcgagccagcctcggggaacgcccccgagtccggcacgtccatcggcggaccgagccgcgcggcgcccacaccgaggcggctctcccctctaccttccgctgccccactgagcgcagaacccctcttgcaggccttggccgctgcgaacaccacggtgttggacgggttaagagcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcggagatcgccagggaagtggaggacgagcgggagactgccctcatcgccaccgccgtgttcaacgcggtgcgggacgacctctgcctcctatacgggagccaggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcaggagcgagctctcgaggaggccgaggctgcggcgcagcggcgggaggagctggcgcgcctcaatctggaaggcgcccgcgccgagagggccgcactggatcagcgggccgctgaattcgaggcgcgagcgaagaagctgcacgcgagagcgtgcagcggtgggccggccacgggcgacggcgacctagccgcccgcctcgcagccgccgaacacaccatcaccgagctgcagggcgcgctggactcgtccgccggggaggtcgaagccctccgcttggcgggcgaggtagggcctggcatgcttcgggacgccgtctcccgtctagaccgtgccgggcggcaggtgggcctctggggcgggcggaccatgaaatacgccgccaaccaggggggcctcgcccagcgcctctcagagatggccgggaccctccagcggctccccgaggagctcgaggaggcgatcaagtcatcctcgagggacctcgcccggggggcggtggagctcgcactggcaagctaccaggccaggaaccctgacttctccccgtgggcagcgctggaagagttccctcccggaaccgaggatggcgcacgtgcgagggtccgggacgccgccgaccacatcgtccacagcttcgagggtacagcccctcgactcgcgttcgcgctcgactccgacgaggagggcggtgacgacggcgcggacgacagcgacgacgaggccgacggcccgggggcgtcggagtgagcccccaggcccccgccaatcttaataacttttccttcttcttccgaggccttcgggcccccttcttgtatagactgatttaatctgtaatcaagtaaagaggaaatttctgcgtcagttaagtttgttgtgtgtatgagacgaggatggtccgtgccgcggtccttctgtgtcttggcttgaacgagggctcgtgcccaggtcccaacctcaagtggcgcgggtcggggctagtgcctggggagatccgcgtgtcgagactggccaggccgggagcgtggtgaccgagggttatggatgacccgattgtgggcctttgccgattccccccccccccggagttcaccacgccccggggcacggctcggttctgggccccgtttggcgattttagccggcccgggccaccgagggcagggtcgggcacgagcgtgctaattcaagccaagattcttcaaaaggaaacgatagcatagacacaatcctcaggaaatcgaaaatgcttttactgaaatacggaagagaaaaaagataaggatatgcatgtggtagcccccggccaaccctgcacgcccgggggggcgcggggttggcccgagcccgagacctgacaaccgacccccactaggggtagaagcgacgaaggtgttcgatgttccacggattaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccaaagcaccgctggcaactcctcgatccacgagtcgccgtgcttcttgaggatgttgaaggttttggttttgaggcccttgaggatttccgcgttggcgcgctccacttggccattgcttctggggtgggcgggggaggtgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacaccttgttcccgaggaatgcacttcaggaggactccgttagccgcgcgccgatagaaggtcccttccaccagcacgtagcgcttagagatgcgctggacgcgttcactcccttcgcggtgctcgggtagagtcttatctgcgaggtacgcctggatttcagtgatccaagcaatcaatctaggggaactgggagcgctcccctcgggtcccgaggcctggactccgacgggcctcgggggccgttcaggcgcgtccgtctcccctagggggtcgggtcgcgccgacgactgggcaagcctttcttcaaaggcgcccggtggggtctgggctcgcgaggaagcgagccttgagagttcgtcggcgtccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgcttggcgaggtcaacgtgacccccgcaccggcgccctaaagagatagggagccgtcgaactacatcacccagtaggcggtgtgaggcagctgcgaggggcccgagctggcctcggggacggagatgggctcaggggctggggtccactccgccacaaagtcggcgagggcctggctcttgat

SEQ ID NO: 22358 - DNA, 1856 bp, Oryza sativa
catttcaccacccgtccagtaccctttcggttatgcaagatttggccgagggggtaagacgtgaccaccgtgacccgatgcgcctggaaataatggcgcaacttcctcgaagccatcagaatagcgtaaagcatcttctgggcctgagggtatcgggtcttggtgtcccggagggcctcactaacgaagtagacgggccgctgcacctttcggcggggccgatcctcttcgccaggggccgcatctccagggcgttcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccattcggctcgggggcctctcctgcctgctctctcccgggtcgagtcgacgcagggtggggatgcacggagtgagggttgtcctcgttgcgctccacgaccaacgccgcgctgaccccatgcggggttgccgccaggtagagtagcaacggctcatctggctccggggcgaccaggactgggggagaactgaggtacgccttcaactgagtgagggcccgctcagcctcctccgtccaggtaaacggcccggagcgtttgaggagcttaaataggggcagtgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgctttgggaacgacgaccgggttcgccagccactcgggatggataacctctcggatgaatccggcctccagaagtcgcgccacctcctcgcggatgaagtcttgacgttccggggcctgccgccgcactttctgccggaccggccttgcgctcggccgcacggcgagacggtgctcaatcacctccctggggaccccgggcatgtccgccggtctccaggcgaagacgtcggcgtttgcccgcaggaaggagacaagcgcgtcttcctatttgccgtccagaagaccactgattcgtgtggtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgcgactttgaggttgccatggacagagatggggccaccggggcccggcatcttcat

SEQ ID NO: 22359 - DNA, 24182 bp, Oryza sativa
  unsure (1)..(24182): unsure at all n locations
ctatgaggacacgccccaacttcacgttgcaaacggtgggggaaaccaccatcgcgatctgtcctccccgggcaacgcacggcgggtggtcggtctgggggaaggtgagggcaacctccgaccaccgcgtctgccgcgtcgcctcatgggtaggggccgcggccagaagctctcgcttcatggccttgaggctccgacgagaagcgtgagcgcacgctcccccatcgacggtggcgatggtggcccccaggctcctggaaccctagatcatcgtcgccatcgtcgatgtcctcggcgggggccttctgcttggcctcacttcgccggttgccggagggagccgccggggccttgccctcacggcgttcttgcctcctctcctcctcccacttcctcgtccgcttagccaaacttttgaccgcgcggcagtccgcgaggtcgtggagggaggtgttgtgcacggcgcaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccgacctctttttcctcctcctgtcccgccgccctaaccgagcggcggatccgggggcggccgaagctgccacaccggaaccggtggagttccaggtccaggcctcctccttgcgagccacacggtccgcgagctgaaaaagctctgcggtggtctggggctccttggaggcgatcttttcgagcatgcggttgtgccgcacgccccccctgaacgcgtagattaccgcgtgtgcggggatgcatggtatggtgttgcggacttgacagaaccgctgaatgtacgagcgaagagactcatcgtcccttcgctgtaccgcatgcaagtccgcttcttcacctgggcgcgcatatgtgccttggaagttcatggtgaactgctggcacaaatcctcccaagagtggaccgacgcgggcggcaagttcattagccaaccccgcgcctgtcccttcagggccatggggaagaaattcgccacgaccctgtcgtcacccccggtggcctcgatcccggtcgtgtagacctggagaaactcggcggggttgacgcttccgtcatatttttcggtgatggtgggccggaaccttgggggccaacggacgttccgaatgctcgccacaaaggctcgacagccgacaccaccaagcgggggcacggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggcgcccctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgtgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctatggaatgtttcgtgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactagcttgcgccttcgcctggaagctaaatcacagcttgtctttgagtgaggcccagcgtcatcactcgcctgacaccggggatctccctattactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtatgtgaccggtcacacactgtgacctgtcacggaccgaacgagtgtgctgcgctgcattaaatgcggcgtggggcgctcgtccaacccacaataaacgcggttaggtgagcgccgctgtgctcacctaacccacacacgtggcgccaaacccacagggggtcggggcgccccagccctcggggccgaaacgggagcggcctgacccctcggggagacaaagggaggggcggccacatcaccctcgggcccgacccccccgagggggtcaggccacgtgggtgactgcagctgccccaaacctctagtcaagatacccccggtcccatgtcaccgacagccgggatttctctcgactccagaagtacggactctatgatatggaaggcggcacctaatggtgacttctcggtgcggtctgcctactctattctttcggccggtagaacatcctgcccgctcggcaagattatctggaaatcccacgcaccagcaagatgcaagttcttcatgttccttgcggtccgcaatgcctatttaacagctgataacctgcagcgccgaggctggaagcttgcaccaatttgtcacctttgttctaaggatggagagtcctgccaacacatcttccaagcctgcaccttctcgcagcaagtttgggtgcaggttcaggctcgtttgaccctctactgctcgccgccgtcctcggactttgccggctggtggctcgctgcccggcaaactgttgcgaagatcgatcgcaagacgtttgacgccggggtcatcctcgttacatggttgatttggaaagagcgcaacgcacgggttttcgagggaacggcctcgtcggtcacgcagttgtgtgcgaccatgtgtgatgaatgggaaacttggaaatcagcagggctagttacctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagctcgccgcagaggcggttgtagctgacgttgaagtcctgcaggctgctcagcccggccacctgcgccggcacgccgccgtacagcatgttgtggctgaggtccagcgagctcaccccttcctgcagccgcagcccggtcatgtcgaagctcagcgcgttgcgcgacaggtccatcacctcgaacgccacgccgccgtactcggccgggatgccgccggtgaggttgttccgcgacagcctcaggtaggcgccgccctgctgcgtggtgttgagcttgctgaagagcgccggcggcagggggccggtgaggcggttgcggctgatgtcgatgccgctgaggaaggggagggcggcgagcgacggcgggatggcgccggtgagggagttgaaggagagatcgaggagggtgaggctcttgagcccgccgaggaaggaggggacggggccggagacggcggtccaggagatgatgaggagggagaggcggttgagcttggcgatcgccggcgggatggggccggagatctgggggaggtggtgccacgtgagggtgcggaggtgggtgaggccggcgacggcgtcggggatggtgccggtgaggttggcgtcctggaagacggagaggccgacgacgcggtcggtggtgtcgtcgcaggtgacgtcgtaccattcgcagcagaggttgtcgggcgtccaggaggcgaagtggtaggggtcgccgagggccttcttgatggccagcagtgcggccttgtcgccggcgttgcactccttcttcttcgtggtggcagcggcggcgccggccgcggcgagcacaagaacgacgaccatggcgcgcatcttgttcttgtaggatatcgtattaattaggtagtagcctccactccaatttagttgggcatttcagtgagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtccaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatcatcctttgacatctgaactaatctgtcagatattagctagcttcaaaaaatataatcttttaagatagtcagagtataagacttctataaatgctcatatttctagacaaagggagtatctatggtggagatgatgcgtatggtacaaatgacagaatgatcattttcccattatctaaaatttatactatcccgtttcatattacaagacactttgattttttttccccttagtttgttaactttacataagcacacgcatgtttagtgcgattcaggcattggggggggcctagttggggcgtgcgcgccccccacgcgcgtttcgggactaaagataggaggtatagttaactaatcaattaattagttttagataattatagcttaagataatgacagtagtagttaggattttctttttttcacaagattttttaactaacaaattgaaaagaaatctatttctgaagtcaaattttcaaaattttaaatccagatttgaaaattttaactcgaaatttgaatttttttttaagtcaaattttaaaaacttttaacttttcatctcacatttgaaaaactttcaactcgagattcgaaaattttcaagtccagatttgaaaattttgaaaactttcaactcgagatttgaaaactttgagctcagatttaaaaactttcaagtccagatttgaaaattttgaaaactttcaactcgagatttgaaaactttgagctcagatttaaaaactttcaagtccagatttgaaaatttttagctcgagatttgaaaactttcaagtccaaatttgaaaatttttaagttaagatttaaaaattactagtaaactaatcagtagtaaaaataggagactaatcattactccctccgtcccacaatataaggggttttgagtttttgcttgcaacatttgaccactcgtattattcaaattttttttgcaaatataaaaaatgaaaagttgtgcttaaaatactgtggataataaagtaagtcacaaataaaataaataataatttttaaaaaaattgaataagacgagtggtcaaacgttgcaagaaaaaacttaaaatctcttatattctaggacggagggagtagtaaactaattacgattttttctcccgtgtggcagaaaaaagaaaaaaaaaaggaaaaaagaagagacggcggtgcgccaaaagaaaaagaaaaaagagagagaggcgtgcgcgcgtgcgtgcatgggccgtgtgggccggagtatgcgccggcaacgcgcgcgcggggattagcttttccgggcatcgggtaccctaggccattgtccgaagcctggcatcccatggccttgtgggctgcttttttctaccatggattgacgactatcaaggcccaacccgtaatgggctggcccaggttatggcccaatcctagctcatataattagaaatagatttgctagaaaactttcagataagatctcagtactatgtaaccaaaccattgttgaattcaagttttattaataagttatatcgtaattacattgtagttagtacaatgtaattacacttcaattatactacagatacatctgaaagtttttgaaaaaaaaaaacttgcgacagttttttaagatactcccgttagaaaacttcgtatttgctggtacaatcagttttattgtgtgttgtaaattaagttgaatgaaacacatttatagtagcaatatccactccaatgttcatctttcaagtacatctggaactataatataaaagttggctgattgattgatcatattgcaagacgacatgaacattgttctcttcacttacactcgttctccgtacattaccagttttccagtcgtagctagcacagtacaatactcttaattactagtaggatttaacaaggagttcagataattaattttaagtagcgattagatgtagtttagttgaaagtttttatataaatgtttttgtagtattatttatcgacaacngcaggcggtggcgaggggagcgccccaaaggcatttgttgtgttggtagcagtaggcgtcgaacctgggcatggcgggcaccgcgccgcacatcttgttgtagctgacgttgaacgtctgcaggttggtgaggttggccacctgcgccgggatccccccgcggatggcgttgtggctcacgtccacgtagtacgtctcctccgcgaactccacgccggacatgttgaagacgaagccgtttcgcgacaggtccacgtaccttgcccgccggaacaccgccgacgcgtcgccggtcagcgcgttccgcgacaggtccaccagcgccaggttcgccgccgccagcaggtccgccgggacgctcccggacaggttgttgtgcgacagccggaggtacacctcgtcgtcgtcgtcctgcagctgcaggttggagaagaggcccggcgggatggggccggagaggcggttgcggctgaggttgatggcggagagattggtgagggcggcgagggagggcgggatgaggccggtgagggagttgaaggagagatcgagcatggtgagggaggtgaggttggcgaggaaggaggggacggggccggagacggcggtccaggagatggtgaggtgggtgaggtcggtgagggcggcgagggagtcggggatggggccggagaggctgggaaggtggtgaaggaggagggtgcgaaggtgggtgaggttggcgatggcgtcggggatggcgccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgcctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgacgatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaaggatcacagcagacctctatagaccaggatgattaaggaatatcaggaacccaaaaaggtaataaatactaaatacaacattcaggcaatgaccatttgatggttcggaatcctgttctgaaggaacaagtgcacactcattttttctgggacaacacaaattgcttttctagactcactccccatgatcataaattaccaagggctagaaacactagcccccatgttaactagcatgcacatcacaaataacaaattaatatcatcaaatagattctgatcatacttctgtaagaaagtggtacctccaacacttgtattggatccaatgattccccatggttatggagaagtcgaacggctgctgtaaacatgggtcctttcccatttttggggtccagatacaaatccaacagcctgagttcacaggaagatgtagagaatatgaactaaggaccaaggtcatgatgcatgaaattatgctagtaatactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacaaaatgagctggcatggaacgcgagaaggaagaaataaattgtataatcaccttttccagccatagctcagattctgaaatcacatatagcacttcttctgggtcatacaaatctgacgattgcaaaaaaaattgcaacctttccctcaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatggaattgatccaaacaggccccccttggttacaactattattgtcagcatttactcgaataatctggcatggaaagacaagatcatcaatcaatcgtatcaatgttcaggtcactctacagtggtgatggatcccaagataccaagtaattagtaagaagcctgacaaactgctattagttcattgtttatgatcatgcaattgtataatgaacaaacttgcacaacgtatacccataattcactctgttactatttaacatttttttaacaaggatcattggaggatcatcatggaatcttgagttctaacttgtaatgattttgtcgattcattatatgtacctttggtgaatgccaaccttctctggatcaatggcagcaacaaccttttctgtagaataacaatcatccagaataaatgttaacgcatgttagttacacccaaaaaagtttcctagcagccctaagtagcaaacacaattttctggatgcaatataggctgatatagtgaaaatattgttagttctaaaataggagaaagagagcccatcgatccatgattacatatgcctactaccatccacactatgttatatacacattcataagtcaaaaggagaaaaaaaactggaaattgtgttgatctgccatggataagccataaaaggcacactggtatagtggtttatctaaaacaaagcaattaccaggagaaagctgtttttccctcatttcagatgttaaaattgcagttgcaagctcttgatcaatgtctgccacctaaacgcaaatagtcagtagaagtacacaaagtggaacagatcattgatcatgaagtccttagtgtgaagtaaatacccatccaagatgctccagaacaaggtcctgatcagatgatgcttgaagtatcttggaggcttcaacggcagcaatttcctcaccagacattttaccaacagaagtttcaagagagtcagtttcaggtaggattgcatgatccttccacaaaccagtgctgtaattccttgctaagatacgccagataccaagggatttggagcacattcctttactgccatataagaatgcaagcgtccgcagatgtccagagtcatccaaaagtgattctagttcctcctgcaccaccatagtatttttattgtatcttttttttaatttgaacacataagaatatcactgaactatatgtagttatgtactgttctcaaatgaagagttaatgtcgatttaagtatcgtaggtgtgtaacagtcttaaacgcttcaaggttgcagatgtttaaaggatttacataccacaacacagctattctgagatgatgcaagcttctccatgtcatcaacaagattgagagctctataaagatacatcagaagagtatcaaccccttccatctctgaagaagataaatccttctctcgggatgcacacaggtacctagtttcatatagcattcagacatcagctggatggagcagcttatttgcaattcgtaatgaataaaaaatgtcgtgaatgagcaaacctgataatatttctgattgctacttccagcagatcagctctgcttggtggatttgaaaggaaatcatcatccacaactgtgtccacacctgcctttttgagaaacaatgcctgttgaagtgttactagcccatcatcaataacttcttcaagaggctttgggggagcatgcaagccccaataacgctttcttggcacctaaaatttacaaagttcacaatcagataaaaaactgctgaatacaaaaggcagccagtcatagtggaagatgagcagtttgtcttgagaacttaatcagtatgttaggtgatgaaaactacagattccatttgacaattacaaaaatatgttgacaaattaatctagcagatcaaaacttaacagatgtgcctaccaatataagctttacgctcaaatttgaaggaaccagctcatgttgatactcaagaggaacgggttcatatatcaagaaattaataaagtcttatccattgaaaaccacattaaagagataaaagaagttgcagcattcaacatgaacttttcacatacagaagaaaaggttaagagagtatcatgagaaaggttgtgcagttagtcagctcctcgagcacattacaggataaaacataaaacaaggaatgtgttaaaacagttgtcttatttatacccagtggccagtggattttacaaggcgtattttgatttcaaagagtctacagtgttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgcttccaacgggatgccccgatcggtccacgacgaccccgacattgtcgacgagcagcatgacctcgtcgcccccggacaggggcttcaccctgggtggcctggaggactcagggagcgtgaatatatcgccaccttgggcgttcgtggtggagaagagcgagtagcccgaggcagtgccgacgaagacggagtccccgacccaagcgagcgccttgacgccatcgacgagggcgatgtcacgcgtccgcacctccaactcgtcggcgtcgtgtagggtgaggtcaacgaggagcagcttcttcccgacggagaccgcgagggagcaggaggggcgatcatcgtcggattcggaggcgcgggcggcgacggcggcaacgttgcggacggagcctaagcggcggacgagcctggagaggatggggtccccaaggaggatgaggccgtcggcgaggagtaggaggcgggccacggcggggagggggaggatggcggatacgggtcgggtggggccgatggggaggaggcggaggaagtcgggggagggggaatcgagggtgaagaggaggagcttgccgccgccggtgccgaggtagaggtatggggaggagatggcggcggagcggacggtgagcggggaggaggctgggaggccggcgagggcggcggggtcgagggtggcgaagggctcgagggcggcgcgggagggtggagtgttggatcccatgggtgagctagggttgggagcagggggacgccatagatagctggggaagactagagtgatcgatctcttcgagtcgaaggaagaagacgaccaaacaactactagtctcttctctcttgtaacagtgttaactccgattagattagaccaacaagtctaacaacttagttagttggtgactttgttgttggcgagagatatacaactctttatcccgaaattcattcaaatcttcacaattttcactctaaacttctccatttagcatactatctccgtctcaaaataaataaatctattatccgtagtaataaaaaaaatacctgtgcgttgcaacgggtaaaaacattttttatcatgtacattaagctcccttgattttggaccgaatgcttccttgtttttggaccgaacgttcattccttccttccttttcagctgctaccttcactgctcggcatatctctcttcggctcagcccacaagtgaagctgtaggctcagctcaaacagtctcgtgtctggcctacctcttttcagctcaacccacaagtattgttgtaggccctgctcgaacagtctcatgtccgtaccatgacgaagtcgatcctctccatcaaatgcggtcgaatctttctcaatctccaaaattgttgagatattttgatccactcgatcctcttttttgattttttttatcaaaatcgaagtgatcctctttttcgattttttatcaaaatcgaagcaatccataaaactcaggataaaaaatgacgaactgaaaagaaaattctgaactgaaaagaaaattcaaaagaaagtagtggagaatcgatttttgcaattaattggatgaggcaaatcgacgtggcggcggcgctaggcatacatagctgggcaagagtgatcgacacaaatcaaaggaagaagaagaccttctcttctctctctgtaacagtgttaactcccatcaaaggaagagttcaccagcaagtctttgctgttggtgatagacgccactacaactccttaacccgaaatccattcaaatctccaccatttacactctaaacttctccatttagcatattcccttcgtctcttaataaacaaatctaatactatatgagtaatatttgattattttagtacactttggtctaaaatattcgatattcgtgataagattttcaaatttcaaccataaaaaatctctaaatattcagtttaaaggtatacttggcacgggtatttattatcagaaaaactgtaaaagtttaatcagattctgttccaaacattaaatatttttttaccaggatagtccatttacatttcctatcatcaatatagttacctacctatagaaaacttcaccaattaaaccatgtctaattttgagcttattcatcccgctagagatgaagaacaagaaccaataaaccaccgctaagcattatcatcaaaatagacatacccaaggaatgataaaatagaaaagatccataccataccggtatgcttgctactagtagtactttatacaagaagatggagtacattacatacatatagttataggtgccattgattgtacgctaggaaacataatctccattcatatatgctacaaaattattagtaacaaagagatgagatgaccgtaacataacaaatatgccagcattgctgcagctcaaggcgttgtcattcccattggggcagccatattccagtctctacccatcatccagccgctgctcttcatctcctctccagcttctttacagattcggtccagcatggcaaggaactccctcacactgccaaaaactctcgccatgtgcccttcgtcgccgctgctcaattcaccatggaagtactcagtcacctccttcacacaagacaggcagatgctctcttgcgcctggagcttcaggatctcctcctctgcctgcctcaggaacatgctcattgtgttgtggaaccgcctcgcgctgtccgctgaggtcaccatgctgtttagcctcaacacgtcgtggatctttccaagccctacgccgagctctgaaacatctctgctgagcttcatcatatcgatggatgaagctttcttggtattgctcagctcagccgcaagttttgacacaacctgaagaccatgttttctgtattccacatcatactgctgagtagtatttgcattcgttttgcacaccggactgtggccttcaggtttcacaatttcatggacaacaaattgcaggagagcagccttgccatcagctcctttcacatcaacgatcttcagcagagtgttgggttccatggcatgtgaattcggagatcctgtatcgatactcatcaagttgccaaagttcaaaacagcctcaaggaccttgtggaacaacctgctgtttttcagctcctggcaagctgcctgtatgaaaaacgataagaaaccctcagagatgagtaatactataaacaaggaaacagtaagtgagggtctattccgttcacagattcaaatcatttgtgtaaatattgatatgcataatacccaattgcatatgaaagttttgttttgcttctttcaacaaagggtgcaaaacaatttgtacaaaatattcaaccaagggctcaactatacctcaagagtagcatatgacattctgagctgattgacctccaaatagaagttggcaacatagagcatagcatccattctcttgaacgcaaatggaatatccagcactgcctttagaaaagcttccacagggcaaagtttggtggatagatcatctttgaaatatttcagtttaagctcttcctcattggtgaggaccatttgcatgagcattcgcaaggcttcaactcccaaaccatgtgcattacctatatccagcaaacacaaattaaaccatgtcaactcccaaacggcaggaattaacagtgcaaaccgtacccatattgtattaaggcatagcatgaaaagtgaacaaataatgttatcaggctcaataactgattagctatgatgtttgtaacaacttgaatgcagatctacgttgctgaatcaaaatacagaagcccaccacagggaaacacatagtcaccaaaaaaagtctataccaatatggcaatattggaaaaatgtggccagtactatattgataccagaggatgcaaaatactgaaaacaagtgtttttccccctttacacaaagaggaggcaactacaaagaagagatcagacgatcacaagggaacaaggaaatttcatgtgcacctatgtcaaaagggcgggttgtgaaataaactatttcagtcagctaatcaggccatgtgggacaatcacagggcaagaaacaatcactgaaccaaattgtgcaatataactggtgaaaaggcaaccaaagttgaaaggacagaggcaccatgcatcatctattcatcgttgatggtgggcataataatgcatcgcaaatatggccaatggtaacagccacccattccaaaggcccccacaataggtgaacactagtttcattcagaaagatgacaactttagacagcataattcaagagcacaacattgcgcgccaaatccaattgctaggaagaagcagccacacataccttccaagatggcttcgcgcacttgctccttggaaatacccaatgctcccaccagcattccaatgccatggcacctcggagcgcccagtaagcacacctccctcggcatcgccgccgccatggagttgttcagatataggtggatcatctcatccttcatgctgcaaattaacaggaaaagcaacaggaagccatcaaatcgaaataattcttttaaaaaaaaagttagcaagttgagatcaaaattgagtggttgcattgggggtgcatcttactgcaaagacccgggctttagcttatccgagtgcaaaggccgcgacttgcgcatgctcttctcggacggcgagtgttcctcctcctcttccgaaggaggtgcttgaggcggcatggggacgaaggggttccaggcgtgcgctgccattggctccggaggctgcggcctccgcttggggggcgatggattgggggctcggccacgcggctgcgggatggagggcgggcggagatggacagggctggagccgagcgtgggggaggaggccgacggcgaggaaggggatagcgaggaggaggaggcctcggcggcggcgggtggcgcggtgctggggtcggaggcggagctccgggatgcgaactcgccggaaggtgggccgacgcgtgggagcggcgggagagggcggagctctggcgatcccggacggagatgggaggtggtcgggggcggctgttgcggcggggcggcgagggtgccgaggtagaggaactcggtgctggggttggaggaggaggtgggcattggcggcggcttgaggcggcgtccctcctcatcgccgtctccgtcgtcatcgtggtggtggttggtggctccggaacgggatgagggcgagcgagcgtttgggtgggagtgggaatggtgtcggtggcgtaggcgacggaccaggtgtagttataggaggacgcagaggagtagcaggcacagggaaaggaagaacagtaggagggcctggaggacagggaagcggcggggtgggcgctgggtggggtggacgagagtggagatgttggccgggaaagtgggtaggccgccgtcgccggatggctgctgctgctgctgctgggtagggggtggcggggcggcgaagttggggaagaaagggtagttggtgaaggggtaggcgtcggggggagaggggttggcggaggaggaggggaacttgggtgtgggtgtgggaggtggtgctggcgccgccggcgggggaagtgtcggtgcgggcgttgccgatatcgaagcgggtggcggtgtaggagtgggaaggagaggcggtggcggtggcaggatgcgatggtgacggcgaggaggccggggcgcagggggcggaggtgtaggggtgggcgtggtgacagtgggggtggggagaggtggaggaggaggagagtcgggagagtggagctgctgcaaggtggtttgggttggggaggaggagcggtggtgggtgttgttgttggggacggagacggcgctgcagtagggtgcaagaagaagaagcagcagcatgagattgagcaaggagaagaagaggggtggggaagacgacggcattgccattgccatcgccatggaggtaggtttgccgttgcaagtgcaaaaacaaaggatgggttttggggaggtttctctactccctcctctcctcacagagactgtgcacaagtgcagtgatgatcctggccctggccagtgtaggggggccagctaagacggtggcaggaacggcagcggcagcatctttgcttggttattggattcttggtgagtgctcctcctcctcccttcctcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggagtggaattgtggagctgtcaaaacccagctccacagctctaatacgttttgtgagagagctctactcctagttttggtagagctgaaattgtttgactgagctccaggagggtggagctggagctggagctgtgccaaacaagcccctactctcattatcttgtggcctggtgcattggcaagccatccttgatcgtatccgtagtggttaggaaagctggtgttgccactcgacatggaagaggaggtcaagcttgtatcgttgcatacctggggctgggactatcatcgctaagagcatcaacaccaacaatagtttgtggatgccatataccttcctaaaggtgatatcactgacatcccgtgtctcagtgtggactctctagctgaaaacttagttatggtttttaggatatttagaatagtgacgatgatactctagatgctatgatattttttgagatgtcgtattgtaggtttcatgttaatgggtgttctggataacttctgtcttcgacagatcggcttcgatggctatggcctatagcggctcagttactctctaacatcaatttttgttttggtttgatgcctgttctcgacaatgatgtgtgtggaattcgatcgacgcaacgatcaaagttgattttagacattctgatttttcaatatgagaaaaacacaaagactacatacaacttataaagcattgagaagaaaataatagttatgcgtattattgtcaattatagatagtaagtcactatctttaaggtattataagttgttttattggttttaatcaagcagtgatttaaaaaaacctaagtctactgtaaactgtaactaaatggtggtagaacatatatggcctcatcagatggccagatgctttggctgatcagccatttaagcaaaataagctaaccaatatacattgaaatttagctgaattagaggcagttttggctgatcagccaaaacatttggccatccgatgaggaccatattatacacctattataacacaaatcaaacacaatatcgttttgtctaagaaaaaccatattaatgtatactctcatagtagggtatgagtattggaaatatcaaaatcacttacctattcattcattttaaaatataaaaaaattttagttagatatgatgcatattagttgcgaatctgaaaaataaagagtatgtaataaatagtggtgtgtatcaggtggt

SEQ ID NO: 22360 - DNA, 10889 bp, Oryza sativa
tccttcccaaacaccacctcagtgtagtatgcatgtaatatgggagggaaatttggtttggaacttaaatataatataagctctctatcatagataaaaaaatattcctttcaaatatggcactgtttagtttcaggggtaaaatgttttggcgtgttacatcgtatatacgaacatacatttgaacatttgaagtattaaacgcagtctaataacaaaacaaattacagattctgcctgtaaactgcgagacgaatttattattaagtctaattaatctgttattagcaaatgcttgctgtagcaccacattgttaaatcatggcgcatttaggcttaaaagattcgtcttgcaatttacatgtggtctatgaaattagtttttttctatatttaatacttcatgcatatgtccaaatattcgatgtgacagggtgaaaaatttttgttagggactaaacagggcctgtataggagtactccctccgtcccataaaaatccaacctagtattggatgtgacatatcctaatactacgaatttggacatacaatcctagattcgtttttttgatagagggagtactcccttcatcctctaatataatggattttgatattttgtttgcactgcttgaccacttatcttatttgaaaaagttgtgtaaatataaaaaacgaaaagttgtgtttaaagtacttttgataataaagtaagtcacaaataaaataaataataattctattttttttaataagatgaatgattaaacaattcaagtgaaatgttaaaatttgttatattagaggacggatggactactccctccgtcaaaaaagacaaaccacgagtttccgtgtccaactttgactgtccgtcttatatgaaatttttttataattcgtattttcattgttgttagatgataaaacatgattaatattttatgtgtgacttatctttttaatttttttcataatttttttaaataagatgaacggtcaaacgttaagcacggaaaccagggtttgtcttttttcctttttttttttttttttttcggagggagtagttacgaaggggcacagggaaatcatcaaagatggggaaattgtactcgtagctctgtaagggctggatcacgagctgcataggaatgtggtggtactagcgcaaaagcagggatggtagtggggtgcaacgtgcacggctgcacgcaccaaaaaaatgtgtacgcacatcacctcaccagcgtactgtatggagtacagtaacagcacgcaagcacacgcacacggagacacgagtcgcagagataggcttttggcgggaagcgggcctctgccattccctcccgccatcttctacatcctgctctcctgtggccttctccttcctccatcgccatggttggactggatcactggaaattggatgctaaagctttgtttgcttccaacgacatgcatccaaaagaaagggcgcctgcttcccggcctcttgttctgcttgcttgcctgccactgtgccactgccgaccaatctcctctcttcttttcttgtgatatattcctatataaagtgttactttttgttctatttgtcaatgaactatatattgtgtgattattactgctctccattactaatattcaaacaagaggagaaaattaatgttcaacaaactcgtcacaaattaagtttgttatgtttgtccgcccctctgcctgtcgggatgggatgcatatggatggagtatgaacaaacctgatctgaagtagtatagttggcaaagtcggtgagatttgagacaagggtcaacaaagtacttgaggtcgttgcatgcgttgatgagtcgtattaacgatcacttcttctctttatttattgatgaagcctgctatcttttgcaggaagccggtcggttatccgccgccgaggatgaagagctgttgaggaggctgcgactgctgcggccattccgccgccactggaaaaaagatggacgacgacgaccatgaccaccacggcaacggcaacacccccttctccttggccttggcgcgctcctgcggtgaagttcatctcatcgggccggcttgcagtttagcccagcccagcaaggcccattggcccactgggagtgggaggaacaggaaaccgacctcctcatcctcgaagacgaagacctctctctctcgctcgcctggcgccgccttcctccaccccactctctcctcctccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcgagggagtctttttacaaaccaactctgaatctgaacaaaaaaaaacaatacagagacctgtctgtgccgataatatgaaaatctttgctttctacacaattactgcctttggtttttgggtaccactataaatccagtataaaaggagctctgagatatttatgattttagtgtactaacatcatcagtagctgaaacaggtgatgatgagtttctacgctctaatactaaggcccttcactctgaatatgatagcttattttttattttagggagatcaaatactctccctaaacagtaaacacccgaaattactagtctagccaaactccaaccatcaaacctagtttaaatctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggttttattaatagtctacgtttaatatttataattagtgtccaaacatccgatgtgatagggacttaaaagttttagtcgcatctaaacagggtcttagtcttgaggctacatcagcaaaccatatctatcttcagtttaaattcatatatcccatatagctctgtgccttggctaaaggtcaactggcatcagtgtggcaccacttcttcctgtttctgtaacattctcttcttcagtttctgcaacaaccggtgcaaactaaagatggcgggattcggcagcctggcacccaagaccaagaactttgtggtggctggaggactgtctgctttcgtcctcggcgtgtattactacaccatgagagcggtgggaggcacagatgagctgcaggtcgccattgataagtttgaagacatgaagaaaaatgatgctgggaactcatccaccgcgggatcctaagaacagggtttagaattggctccatgtccgcctctatactgaactgatgacacttggttttgatcctaagaacatggtttagaattggctccatgtccgcctctagccctctatactgaaccgatgacacttggttttgtacaataatggctcgatactaggttttgcttatgctttgatgataggctggaataatttttgactgaatgatggctgcagagttggattgcagttttaattttctgaaagttcatataacagtatgatgacctgtgtaacttgaaggtttctatttgtgtgtgggtatgcaaaagacaacaaaagtgtagcaatgttatgggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattcaacgtattattgacgtggattatttgctctatacttctaaaattacgggctcaaacaatgttcttatagtacattgcatatacaaacttaggccatgtttagttcccacgaaaaacttttcaccatatcacatcaaatgtttagacatatgtatggagtattaaatatagacaaaaaaaattaattacacagattgcgtgtaaaatgcgagatgaatctttaaagcctaattgggccatgatttgacaaatatggtgctacagtaaacatttgctaatgatggattaattaggcttaataaatttgtctcgtagtttacatgcggaatatgtaatttattttgttattagactacgtttaatagttcaaatgtgtatccatatatctgatgtgacacgctaaaaattttcacccccttgaagtacacagggccttatactatattcccctacatttctccctcacacacgggagtagttgattcgaccctttttttcttgtgatgcgtattcgttgctgaccatatatatcatgtaagtcaggctcttctagtgtggctacgagctgagtccgacttgagtttattcttgggctattcctcgactctaggttgggtgagagacttgtttgtcacgagatgagatggaagtagcactaatctttggctaagaacaagtttgagttggacttatcacgcaatcacactagatgagcacgatctagcttgggaatgagcaattttcaaagcgacagtgttggtttttgcaatataaataggtttcgaggtagaatatcaaaacaaggatgattaaagttgaggcagtttatgcaattttgtgataaaaaggaaatgggacggattaaaaaaacgtagtggcagtgtcgtaaaaaaaataggattagaggggagcgtgggaaaaaagaaaacgggtaatatactgtctaacttcaacaggtgaccgtctcagattgagatctccccttggcctccctgccccgttaataattacagtattctattctctctctagcaaacaagtaggagtaattttcctctttctttattctactagtctagggaaaaaaaaaaagtagtcgatcgatcgatcgagaggtttaatctgtcctccctctcgccggtcgccgccctcgtccccgccgccgccgccgccgttagattgaagcagagctacaggcaggaggggcttctcctcgcgcgccgccatggtgcttggcaacgtcgccatcctcgtcggctccggtgagtcactttccgccgtctgctccctcctgaggtccacccgcagccctagctagcttctcgtcgcccagcccagccggttgactttcgacttggagattgatagatagataggagtagatgccacttgcaaccatggcgcagtcatagatagattaccaaaccaatccctcccacttctagggaataccactaccaaatcccaacttatttgctcatcttgtacggagtattttgctttaccagattccaatacatagattgatctagccttttagggccggggccggggtttgtttagttcaactaagctttcgcttcaaaccagaggggaacttattacctgggtatcccactgctacatgaaacaccactgtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaaatgtgttacttgtgattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtaggtcacagtcatccatggggatctgagtgctttccaagaggatttacaatcagttaaccttgtagttcggagtctggtatgtgcctcgtaccggaacagattctaccttatttactgaatatccagatttctaccttatttactgaatattactcgtgtacattttttgtatcttgtatcatgcaggaatcaaagcttgtgagtctggaatacacccaggtgagtagaaagctcatgtttttttttttaggaaaagtagaagctcatgttaccactacatattaccaacaaactcatcgacatgctcctaatgctatcttcttaaaatccttttaggatcatacggctaatggaatatctgacttggttgagttcacccagaaagccactattcgccaggcaagtttgaatggtctagtgattccttaatgccatgcttcttctatgctttatttaacaaaaccagttgcacctcaactataagcatattcttttcctatatgcttattctgaagagatgtttttattttcaggtcccagcagcatccgttcctccagctattggatcttcagagcgagttgttaggagggtaaaggcttgcacttttcccagctttgtcatggtcggaacatgccccagtttgttgacttgggttcatgtgtttctggttgcaggtttcttcgttgcctcaatctactgctcttccagctctgccgacaaccgcacctgcagctgaaccatcacctagggcagaggtgccacaggtgtggtttcagtttgatgttgcactttgttgcatgcaatttcagtttcctcttgcgctttccatgattgaaacgagctattgctggacttttgcaggaggaacagtggggttttgtgagcaaagcatcatctagtagggaaggattagggcgtttgcagcagcagcggagtgttgtgaccagaacgtcgtctatgagggaaggatctcctgaatcttcaaatggagcctcatcctcaactggagcaagcacaggaaggaacacaagcacaggaacaaacacaagcacgggcagatttggtgggctgaggcttcctggacttgggtttcttgcaagttcgacgagttagttgatgaggtgtttttatttaagttaaaagatggtgctgccaggagctctccattgctttgcttgtagttttaggttgtacagtaggagagaagagataacagtagcagtgatgtgatggaacaacacatatacgtgcggggctgggctcgtttgttcttgaggaggccaaatttttgtagaaaaaagagaggaaaacatgtgcacctatgtatctatctatctatagccatgaatgcatcatccagggcaacaccttggtctttgatgtcgagatttttaacttaaaatgccaagagtactagtacttggttaattaattttatgaagacgagtcaactggttggttgcctttgttactagtatcttgtatgacatatgccgatatttcatccagcttagggccatgattcgtttcagacttctgttactgtatatatgtcatatgatatatgatttgcttggaatttctgttaagatcccgctactgtatctcgtatgatatacagtatatgattcgtttggtatgtctgttaagatgtgctactgtatcttgtatgtgacatgctgatatttggtactccagtagagatcttataacaggaaaaaaatatgaaagaaaacaaacttacaaaacagcagccgcctgatatgatttgatgagaaagagaaggaagaaaaagaaagccgaagatatgggccgtgtttatatgggcccaagccctaagaggagagtctaggcgacgggacgggaggcttcctcctcctcctcctactcgagactggacgccgccacctccacctcccgtctagtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggtctgaggtcgcttcgaattcattggctgcagctcggagcaaggtgcaagctttcctcgaagcggctcgtgccggtgatctcgactccctcaagagtaggtgcccccatgctttcctctctctctcctttgctttccttgcgtttcttctcatctcctctcctcatgcgccattgcagagctcgctgcggcgctcgacgaggagggcaagggcgtcgccgccgtcgctgctgccgtcaaggacgccaacaagcgcaccgccttgcacttcgccgcccgcgagggccgcacccacgttgtcacttcctcatctccgacctcgccctccccgtcgaccccaaggacgacgatggtactactaactatcactatctcttactctcatctgatttcttcacaatctctcatccatcagtttacatccactccaccaggtgaaactccactcatccatgctacgcgccaagcccatctccaaactgtaacctatctgcttcaccatggagcagatccttccgttgcttcttccctcggagccacgccattgcaccatgctgccggcataggtaaaattcatcat

SEQ ID NO: 22361 - DNA, 720 bp, Oryza sativa
  unsure (1)..(720): unsure at all n locations
caatcatatctgcttgccatttcttgtttcactgttctagctagttcctaaagttacatagatttgcagggctgaaacttttctgatttgatgtttgtcacgaagcgtggcttatctgatgcttgcaatgtagttggcagccaattggacaaggtttcagatgatgtcactgtaagtttttaacttctttcagcaacgctgaactcaaatgtgttacttgtgattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtaggtcacagtcatccatggggatctgagtgctttccaagaggatttacaatcagttaaccttgtagttcggagtctggtatgtgcctcgtaccggaacagattctaccttatttactgaatatccagatttctaccttatttactgaatattactcgtgtacattttttgtatcttgtatcatgcaggaatcaaagcttgtgagtctggaatacacccagnnnnnnnnnnnnnnnnnnnnnnnnnnnnnnnnnnn

SEQ ID NO: 22362 - DNA, 720 bp, Oryza sativa
atcctccgtctggcaacaagctatcgcaccaaaacgaggtagaggctccgttccccagcagtactttgctactagcggcaaagcagtgcagtgactttctgtcagctagaggtgcaatgcgcgtccaagaacactctggctcagcgcggcacagccaaatccaccgagtgcgaagcgcaattcccattaggcgtaggtttctgatccctagtcccccctgctcgatagagaggcaaagcttctcccaagccaccaagctgcaagagcccgcagcatcttcatcacccttccaaatgaaaccccagcatttcttctcaatttcgttgatcgcccaggctggtagttccaagacggacatgaagtagagtgggagcgccattaacacatgcttgatcagggctagacgggcatctggagataaaagcttgggcttccagccagccaaatttttggcaagcctatccatcatcagttggatttgcactttcgtcggtttacgcacagaaagcggcagccccaagttaacaatcggcaattgcttgattgggcatgtcaacacctctgtgacctcttcaatttgaacatcagtgcaatggatcagggtcaacgagctcttggctaggttggaaaccaaacccgtggcgtcacccatcaacttgagtatgaagtggatcatcagcgcgtcccgcccagaaggatggaagaagatgatggcatcat

SEQ ID NO: 22363 - DNA, 594 bp, Oryza sativa
gatgatgtgccactatgatattgcttctgtccctgctagtagttagtacaacattaagagttaactagtttgagtggattaacttgtccaatcatgctcaatacacacacacacagcacagcacatctaaatctcactggttctgttaggtttgatatcagctagaacaatcgcaatgatttccctgttactcatgattctctgtcctgtttttacctagtgctgtgcgacaattaacagtacccacaatgcaaacttagagttgctgttataactgtaatttgttttctttcagagtaggaaagaaacatttcaaaaaatgaatgagcagtaatacagtacatctgtatgcaggttctcgactggcttcggtgtttctgggggaagtacgcttatccatgatttttactcaagagaagtacagagccccattcatctcactgttgacactgggttcacaaggggcgatgcttcaatcaaagcctatatctcatccaacctgtctcttggagataggcaccttgctgcgcagttccaagagattccccttgatctgaggatgcttgaagcaggaaaagttggatgtatgtctca

SEQ ID NO: 22364 - DNA, 655 bp, Oryza sativa
  unsure (1)..(655): unsure at all n locations
gtaactaagaatgccttttggaatagtgttattaaaaatgttagataaacatttggtttggtgaaaaatgatatggttttatccaaatgagtggagaggttcagctgcaaatccatatgcacatcctaaatttgctttgtttataaatgccagcctgttcaatgcaactccttacaaatttatggccctagtgcacatatgtgctcatcacaataactgggttcaaagtgataattaacttggttttgcctatagcccaggtgtttgacatggacttacagcaaacacatttaactctctacagttggtgattaaccaataaaaagagctccattcatcaaatatattcaaccaatatattacagtattggctccacaaactagcttactataataagatatgcaagcatgtctatcaacacaaggaaaagtcaagacatgcacttggagagttgttacatatgtgcaagaggtaagcctgataaactaagcactgaaatttcgctcatgtggggtaacgccacaaatcatatggagttggcacgttgcatcccaaaatattccanattattatttttattttgaataaatattaactgtatgctaagaataggaataggaagataactagcaagatacaactcaaagttagcat

SEQ ID NO: 22365 - DNA, 1165 bp, Oryza sativa
aaatattggttttatactctgtaaaagacgaaaaatttgcgaaaaagaacatatctccaaattacatggaaatatccacgagtttcaaaaaattcaaattcctataacaacaataagaaatcagcgtcctacaaggtaagttcaataatacatatcactctttgttctctctataatagccggctgaagtctaccatctgcatgtcatataataaaattttaaacaaatataaatcacaaagtgtttgctaaaatgttatcatcacattttatgactgattatagtcaagatctaatggctagttataagttttccattaaatttgcactagcattttctatttacatctatttacgtcaacttaacttacattgtaaatacattaaaattacatatataacttagggacttacgatgtatgtacgtgttaactatattttatgaaaaatacgacggaataaatataggtagtcccaatcacaaaatcaactcattaaactatttgccttccaaaattttcaacacgaagaacatgattatatagccattatgtcaatgtctctaccaacgcacggaaataataggttcttgcaggaggtccactatgcgaaaaaaaaaaagcgaccattcttcccgtccccctactgctcagccgtttgctgttccgttttgtgattggatttcagagatttccgacgggaaaaaaactgaacctgattgactacctgatgctgcgtgagttggtggacggctctaatgacggctggctctaccaaatcggcatatccagtttgggttgcaagaatcttcagtttttcctcgtctggaataatgcgggtcttttttaggggaattctcagtggcatggtcaaaagggaggaaacattttcatcatacaccgtgggtttttttttaaaaaaagaaaacacataacactttattaaatgacagcatttagggaattgaaatcccgaatacttcgcccatgataaacataagagttgaaccataataagagagaggttaactgaaaaaagggaagcaaacttcctaatgaaactaagcagcaatgaagcagcaaatcgacagggtactgcggcaatgccgcgacgactgcatccgagggactctattgatgtgcacttcgcttgacaaacccgtaaa

SEQ ID NO: 22366 - DNA, 249 bp, Oryza sativa
tacccaataaaattcattagtcccttaaccctattattattaatcaccaaaacccgctagggggataaatgcaacttcatggggcagctgcaagatccgggctaggggcggtcgcccgccgccgcgcgcacatcaagcagcgagcacatcccctcctcgtcaagggggcagcaagcagacagatcaagcagcaacacatccaaatccaaacaagcaagaaagatcgagcagcaagaaacacgagcactc

SEQ ID NO: 22367 - DNA, 487 bp, Oryza sativa
catacatgagttgtgtgaagattgtgtgtgctttagtagtaaaatctgaacagagaaggaattaaaagagtctcagttaatttgaatcagtagtttgcataaccaactaatgaattaagcaaggaaaaaaaggcatgtatcatatcggcaacaaagagcaaattgtgttcagatattatttaccattgttatctcgcaacttgatactaacagttctgaacactcaaatatgctggctctgttgcttatttctccccttgagcacatcagaagaccaccttcataagaacggccaagggctaaaacatctcccttgtcgataatatatttaaggataacagcctcttgaagcttgaaattggatgtgacttcaactaaggctatgttatgatggaaatctaccatggaaatctggcaaatagatatattcccactaggtagaaagacctccacctaagtaagtaataaaaaatcaggacaaaaataa

SEQ ID NO: 22368 - DNA, 637 bp, Oryza sativa
ccaatgagcagcagaaagctgataggggggccttcctccccgggcagccaagcagccccaaggtctctcagttctcaggctacatcactgtgaacaggcagaatggcagggcactcttctactggttctttgaggcccaggcactgccctctcagaagcctctcctgctctggctcaatggaggttgtgcaataatgtctgaatcatttacttctgcaatagaaatgtgaactttttggtacacatttgttacatgagtgcatatgtgcatgcagggccaggttgctcatcagttggatatggagctgcctctgaactagggcccctcagagttagcagaaatggagctgggcttgagttcaacaaatttgcatggaacaaaggttgtgcaaaaactaagcatttttgtttcttataattgttccaattggtttgagcaaattaataaaatgctatacgcatgtcactgtttttcacattgttcttgccagaggccaatttgctgttcttggagtccccagttggggttggcttctcctacaccaacacatcctctgacctcaccaaactgaatgatggttttgtaggtaattcagtattgttattggtaaagtatatttttcttgaccattgtttg

SEQ ID NO: 22369 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnntcctcgatgcgcgctcattcgtttttgctgagctgccatcgatgggattggagctaccctgggtgataccggtggtcgacgagagcaacaccgattcaggtctgtggctctcgtgtacacaggaaattgaagtttgttgttgtgttcggtccaccagcagctcctaattcgggagtgctgcgaagccctaaccattgtatccattgtcattatttaagctgtatcttgtatcacttggcaaactgaaccaagacaccattttcctgttatcttgatgaaatataacaatgctatgaatgttatgattatcgatttatgttctgttggatgttgagagttgagacgctggaactgtcacacgtttttattgtgccccccatcttgtgttgtagtcttgcatgtgcgcaagactcaccttggctaccttgttgcattgttgctggttctatcttgaccttcaaaacttgtcagattgcttgagcagatcatctcaaactcaacttttggtgtttggtttgtgttgaattagtaacatctataatcgtaataaagctaagaaagtttatactcctatataaggttgaagaactgcaaatatataatcttttgagctacacatctctgaaagattagttacatggttatgatctctgaaagccttgaggaaggttcagaattttgggacatgaaccacataccgtggccgcgaagggagaaaggttcagtgttaccttcattcgaccggaagatgtacgccacaatcccttg

SEQ ID NO: 22370 - DNA, 5541 bp, Oryza sativa
tttctttttataaaccttttcaactttgtttatttcttaataattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaccctacaaccaactggcagtttgtagccgaggccttggaatcaaagagacaattccccttaggcaagattctcctcggctatttgtaccaaatgctgaacaatgcatcggctaagatagccgtcggctcagtagttggagcaggtggaccatggtggctgttgcaatcttggttgaatctaatggtcatgaaattcgtcaatcggccatccgtgacagaagccgaatttccaagactggagccgattgtggaagatgatggagaggaacgcacccattgtagatgtacatcttatggagaatatgcttccacaccagccgatgcaggagcaaagctatcagctgaactgctcaaggactggttctgcagtttttatgatggctttcagaaagacactcagatttggttcccctatgaagactcgactctcctggaaaatccatcggactttagatttgaggatatcaatcatgaaagataccaaaagtccagagaagttttctcggctgcaatcagtccatgcatcatccctgttggcattcatcaaggaagaaatatccatgtttcttatgagttttatcacccgatgagctctgccagacaacttgcgatgggtcaattaccaatcggcttgttctttgccgataaaatccaatgccgaggggaaatttcatcaactttgatggaccgactgctcaatctccaagggccttctcttggcagtattgaaaatatagagctggccaggttcaggagcagatcatttgacagatggtggggtgaatggaagttgcatctgttccaccaaccggcctcaatgtacatgacagacctctttcctgatgttatacctcaggtaaacggggattctcattaatttcattcgaacaattatcaaccaattcataacttaactaattttctcttatgttttgcagacaacagaatcctcgcctccacatcaaagcaatagtggcagagatatcgaatatgccccaggtttaattccaaatggaggtgggcccatctcctcctgtcatcggctataatgcccccaagacttcaactcttcttcaagggctcatcagagaaccagccgatgctagtaaaaagagaagaaccaggtcatcggttgtggacacatcttctccagccccaaagaagaaggctaaattaaagaaacctaatccagccgatgatctgcctgcccttgatccatccgttgaacaagctctagaagaagaagagatcggagaggatgttgatcaagctgcaaatgaagtaagtgatactgaaagaacaccatcggcttcacccaagcaaactcctccaactccttctgccccagctcatttctctagggtaaatatctttccctaattcccttttataaccattttatccttagccgattatccattaatcttgtctttgcagaaaaagagaattgctgtgaagaaaaaatcgacagcaccatctctcaaaccggctccactagtaagatgttcttaaacttttcactagtcgatctcagccgatattgtctaatacttgtctttttcagcctcctcctccttcttctcctgtccagcaatcatcaagcgataaaactccatcggctgtagggagtcaccatattcaagaagaagtacaaccagctgctcctgctatcccagtaagtttcttttaagcaccaagtcttagatcggctatatctgtttgtcatctaattgtctttaaatttctcttttgtaggctttagccgatctgttttcttttgatatcaaagattactttgatgagacagaagaagaaactacaagtaaggctctagcccctttggacgacactgtcaagaaaacacttgaagacatatcccttcagctagaatcttcctggataatctggtggctgattgtggttcaatccgggcacgatttgctgaaatccaagcctcaattctggacgatctggtaaacaccatcactccagccgtgtaccttgaacaacaccaatttaagctagagaaggctaagcaacggatagccgatcggcgagaacggaaaaacattgaagctactatccaagccaatcagcagcttgtgcatgaagagaaagccaagttagatcaactctatgttgggccaattcagtcgaatatagatcggcttgaagctcgcaaaattgatttaacagctcaactcgaagaatgcaacgccgagctggatctagaaaagcaaaagctatccgatctaccaaatgccattgaagaacaaaagtccagattgagatcggctatcaagaatgtggctgacatgaccaagtctctcaaggttatccctggaaccgatgctcaagatgcccaagccatcaaagaagtagagcaaattaggcaacgggctgtttcggctatccagtgttttttgtctcagtaacattctgtgtaatagaatctaggaatttttgtaatcggctaagaaactctgactctttatgtaactcatcttaataacttttatgccgattcaatgtaactccacattttgctcgaaaatttgcaatttctcatatatatgtgcccccttaattttataatgtcaaaagcattgataaaattataaaatcaactaagggcgatataatccatatcggccattgtacatcggcaaaccacaaccgattacaataggaaaacaactaagggcgatataaccatatcggccattgtacatcggcaaaccacaaccgattacaataggaaaacaactaagggcgatataaccatatcggccatctcaaggcaatgcaaatacatcggctatcatgtatcggcaacaccagccgatcatgtattaacccaaacacttgggtaatatttcttcaagtacttgccatttagcgctcgtccatagatttctccatcgagtccttgcaacatgtaagctcccttagacacaaccttatagatttggaacggtccttcccaattcggtgaccacttgccgaatttgttatccccagtcccaatcggcaaaatcaacttccataaaagttcaccttccgaaaaagtcttgggtaccactttcatgttgtaatgccgagcaactcgttccttatccttggtaaccttcgcaatggctcttaatctagattgaaccaagtcttctctttcatcgaccatgagataataatattcatcggctgtcaaatcattttgcaactctgttctctgtgaaccgattctaacctcccatggtaaaatagcctcatgtccataaacaagcttataaggagggacttagatcgacccatgacaagccatccgataagaccacaatgcttcggcaaatcgagtatgccactgccgaggataatcagaaatctttctcttaatcaacttgatcagactcttgttagatgcctcggcctgcccattagcttgtgcataatatggtgaagaattcaacaatttgatacccatctatcgacaaactgaacaaactcatcggacacgaagattgaaccttgattggttgtaatggtttgaggaatatcaaaacgaaagattatatgctcttgaacaaactgtatagcatccccggaatcaactttcttcaaaggaatcgcctctacccacttagtaaaataatcagttgctaccaatataaacttatgccctttactcgatggtggattaataataccgatcatatcaattccccaacctctaaacggccatggtttaatgataggattcatagccgacgccggtgctctctgagttgctccaaatttctgacaatcttgacatccgttgcaatatttgaaacaatcttccacaatagtcggccagaaataccccgcacgtcgtagcaaccacttcatcttatgagccgattgatgagtaccacaaattccttcgtgaacctcaccgattgcaaccttagcttgatcggcactcaaacacttaagcaacaccccgtcaatcgtccgataataaagctcatcatccaacaaagtgtacttcaacgctttgtaacgcaatttctgagaagccgattgagatggattttgtaaatatcgatgtacatcatatctccaatcatcggctgttaatgcagcaacctcaaccctgacatctttcatcatcggcttatatcccgacgccccttgggccaaatcattggcttcaatattttgttctcgagatacatgcctcaaagtaaccagccaaaattccttcatcaactctcggcacttctcgttataaaccattaatgtatcattcttgcactcatattcccctgccaattgacaaatcactagcaaagaatctcccataatctcaatagcatcggcctcaacttccttgagtaactgcaaccctttgagaactgcttcatactcaacctgattattagttgcataaggtttaataatataaccaaactcaaaacttgccccccaaggggaaattataaccaagccgataccacaaccatgagtgcatactgatccatcaaagaacaaagtccatggcacaacctcaaccgagccgattgaatcatcatgatgttcaacaataaaatcggttatagcttgtcccttgactgccttcggtgactcataccgaagatcaaattctgttaaggaaaatatccactttccaacccttcctttcaaaattggagccgataacatgtacttgacgacatcggctttgcatatgacagtgcattcgttggacaatagataatgccttaaccttgtactagaaaaatacaagcacaagcataacttctccataggggaatatctagtttctgcatccaagagccgacgacttagatagaacacaaccctttcctttccttctagctcctgaattaataccgagccgattgacttctcaccggctgacagatataatctaaaaggtatccctttctgtggaggaatcaaaactggaggagagctgagatattccttaatactatccaaagctttctgttgctctgcccccaaagtaaacttttgattggctttcaatctcaacaatggtgtgaaaggttctaatcttccagacaaattagaaataaaccttctaacaaaatttatcttgctgatcatctcctgtaactccgtcttgttctctaggggctgaattttcttgattgcattaatactcctttgagttacctcaacccccctctcatgaacaagaaatctcaaaaatttgccagccgatacaccgaaagcacattttgtcggattcatttacaagccatatttt

SEQ ID NO: 22371 - DNA, 1537 bp, Oryza sativa
ctatcaacttggttctaaattctgaagatcttactaataaatgtcggccttggtcgatcacctggacctatgtcaatttcttccaaatcgtcggccgacatgaaaccttctccttacttgtcatcgaaatcatctactgtgtccttggtgtagacgtttgaaccctccacgacgccctcaaaataatagcttgggctctccatcttcaattggttgtatatcagaatcggacacttttagaaaatctccatcccaaacttttctagataagcaatcaagaccatccgtctcccaaagagctaaatcggcactggcaacattgactgacctatcggctggcatgatttcaatcttgtcgcctagccactgaatcaagcattaatgcatggttgaaggaatagaacaattggcatgaatccaatcccttccaagcaacaagttgtaggaacccttcccatcaatgacaaagaatgttgtagggatagttttgctgccgattgtcagctctacattcaaaacccctttggtttctgatggattgccaccaaaatctttgagcaccatgtttgtcttaatgagatcctcagcatttctgcctagcttcctaaatgtagcataaggcatcaaattaactgcagccccaccatcgaccatcatcttagacatcagcttcccattgacatagccatttatatataatggtttaagatgccgattctctgtcccttccggcttctcgaagactgcttgttctggtgataaaatcaacttagccgattcttcttcaacttcatcgacatcggcttgcttgatcccaaattcagcaggcaacgtgaaaaccatgttaaccgatgcagtcacaacactttttcctttagccaatctctttgcttcatcggctgcggcttcatcggctgtaggaacttgattcttaacacgtcactcctgcttcagcttcgtcttctttagccgatgattgatttcttactcaacctcctgaaagcgctccctactcctcaacctttgaacccttcttcttattctttgtaaaaataccaaaaggacaccattgagtcttcccgtctttgttgtcttcttggtcacaatcttggttcatcgagcccaattgtcacgtcccaaaacgaccttaaaatataccctttaaattatgcctagaataattaaaatcctagtgaaagcctccaaaaattaaaatgtgcaaagttaaaagtcaaataaggcttggaggatttttgtatatttcctcaaagcctaaaatgtgtaaataaattttagtggaattttcagagcacaaataataattatcaagaaataaacaaagttaaaaaggttttataaaaagaaaaaccctaaaaatcctccttccctctctctcctctccccgcggcccactcggcctctccccgcgcgcgcgccgctgacaggcgggcccgatcgccaccctcgctgacgggtagggcccacccatcatccccttcctcccgccgcatgcgccgctccctccgcccgcgcctag

SEQ ID NO: 22372 - DNA, 2334 bp, Oryza sativa
  unsure (1)..(2334): unsure at all n locations
caaatggccataacttggtcctttgaactcggaattggaccattcaagtctctaatttttccttaagaagtcaagaacccatttttgtgctttgttcctgcttgttatatgaagtttattagagtaaaagcctttttcttcccgttggtcgtgtagacactgcagcttcggaagatccactctacgtggaggtcgaagccgacgtttgggaaagcgagcaaggcaagtcacatcatccttgaacatattgaatcccagtttataaaattattttggtttaaattactgcattatcgctttatttaaattcccgcgttatcactgttttatttagccatgcctatttacctttgttatgaccttattatcattgctattggtattatcaccttgcttaccctagggaaataaaaccccaactagtgggtactctattcatggttccactagtatgaatttaggtagatgcttcgctgattaattaggcaacattaggtggtttcataaccttagactttgggaatgctcatatcatttggacattatggaatggttggactatgtggaaatggacatacacctccccctctattcaaaaccctcaaaatggttttaggctgggctcgaggtgcatggttttgatagtagcacctcggccaccataaggaccggtcttcgggcctctgttgcaaagcactaccgtacttccacatgtctagtgggtaaggcttagtttgtggctcagtctggtcataaacaaaggtacacggatggagatggacgaagtcgaggctcgatggacatctctaggacaaatgaaggctacacgagttgcggcccggtagtcgagatgtcatggcacaaggccggtgtcctgcaactaggggcttaacctttggtacctgtctcgggaattcccggcgtagccaaggttgggtcggactcttgtctatggctaggatgggttgggaaactatgttacgtattctgtccgtatcacgtgatggtatgtggcgcgtggttacacgtgaggaagacgtgttttgtgggtaaagatgtacacctttgatcaaagtataatctattcgaatagccgcgccctcggttgtaggcaagcctagcaatgtacccaagttagtgttttaaattcttaaaacctgcttaacaactaaaatgtggaatggttggcctgggttggcttgggacgagctgggacctgggtctggttgccagttcggtctgaatcatcgtaggccttgggttaaggcaggttcgtgcgggttcacggccttgattaataatattatgtagctctaggatcgtatttacaaaatggccctgagcaactaaaagtcttttaaatgttgtttactgcgaaccctaacccctttattataactcccttgtactcctttgcctttattctgcatccgtgggtgtgtcttgctgagtaatgtggttgtactcaatcttgctcaatttttccccaacccaaaagaggagttcctggaagatgaaggctttggtgtctagcttgtgcctgctgtcaagtgcctgtggtcgtcgccctagtcttccgctgttttccgtttatcttcgtgtgtgctaggccttcgccgcccatgtaataaattatctatttacacttccgcttgtaaaactctgaattgtatcaacttttggtgtaccttgcctcctgggacaaggaataatacacgcacgaatggaatgcccgttgggttaattccggtcgtgacaccaatctttgatgaacagaaactcttgcttgccttagccgattgcttctattatacgatcggcttgaacttcctgcaacattattgcacccaggacagtcctcaatagatggcagcctcataccttcattctagcaaaatctaaagaactcatagccccaatgaggatcaaaaccgccatcatcttcttcataatgcctctcctgctgtttgttacacttcttctgatacttattgataatttaatccgaattcacctgaaaacctcttgcacgacccccatcggctgtttggccagctgtatgcaccatattgacaggaaaaggattaccatcaaccttcatcggcctcttagaatcatcaaatttgattttgcctccctcaatagctgcctggatttgctgcctgaagaccttgcaatcattggtagaataagacccagaattatgccacttgcaataccttctcttgcccaattcttcagccgatgggattgtatgaccagcaggaagttgaatctgtttctctcgaagtagcaannnnnnnnnnnnnnnnnnnnnnnnnnnnnnnnnnnnnn

SEQ ID NO: 22373 - DNA, 5858 bp, Oryza sativa
actcttttacccattggcatagtataactttcttgcttctaacacatacggctgccgctatttcggagtcatcatcatcatcatcatccgatccatatatgtaacgacagacatgattaacctttctaaagttcttcctggcttctgcgaatctctgttcatgcaaggttaccttctgtgcaagatgtgacaaactatcaaagtcttgagacgagaacttctccctgatcggagctatcatacccttaaaagccaaatcggctaattaggcatcagttaaactcaagctgtagcatttattcctcatctctctgaacctctaaatgtactcatgcacaggctcatcatgcctttgcttaatcgctgttaaatcggacagtttcatctcatgaatcccactatagaaatagctgtgaaaatgcttctccaaatcggcccaactgttgattgatccacatggcaaagaagaaaaccaagtgaaagccgatccagacaaagacaatggaaacaacctaaccctcaaggcatccacagccgatgcttcgctacactgagctaaaaaccggctaacgtgttcataggttgaaacgctatcttgccctgagaactttgaaaagtctggaatcttgaatcggttaggcaaaggaactctctcaaaccacttggggtaaggatgccgatacaaatttctagcatctttcggcttaagcccgaactgttctctcattacatctgcgatcatattggcccatggtcgttgttgaggcgctccttgtacttgttgtggcacgggctcaaattgattgtattgtggaacaaactggggttgagctggtcctcctcgctgatattgaacttgtggtgatggagactgatactgataattcaaattgcccaattctaaaaattcggttgtatattacgcaccaagtgttctggaacaacgtgaggtactaccatttgacctggttgcacattatgaaccaaatgctctgggacaacttgatttgcggtgtgctgccttagctgattgtcaggtgttgacatttgtggataagttttaaatacttgtgcagtagctccccacgccgcctgcacccgccggccgccggcttccgcccgtgcagttgctccccacaccgcctgcgcccgccggccgccgcccgtgcagctgctcccccgccgccgcccatggatattggagaagagaggagagagaaagagaggtggtgaggggagagaagaagaggctgacacgtggggctcacgtgggtcccacgctgagtcagctgccacataggacaaaaccagagtcaaaaccgtcgagggatatagtttgcatggttttgtaagttgagggacacatcatatccggttttacggttgaaggacgattttataactcgaccttcggtgtactttttccccatgagagtattagataagcggcttgcgttggtaaataatacgctcagtgagcccattaatactttacatgtcgatagcccatcaaagaacaatccacttgatctcggacttgcagcaacccaaagcctccttatgcaatatacttataggaaaaagtttcggtccctcaacttgtcatcgagttacaaaatcgttctcgaactgcaaaactggaaacaactcccccaacttacaaaaccaatgcaaactagatccctcgacagttttgactccggttttgttctatgtggcagctgattcagtgtggaacccacgtgggtcttacatgtcagcctcttcttccactccacctctcttcctctctccttttcttttctctcaggtctcagtagtgtagccagcgggtgggggaggcgggagtctagtggcggcagcggcgacgggagacgaggtggcattgaggcgacgacgacgcggcgtcgatgacgagcaggagggcttccctccacgccaccgcctctgccgccgccgacgggtgcgggaccagcacacggtggcgagggaccggcacaccgcggctacaagcacgactggcacactgtcacatcctgattttcgtttcaggatttataaattatttaataaattattaatagaatttatattaaatgatctttaattttcaagtgaagtaaaatgtgggaaataaaatttcttaaatctaaagcatggatggatttaatttttttgttaaattctccatggttaagtcaattctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaacaatttaattgaaaaaggttttaaaaagtcttcttttggctttgggccgaaagtcggcccaaaacctctctctctctttccctcggcccagccggcccagtccgccgagccgccgctctcctctctctctcagccgctgacaggtgggccccacttgtcggtttcgtcttcctcctttggccgccgccgcccgcgaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaacttgtggattcgatctcgaatcggattcatctctctcctccaactccgaagtttccttcgccgtctccgtcgccgtgggccttcgccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccgcttcctcctcgtcgccgtcgccgtccgttgcttctccgccgcttctttggtcaccggtgagttcgccgcgtcgcgctctacgtcctggtgctctccgttcgcgtcgccgcgccgtcgttcgccggcgagcatgcgagcccgagccgccgagccgccgccgccggtggtgacgtcatcgctgacgtcatcggagtcgtccgccgtgagccgccgtggacccgatcgatctcggccgtccgttttggattggttcgatctcgaccgtccgttcgcgtgaaccgtcgcccgtgcgcccggtccaccgtaaccctagccgctgacgcaataatccttcttttccttttcaaaaataattcattattgcgtcataattcaattaaaatccatataaaggttttaatccgatttaatctttaaaaattcataactaattcatcttaactcagtttaatgtgggtcaagttgcaaaagttgtataaaataaagatctacatattaaaattgtccataaattgaattaaatttatttaattctttttaaatgggctttaattagattaaatcttgtaaaattcataataaattcatatgaaatcagaatgaggccgttcaagtctcataattcatctaaaaatatgatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctatccctttgttatggcctgtttgcattgattactttaatccttgataccttgggttattataatttgactagttgagctttatatattggttcagctagatattagatgtgattgcttagccatgcttagaaacattagcacactattgggataacttatgattcattattattatgatggtttaatggtagctcacgatggtcaatcgtgattggttaattaatttcttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctgataataatttgcttagctcctggtttggagattagatctgtacagccgggtatggttgttcaggatggttgggcctgtgcagcatgggtgtgctgttcagtgttgattaaaatttctgattaattactccactatttttacttctcttaaatgttttgctaaatgctgcttttgcaaatgagccaatattacgccatcctttggtatccttgtacacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaatttccgggcgtgacacacacggcgtcctcgatccgtctcgccgccatggaccgccgccgtgggcggtgggatctggcgctcgcgccgtcagcagtggcggttgtggcagcgtggggggaggccctcctgctccctcgtcatcgccactgccgcctcgtcgcccgtcgctaccgccgcctcgtgtgggctcacaggtaggctgctgtaggccttgaacgcgaacccgacgagcacgacagcgaggttgagatcaaacggcggccacggcgggtcctccccagccaaaccctccccagcggtgcactccaatctgggcttcacgacggactgcggccgtggcgcggtggagggcggaggccaccacagtgcctgcctccaccatgccgcccatcgccggccgcccaggttgtcgcgaccgagaaaattgccttttc

SEQ ID NO: 22374 - DNA, 3627 bp, Oryza sativa
aggcatgcaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcggtgcagagaatggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggaattggagctgttgcaacgcgggttataggactgcttcgggatgcatggatgacaattcgttgaggagcaagcttctgattgcgggggtttgcgtggactgacgtgctggcagctacgtttctcggttttgggcacttgtcggcgaaatgacccattccttgacaattgaagcaacagatatcttcccggactcggcattttcttttctcattttgtttcctctatcctggcactggagttaggctgaagctggaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaaaccttggggaggcttcgcaccttcatcatctgaggagacttgatctgaatcttcactatcagacactctacctccattagctaaaagatgctctgtcaactgttgtgcacctcggaaggaatttcttctctgatgttctgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgcatctgactcgggttcaaaattggcatccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaatccgaagaaggaagaagggagtaaaccttttgcaaatagcattaggggaaggagaaaaaggaactttcgcaaataatttttatttataaaatatgtccttgggttttatccatttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggagaaagattgagcaagaatgagtacaaccacagtactcagcaagccacaccggcggatgcatgattaatgcaagggggtacaaggggataataatataggggttaagttttgcagtaaacagcatttaaaagtcacttagttgcccaaagccattttataaagacgatcctagagctatacagtattattaatcaaggccgtgaaccctcacgaacctgccttaacccaaggcctacgatgatccagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaaccttcgggacaggtaggcaggattgagcccctagcagcaggacaccagccctgtgccatgacatctcgactaccgggccgcagctcgtgtagccttcatttgtcctaaagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggagttttgtttaatctagggtgaacaaggtaataataacaataacaataataataaggtc

SEQ ID NO: 22375 - DNA, 416 bp, Oryza sativa
  unsure (1)..(416): unsure at all n locations
nnnnnnnnnnnnnnnnnnnnnnnnnnnnnnncttcagaatttagaaccaagttgatagagctgttaaaggaattcagagattgctttgcttgggagtattatgaaatgccaggactcagccgatcgattgttgaacatcggctacctatcaaacaaggggttagaccacatcaacaacctccgaaaagatacaaagccgatatgctcgaacccatcaaggctgagattaaatgtttatatgatgctggttttattcatccttgccgatatgccgagtgggtttctagtatagttcctgttatcaagaaaaacggcaaggtgagggtgtgcattgacttcagggatttaaataatgctannnnnnnnnnnnnnnnnnnnnnnnnnnnnnnnnnnnnnnnnnnnnnnnnnnnnnnnnn

SEQ ID NO: 22376 - DNA, 697 bp, Oryza sativa
  unsure (1)..(697): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagagggacctatagaggtccatagttaagttcccatatgtcctcaatggcaccgtaatacatgccaattgtaccatcgtgtctcatggcattgatacgaacatcactattttggttcgtgctctttatgtcttgggctctcgtgtagaatatgtacccattgatctcatattcttggaatgtcttgatcgagccagatagtcccctcgccaggaaggccagttattggttaatcgtctcgttacccatgagatgttatcgcagccacacggggaaagtatcaatgtgatggcgtgtaatccatgcatcgaacttactgatgtttctggcgcgaactagagccaagtgctcctcgatgtaaggagccaccaatgaagattgttgcagaaccgtgaaatgtgctttacggaataaattgttgtttaccgtcattattgcttt

SEQ ID NO: 22377 - DNA, 1809 bp, Oryza sativa
tttcctcacagcccggcctgtgcttaacagcttaggaatactgaagcaggagtaaggtagggacgtagggtaaggaatggtattgaatggacattatccatgatgcaagtagttgctaataatatatacctttattaatttgacgcttcttatgagcttctacattagatagaaagatccgaccattaatgtgatggatagtattatcgtgaatatagatcatgttgagagtacgtgttaaataaatcgtgcaattgaaaatagcataagttttaatttaataattataaaatctgcatttaataaatatgatattacgcctattttggattctcaactcaatgttttattaatttcattccaaaatttgaaattaataatgagacagttttagctgatgtgaactcttctcgcatataggcaactaaaattttgaaaaggtaccctctccgtcccataaaaaacgaatttacgaccagatgtgacacatcatagtattatgaatttggacagatgtattgtctccgtccaaaaaaaaatccattcctagcattctgaggtggaattagtggagatggagaatgactaaaatgtccttaatcattgaaaaaagtagtaagagtgatagataggtaaatggtattgaagggataaaacttctcgttttacgtgttgagggtaggtaaaatggtagaagttggtttttttggaacaaaattcaaattctagaagttgagtttttttgggacggagggagtatgtccaaagtcgtagtaggatgtgtcacatttagtattagattggttttctacgggacaaagggagtaaccaacatatttaacaaatattataattttaatatttaataatattttgtgcaaatgcatgattgatgactagttaatccacaggaatgttcaggattgacatgccaactactccctctgtcacataatataagagattttggaaagatgtgatatatcctaggataacgaatctagacaaactccctaccagattcgttgtcatagaatgtgtcacatccctctaaaaatcccttaggtagtgtttggtttcggaactaagtgggatgggatggaaccatccctgatttttgggttgggatgattccaatcacatgtttggtttgtaagatgggacgatcccaatttttttgtttggttgaagggatgagaaagggaagggatggacaccgtttgcaatcaccgtcaaccgatcgccggatctgccgccacagtcctccccatcgccggaggaagagcaagaggatgagccggcggcgagcaagagcaagaggaaaagccggcggtgagcaagagcaagaggaaaagccgtcgccgctcctcccatcgccggatccgccgccgcccctcgtcctcctccttgcacgccgccgccgctcctcccccgcgagctcctcctcgcgagccatcgcagtccccatcgccgaatccgccgccgcccctcgacctcctcctcgcatgccgccgctgctcctccccgtcgccgaatccaccgccacagtcctccccatcgccggatcagccgccgctgccctccccaccactggatccgccgtgccatcgccgatgccccgccgccgcggtcgtcatcgccgagccccgcgtggtcaccgtcgccgagcctgccgctgtcgccgtcgcccgagccgtctcccgttgctcccgagggcgaacagcgcgagcgcggtagaaaggcgtcgtcacgccgttcgctcgtcccaggtgggacgagttcgtccgccacattttccccaatcagttg

SEQ ID NO: 22378 - DNA, 2567 bp, Oryza sativa
  unsure (1)..(2567): unsure at all n locations
cccatcccactcacccctcaaccaaacacccctaaaagtgggttcgtcccatcccatccactcaaccaaatactaccttatattacgggacggaaggagtagtcatcagtctttggagcaatttgcagaggtaggctgacaggagttgtcacttttctttcggactttcagcacgaatgacctaaagggccccatcccatcagtcctgcgggcagctgatcaagcatcctgtcaccataccacagacgaaacacaacacttttccactcacttttatgttttctggtatacattggtttccattaattggttgtttcaggttcccctgatcgatcagtgcatgcgttctttttttgtgtttgcgcgttccttttgtttggccaattgtgcaatgctagtcccgtgctgtcgataccttcattcaccctcttgagggttcttcctatcgattcgttttgggaaaatatatgaaatatcgtcacacctagttttggccagtagaagatctcccggggtctatcaatgttctaacttgccgagatcttgtcgagagccagaactatttattctggaaaaagtttatgtataccctcaaatttaaaaaccaagagaatttctttctcaaccaccctcttggataatcaagatggaatagatacaataaacattagtgtgatatggtaacagaataaatacgcgactaaaaaccgatgaagtaccaacatgtcaccttagtctcaaacatagctacctagaacaagtaaaagatgatttttactctattactctccgtgctacccctagtggatcctcactctactagccatctagaaaccacactacccctagtgggtcctcactctactagccatccagaaaccacaccccactcacagtatccttaatcccatcaatcccatgcatttatgagggggtattttagagttttcatcctaatccttatgccctaaaatgctagtattacgaagtatattgctatgttttatgatagagggagtaacttcggtaaaaaaattataagctcacacctaatgctatatgttatttatatatggattattagacatattacaaacatttgtttatagagataactaaaatattatataaaaacaagaaaaaaagcttagaccaagttatatacataagcactgtagtttaaagtttttggagaaatcgtagtttgacaatcatgataaacttaatccataagtccataggctgaaaataactcaatcttattcgttgcatatatcttttcctccttttaccatctccgcgtggcaaaaatataaactatctactagaatggaatgagcggatccattcattaacgaaacagaaaaacatatgtttccaaataatgcctccttttttttgtgaattactaataatgccttgtgggagacatgatttgttgagagagacaaatatacaaagaggggttcatacaaaactaactatcgctgatagcgtatttgattggacctctctacaatggttctcacatgaccctatatatagtgacattataatgtagataatttttgttggttctgttttaggttgccacagaattttttattacttccaagttttcattaataaaaacacttacggggaaaacaccagtggtgtggtggtggagtcgtgggtgcaccgtgcatgactatacccaccagggttcaaattttggtgtccacgaatattacgcacatgtaagtggattttcaacaggattttagtgagattaggaatgcgttgttggcttccgtctcttagagcatgtgtaaatacaatttgaaagagaatttgttatctcaaaagtgctactcgctaatgaaaaaaatactgaaaaggattcctcgaccactttccgcaataatattatcgagttcatatctttgtcaagttgctgattgtttcatgtatattaattagccgtttcaaccattaattacattgacatctaaaactcgatgtcaattttgttcctagaattgaaacatgtatactatgttataatataaatttgaaaaaaatataatttaatgtgtgtcattaccaatatgaaacaaaatgttggaatatagagacaagcaatacaaattcattgaaactaaaactcgcactaaattcataataaacttgaaagttttagtgttgggcaaaatttaggttatgcatgtgtaacagtgtaagtttattaattagtcgaacgaaaaagaaggggaaaaaattcaggcgattgacaaataacaaataagttgttaccgtttttttccatataacttgatccagatcattaatataaacgtgatcatatgcattgtttatcatataaattaagaagcaatgaaccacatacacagtcaaacacagctgctaattaatcagagaaagaaaacgaagccgtttataattttcggagagacaagaaatgttacgatatactatagatgatacgttgcgcacgagcgcaatgtgattcgtgatcgattaaannnnnnnnnnnnnnnnnnnnnnnnnnnnnnnnnnnnnnnnnn

SEQ ID NO: 22379 - DNA, 11200 bp, Oryza sativa
catgtcgaccgtcgggacgacgacgccccgcccgcgccgacagaacacggcggccgcagctgccgccgccgcctcccggcggccgcattccggcgcagcagcagccggcaccaccatggcgttaatgttgctgctgtggctgcttctgatgctgctcctgcacttgtgctgttgtgcagatggtggcattgttggtaaaggcgatatatataaggaattggttgtcatatgtgttcatgtggagattcctgtggaaatgctgaccataggttctgcatttgacctggtgtccttaagctcgatagtaattattatgcaactttagtttaagtgttttatatataaacttgggaatgatcgatcagacctaggaggtagctagttagacggcctctccaatcatctgaattgcaggccgttaattattatataatcttatgccgctggctagcttgtgtacgtccatatacatatagaaaattttggacacatcggatgtttgacactataattaaaagtattaaacgtagactaatgacaaaacctatttcataacactggactaattcgcgagacgaatctattgtgtctaattaattcatgattagcctatgtgatgctacagtaaacattctctaattatggattaattagactaaaaaaattgtaaagcagattagctctcatttatacaattagttttataagtagtctatgtttaatactctaaattagtgtcaaacatccaatgtgagaggatacaaacacccgtggacgtcaacaacaggatgatgatcttatgtggctagctgtcaaatgggggcctaaattctagccgacgtaaataatcactgcttttgcttaagggttgaggtcgatcaccacgaaaaatgtgaacttgcaatttttttagggaacctcaaacgcgctgtgtttttttttttgttagtcactactagagaaccccacatctctcggttcgcaaccccctttactcccgggtaacgaaccgggagagagaatccgggactaaagatcgtcccggtttgagtcaccaaaccgggagtaaaaataaaaacgccacgtgacgctttctgttttcttttctttttttattgttttttgctaattttatattgatttcacaccgagctcaaccacacagacaaaatcatcaacaaattgacatcacagattcatcttcaacttcatagaaacatctaaaaatcatcaacaaattcacatcacaaaatcatccacagattcacaaaaacatgtaaaaatcactcacaaatttacatcacaaaatcatccccaaaatcatcgccaagtcgtcgctttcggattgcccgccgcgtgtgcgccgccgccagctgccttcccatttgcgccgcctcctcctcccggcgcgcccgccgcttcctcctcccggcgcccgctgcttccaccgccgcgccatcgcccgctcccgtgcgcgggccgccggctccctacactgcagcgcaggccaccactgctcccgcccggccggccgccacgcccgctcggccgccgccactaccgcccggctggcgccgccactccagagaggggaatggggaggaatgggaggggaaggggagaggaagggaaagagatggagaaggagatggaggccagcgcttttaatgaggggagcagagaggaagatgacgttgtttaatgaaagcaagggggagggataatcggccggataagatccagatcgatggcgtcgggctcggggtgctctttgggtcccggttggtataaaacaaccgggacaaaatgtctacttttagtctcagttgtttataccaaccgggactaaaaataatttgggtctgtctcaaacctaacaacttcttgaaccgggactaaaaatgatctttagtcctggttggtaaccccagctgggactaaagatcaaaattttttagtcccggttctatttccggttcctattagaatcgagtctattgtggaaatcggccgacccaacaaagatcacttctccagtagtgagggttggcaactaatccccgcacaaacaaaacggagcgactcattagcacgtgattaattaggtattagctattttttaaaataaattaatataatttttttaaaaaaacttttgtatataatttttttaaaaatacaccgtttaatagttttgggaaatgtgcgtgaaactcatcaaacgaacacagccaataggctgcgttcgttccgttgcgctgggaattaatctcttcggcacgtaaaacagagcgatttattagcatatagttaattaagtattagcttttttaaaaaataaaaggattaatgtgaatttttttattaacttacatacataaattttttgtaaaaaatacaccgtttaatagtttataaagaagagcttgagttgagaaagccaacaaaaagaatacaaccatatatagaagtaaccataaactaacagcgttgcagaggatcatccaaatcctgaagactgaagaagctgtcaatttatggtgtattagctagataggtccgctctattgccgtcctcagctagttttagccgatctcatatttgtttaagcagccggactgccgagcatatatgcataatatattttctgacggctggggttcatgcactgccatgcatctggtcgacgagtccatggcatgcatgaatcatggcatctggtcgatgagtccatggcatgcatgaatgtgtgagtaatatattggtgcttccagatgacacggcaggggaaagggagaagagaacatactactgtatatattatgcattcactatttgtacccaaaaagagaaaccctgtcctcactgttagcctgtccaagcttatgctggtttggcgtttctgtgtccacattttcttcttactggcctgctaggctgcgaggatactgcttctttgctcttatttttttcttcttaagaaatggatctgtctgtttcaatagccgacatatgcgtttaagaaatctgtgtcaagcttttgcaccggcttccgtgtataatgtttgaccgtccgttttatttcaaaattttataatttttttaaaaaaattaagtcacacataaagtactattcatgttttatcatctaataataataaaaatactaatgatagaaacaatctaataagatggattgttaaacattagacagggaaactcacaactgcacttaaaattggacgcaggaagtatgctcttttttttaaaaaaaaaaaaactatagtttgtttgctatcaagcgatgtatatattgtacgaattaccactagtaggaaaaccattttcctagacaaattactaccatttttctagcctgcaagatgggaaggggaggctatatggccgaccgcctgggaaattggtgatagcataatgtgaagaaacacaattatgcaatggcattttattgaacttgcattttttgattgcaatttgtaaaatcaattgcttgttaatggaaaaatataatgtagagtattcctcattttcctatcaagataaaaaatcacatatattttggttccaaaattttactatacatcgatcggtgatggaaaatatggacgatatcgtaaattttgatcagtgataggtgacagcataatttacgacggagtgtcacaggtccaatttccctagattctagtggcacactactacagaccctatttttccgtgcggttgaatcgattatcccgtgcggtggctcggcctgcctgcagcgcctcgtctgggaaaatcggtattttcgcgtgcgggcgggccgaccgcacgagataatcgattatcccgtgcggtccgttaatcggttatctcgtgcggtgcagtaaggaggactgcacgggataatctattatcccgtgcggtcaaattataccgactgcatgggataataggttattccccacggctagcatgtgctagggcaaccgcacgagataattcgtgccgtcggtttgtgcgctaagatcaaacgtgcattcatagagatgggaaaggagaataaatattatgctaattagatgtctcctttctcatgaataaagtagtaggtatttggtgttttactttccaatcatgtaagcacttgctatgaataatgtggctcattggtgttaaccccaatgtttgccaagtttgttttgtttatgttcaataaagttcaggttttgaataagtgtgggaagatatcccagcttctgacgtgcatatagtctgaaaattgctgaacatctgatgtgcatcaaactctacagaaaattgtagagtgattgggcactcgagtggttcggccgaaccaacactgaccccaatcaccctcaatttccacaggtaagcaggtgagcacgtctattatctgtatatctctaccatgatatggtactagagctggaaattcagaaaatgattggttcaagcataattgaaaagataaaatctccaactaatgaaattctttctatgattaaccttgtatattttttattctcagctgaacttgtacttgtgaacaatcatccatgtttagggaaccttatgcatctaggtaattgctatatgtgagatgattaaagatgaaagaaattcttgcaatatttgtcataacttatgggaatttgtttttcaaaataaaattttgttttaaaagctcattcctctaattgactttactctatacctaccaaggccatatgcaagtatatcaatgataaaccttattatgcatatgactgcttagcattatattgagctttatcaaatgtatgtgactcgtgttagatatcattcatactctcaagatcaaggggtcatttccattttttccacatatataattaagctaagcttctacattggaaattggcttcccacaaaaattccattcaaataaactcctactttagactatgctttcttctcctagaaaatccttggcaaaaataaaaaaaatgagaaaaggagggaaaggcatggctatgaaaaaaaaagaaagaaataaagcttgctctcaaaacaatgagcatgaaaatggagaaggtatagtagaaaggataattatttctttattccatcattccataaaatatttttgcttttccattttccaccacaaataaagacccttgatctaggagtatgactgatgatcttcttgagtccatatttttggctttgcaatatatatgatgcaggtatgtcacaattttatccctgccgagctccacatatcagccttagaataggaaaaagttcagacacaatttgccttggtgaggacccacaaagacagaatacttgagtgacaagagagaaagtcaatatgagaaaaagagctagtttgcgaaaattcataaaatcccatgagtttgacaagtggaacaagaagggctggaatcgagatcgttccatttatcaattactcaagatggtaagttagccactgatagagttcacaggtgcaggtatggctttgaataatttatatgcttgaattatatcttggagaaattcattctacactaacctttactcagggacgagtaaagagctaagtgtggggggttttgttggcagttattaaatgccgattctataccgccaacatctgcataaagtacagataataaaacatccaacatagtgataggtgttaaatctcacatattccacaagtgttggtgtatattggtatgcaggtgttaaaccctgaagatgggaggggaaacaaacaaaagtgaggagaaacatgtatccacacaaggatgggttgtgaacttcatcaaaataccagagaatcagcccaaaactctgagaaatggatagaggagaaccaggaccatttacccccaagtaccccacccaatggcgcagcgatcttggagatcggcatcatcttctccaactccggccgccgagctccatcttcgatttctccctctccggtgagtcccaatccgattccctgccatggtagcctcgcatggacctctctaacacgaaagacatgaatgcatggtagtcctttgaagaaatcgagccatcgttgttcatccaaggtgaagcgccactgccgagacatttcgcgagccatcgtcgacgaccaagcttggccgacctcatccgtgcgccaggatgccgccgtgcgtcatcaccgtcggcggtgaacccctgcgatgcgacgctgccccgccgtggccgagccatcccggctcgggccagccgccgtcgcgaggaagaatggggaaaagaaaagaagagagagaggaagaacagtatgtgtccaggggcattttggtacttacacagctctttctctctccattttgaccggaaataataaaataatgggaggactgtccagcaacttattaccactttttgcagtgcccacgagcaaatacacgatcttcgggtgtctcatagcaaaggtcgcaatctttcggtgtcctgtagcaaattttgccatgattttcacatgcatggatcttctgaacacctagagataatggacatatcaatttcttcgcttgataagtgtttgtcggcaggaggttcgacttagcaagcataactctcaaaatatccatcaaatcattgaagcttgtgtccgatcatccatgtctggacttcaatctgagaagttcaagcacagagcgcaacaccgtatagtccttgtcgcatcctttcgcttcgtcgtaaagaagatccttcgctgttttttcaacgcttcccaattgtccaaccctcgtcttctaccagttaggacctctggttcaacatgccgcaacatatcttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacgaaaacttacaaaaatggaagcaaataaaggagaagaacaagctctacaccttttatatggaacccaatcaaagatttgaggtcgaaaaccttcccccctaatttgtgggtgtttaggagagagaaaacaccgacatatatggcaacggtcgggctgggggtttatatagccccccgaccatcgcaagcggtcaccttacgtgggctgcacgggtggcgccggtcttcggcttgttctaggcggagctacttatggcccgcctggaagctataggggccggcgtccagaaaaatctcgcgtgtagtagtggcatgtggccgatatcgtgagtaccattgatatttatataaagtagcatatttgtagtgacatggatctaattaacccttttatttaaccaatcacttgtctttttacgctgattttatcggggcaaacagtggttgtgtgcttcgtgcgatgtggggaggagtggacttttgtcaagttttgggatatactccgatcctgatgtcctacattttttaaacccacatagtctaggaagaaaatagcgtgttttaggtgctctttgtctaggtttacaagcaaatacagtaagccaaaaaatctaaatctaaacaacagctttttcatttgtttttttttctaaaaccatgagtcactctatcactgttaaaccaaaagttagttaggccgaagaaacatttttaccttacgtgaagtaaaagtgtgactctaacattaaacttaagattttttttcagggattaaacttaagactttaaattcactaggttgtaaatcacataagctaaaaggataacttaaaatttctcaaaaaaagaaaggataacttaaaagcctataaatcaatctaaacaaaaaaaaaacccttaaataggtctcgaggcaacacgaagcctttgtatccagattttccataaaagatgctctacgggcctaaacttgtgtgcagatttcagcccaacgtccgcacggagcttaattagttcccaccacccacttgagccgccgccgctattcatccatggagccggcggcgacggtagcaatggatggatggtcggggccttgccgagtgccggatggtggcggtggccggagtcggaagagcgccggcgtacgtgggtggggagtaatttctgatccgtggatgcacaaccaccgtacgtgccagtaacgtataccgctccactttggtgcctgtttgggaaaagcgctgccccaaaagtccacagtttctaagaatatgtagttatatattctcaaaaatgaactaagaaattagaagctgaaggagctgggttttcagagcttttctagattctcaaaagctggttaccaaacagctgcttattagaatctaaagctccgtcaaacaggcgcttttatctccgctgttgagtacttcattttcaggtcatctaatcgctggagtcgtttgacgattgcaaggtacgtacatgtaggctcgagctaattaagctgcagctagctagccagctcaagccactacataccatttgagtgttctggtagtgattttggaggatttcaattaccaatattttttttatagaaccctgtggttcatagaaaaggaaagaacattttttggtaggattgtattccgacggcttaatttcgtataagaaaataagaaagaaggtttgatcttttgatgattttcattcctgtgggattagagaagaaaaaaagtccattttactgccccaaactaattcaatggatcacttaactccctaaactattttttaggctcattttaccccttgaactattaaaaatggttcactttactccttaataacatttcctttttttgttactttttatacaagttttattttaagctgaaatttgttagagtaatagttgacaccattaccaaagtttaaaaatattttgaaattttttttcatggtgttagcttgaactttaaaattttgatgtttaaatcagtttggagtggattcaacctatgcaaacagtgaggaaaaaaatcataaaagaatgtaagatgtaggttgtggatgcatttttattctaccaatttttcagtgcaaaatatgacttatacaatgagaactaaagaagagaaatagcgttaggggagtgaagcaaacatttttaatagtttagggtgtaaaatgagccaaaatatagggttaagtgcttcagtaaaatagtttgggggagtaaaataaactttttcattagaggaactcaatatttcaattcttgcgttattctattttttgtgtttttcctgtcctgtttttcacagataaactaaatacttacaaatatttggtatgtctgcactgtgctctgtggatcatgttctccgtgatcatcgatctctgtcaggcaagacgccaagaacacatccaccaaatctttgacccccgggagagaccatgccaagaaccacactccccaacacggacagaacacagaagatgcccctcggcaacagcgcgcggcgcagctaaaataaaattccttatcccctttgtgctcacatgtgcattgcatatatgcagccttgctgctcgcctgcaatgcaagtatgcaacctgtgatcctcctcctcttctcagtcagaggtgagccccctcctgtgacccctccaatgccgttcacatgatctcactctctctcgctctcactgtcgcacacattgagcagtgtgactcagtgagccacctctgcctttttacatgaccatgctgctcttgtcctagctgcacatttcacacttcacatggcaacagaagcagcagcaacagcaagatgtcttcttcttcctcttctttctcctctccaatctccacacaagcagcagcaactcatctttgctgctcttctccttctcttcttcttctcttcactccagagtttgcactgctatgctgctgctggttacaatgagcagcaggaagctgata

SEQ ID NO: 22380 - DNA, 19105 bp, Oryza sativa
  unsure (1)..(19105): unsure at all n locations
tttttggtacacatttgttacatgagtgcatatgtgcatgcagggccaggttgctcatcagttggatatggagctgcctctgaactagggcccctcagagttagcagaaatggagctgggcttgagttcaacaaatttgcatggaacaaaggttgtgcaaaaactaagcatttttgtttcttataattgttccaattggtttgagcaaattaataaaatgctatacgcatgtcactgtttttcacattgttcttgccagaggccaatttgctgttcttggagtccccagttggggttggcttctcctacaccaacacatcctctgacctcaccaaactgaatgatggttttgtaggtaattcagtattgttattggtaaagtatatttttcttgaccattgtttgtcacatttgagatgtttttggcgccttccttccttgtagccgaggacgcatataatttcctggtaaattggttggacagatttccacagtacaaagaccatgaattctatatttcaggagagagctatgcaggtaattcttcacatgaacatgaaagtcgtctcttgcccccttggccttctttttgttgttttgattagaacaaccaaccttgaaattgtagcctacatgtctgaaaaggttcaggaaatgatgctaatgcatcaaattcagattatagttgacctttccaattaggaatttattagtaatacttgtatctattccgtaataaccatgaattggctttgagataaactaattcaaatttttactagatttgagccaatagttcagattatgcatataagatagtttgctgagccctaatatgtctactacaagtttctagaagttcaaaattttagttgcaggtaatatagtgatctgtcctgtaaccataaaaaaaaagcatatttaggtgcttaggaagaaggatatcataatccgtgaaaatagaagcaaagtgaatatgtcctggttaacatcatgacttgacatcattttcatactatttagatatgaaggcgtgtcctcattttccaaaatgaaatgtttcattcctgcaagatcctcatcccattgagcactactagtggtattgactggtcatactagaattatgtgatatctcatatgcggtagtaaaaaagatgccctataattccttttccctgtacatcaccaacaagaattttcgaattaatgcaggtcactatgtgccacagcttgcagaccttgtctatgagaggaacaaagacaagaaggccaacagatatatcaaactgaaagggttcattgtgagtacatccattcactgattagtttgccagtattgctggtttggcttcattctttcatatttcaaaactggatggcaatattatttggtaaagtccattttaatggactcaaaaactcttcgttaagaatccgagagctgaaagtacatttcacctataatattttagcaacatattgacagtaatgatgatgctttttctagataatggtctttaatttagataaaaatcagtggaacatcagaaaagagtatttcatctattattgaaggtccaacaggaaaaataaaatcttgcagttctcgaaataagttctaaactttctggaatcataacattggtacttgggcccaaatacaggttggtaatccacttactgatgatcagtacgactcaaaaggtcttgttgaatatgcttggagccacgcagttgtgtcagatggaatttatgagcgcgtcaagaaggtgtgcaacttcaagatctcaaactggacgaatgattgcaatgaagccatgagtagtattttcagacaataccaagagattgacatctacaatatctatgcacccaagtgcaatcttgctcaaacatcaagagtagctgctttcgatcacgcactcgaagcaagcgatcaggttgatgacaaatagttcaaattagttctgcttctgaaattctaaggcttgttgtttgacttggtaggaacaattcagtaggaggattaggatgttctcaggatatgacgcgtgctactcatcatatgctgagaagtacttcaacaagccagacgtgcagaaagcattccatgcaaatgcaaatgggatgctccctggaaaatggaaggtttgcaggtgaattggcttcttttctttctttttttttaacttaagaatcggcttaaatttcttccactaaaaatatttagagtggcaactgtagatttgttaaactcttaaaattttatattttcttttaaatctgaagtccttctctattgcatattcagctatacatatacgaggggcatatatggaccctttttgggcctagaaccacacacacatgtacacagcccacacccacaaatatacactgcccaacagtccccctcaagatgggcgataaatatctatcatgcccatctcgctacatgacgacatacactatttaacacctaaagccttcgttaaacaatcaaccacttgttctctagaattcacaaagtttaacttcaaggttttgtcatctatcctttctttaataaagaagcgatcggtctccacatgttttgttcgatcatgttggactgaattgttagcaatattaatggctgatttgctgtcgcaccataacttcatgggaatgtttatcatcaacttcaattcagttagaagatctcttacccataacaactcgctcaaactaatcgacattgacttgtattctgcctcagcagttgaacgagacaccaccaattgtttcttgcttctccaagatactaaattgccacgaacaaatacacaatagcctgatattgaccttctatcatcaagacagttgccctgatctgcatcacagtatccctccacatcaagatgtcaattttcttgaaccataagcccttacctaggcttcccttcaaatatctcaaaattctatacacagcatccatgtgaccacttctaggatctgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacattcccctcttcttcagaaacggcttgtccccaagccggtgcttcagggaaacgcgcacgcagtgcagcaccatcctcccaggttgcttcagcggacgtctgaccagaccaacgaatcttgagttgttccacagctccagcgcctttcttgactgcacgacgagcaagaatttgaactggtagcgcttcatcttcagttaacgctggcaggtcttgaatcgacgagtcaggagctggtgaagaagcctgacagagctgtgagacatgtactactggatgaatagcacaagttgtcggtagttgcaggcgataagccacgcttccaatgcgcgccaagatctgaaagggaccaaaataacggaaagccaatttgtgattagaacgtcctgtcaaggagaactgagcatgcggctgtgccttcaggaacacccagtcaccaacttcaaactcacgatcagaacgtttcttgtcagcctggaacttcatacgttgctgagctcgtaacagatgttgtcgcagcaaactggtaatcacttcccgttccttcagccagtcttgcaaatctggaacagcacactcaaagcgatcgagcacaccaaaatgccgaggagaatgaccatataatacctcaaatggtgatttgtccagagccgaatggaaggcagtattgtaccagaattccgccaaagcgagccaacgataccacctcttagggcaagcgtgcacaaagcatctcaaaaaggtttccaagcactgatttacccattcggtttggccgtccgtttgaggatggactgtttgccaagcatgcttgggcactggaagaggctgtaagaaacctgggtaccgaacccgttctgctttggcctgtttacagatggaacaagccgacacaaactggcgcacagcttttctgagtccaggccaagcaaataacttattcactcgactgaaggttgcctgagtaccagaatgacccccaattgctgcattgtgcagtgcagtcagaaccttagtctgtaactccacattgttacccaaccaaatccttcccttatggtagataatgccattctgtaatctgtactcagggagcgcctctggacttaacgagagcttagtcaacagttgagaggaaacttgatcctgagcatatcccagctgcacatctgccaaccaaactggaatacaggaagacaccgcactgagttgaaacacatcggttgactgattgcgtgacaaagcatcggcggctttattttccagtcccttcttatagacaattcttcttatagacaattctgtattgtaaaccaagcagtttggtcagagcacgctgttgccaaggtgttactaatctttgatcatccaaatgaatcaaactgcgctggtcagtacggattataaactctccaaactgcaagtaagagcgccattgttccacagcgagaagaatcgccaagcactccttctcgtaagtggacagcccttgatttcgaggccccaaagatttactgagaaaggctaacggatgaccagcttgcatcagcacagcgccaacacccttatcacacgcatcagtctcaatttcaaaaactttggagaaatccggtagtgctaggacaggagccgaaactagagcttccttcaaggcatcaaaagacgcttgatgctccgacgtccaaacaaacaccacattcttcttgagcagatcagtaaggggcctgctgataataccaaaagagcgtacaaacttccgatagtaccccgcaagacccaaaaatcctcgcacttccttcacattacagggtactgcccagttgcgcaccgcttgaatattctttgagtcagtggccacaccttctgcactaataacatgcccaagatatgttagacttgcacgggcgaacgagcatttgcttctcttgaccttaagttgatgatcagttagcaattgaaacacccgtcgcagcaaggctacatggtcgtccaaattttgactatagattaagatgtcatctataaacaccaacactcctttgcgaagcaatggagctaagatctgattcatcaatccttggaaggtagccggggctccggtaaggccgtaggacataaccctgaattcgtagtgtccattgtgcgtcttaaacgctgttttgtgctcatcttctgggcgcatccggatctgatgatagccagctcttaaatccaaactcgtgaataaacaggagcccgccaattcatcaagcaactcatcgataattggcaaagggtagcgattcttgactgtaattgcattaaggtggcggtagtcaatacagaatcgccaagtaaggtccttcttaagcaccagcagaacaggtgatgaaaaaggactagagctgggttgtatgattccctgttggagcatatccgcaacttgccgttcaatctcatctttttgagctggattatatcgataaggtcgcaagttaacaggttttgctcctggcagtaaaggaattgaatggtcaaagaccctggccggtggtaaaccttgtggctcatcaaagacatgaacaaattctttcaacaactggtcgacagcctgaggtacttctgtatttgttgtttccttgatcagagaacacaactcaaccacttgcatcacagcttcccgatgaatcagtccttgaacttgattgacagatagagatgtacagctgctaatatcagctctaacacctcgcaaacaaacatccttttgtgcatgtttaaatctcagagtcttagccctccaatcaatttgcataggactgtgttgctcaagccaatccattccaagtattacgtcataacttccaagaggtaacactttcaggttgttctgaaaagaaacaccctgaaccagccaaagacaattctgcatttctttgttacattggagtattcccccatcagcaacccgaactcgaaaagattgcacagttttctgattgcctcttatcttgcctgccatttcttcagatataaagctatgagtgctgccagagtctacaagcatcattatctcatactgttgtattaatccttgcagcctcaaagttccagaagattcagtccctagcatagcttctttagaaatctgacagacttcgctaacagtttcagaagccctttctgtcagctcatcagttccagcggatttggtttccccatccgattcctcaagcaggtcgagtaactcctccacaacatgtaactgcacagttggcccacacttatgttccctactccatttttccccacaagtgtgacacaatcccttagccttgcgataagcacatagtgctgccactcgatcctccagaggctgagttctgtcatcaactcgcccaccagctcgcccaggagtgaaagcaacattccccacagtacgctgtccgacccgatgagaaaaacctccatcaatccgacgcgaatcccgtcgtcccgcttccaacacctcttcctgtaaacaagcaaggtccacagcagtatccaaatcgtttggacgatgtaaaattacggctgcgcgaacttcaggtttcagtccatcaaggaattcagtaatgaagaatactgaattccaggatggatgatgagcatagagttgatgcatcagctcattgaatttttctgcataactaagaacggttccctcctgcctaagcctcttgaactgtctaatgagactctgaaattcctccctcccgaacttagcacaaacagcatccgagaaatcattccaccccatcaattccacatgagcattggtggattgcaaccacactagagcactccccgaaaattgcaaagcagcaaccccaacccacacatccgggctaatcccacttactcggaaataagtttcgcatttcattttccaggctctagggttctctccttcaaattgtgggcaatctactctagcattacccccatggaatcccttggccgggagagacgttgaagagaaatcatctccagacgccttcccccgattcatcgttgcaacgttgcggcctcacggccctgaactcgcgtccgcccctttggaggccgtctcctcctccttcggcaccgtcggcgtgggtagaagagggggcagatccgctggcttgacggcgagaattggattgcgggatatccgctccacttgctggcgcaggtcgccgaggtcgtcccgcatctccgtcatggccttgtccaccgccggtttccagctcgcgagctccaccaccataggcttgatttcctccaaggatcccatcgaagcttggatggcggtattctgcttctggattgtcgccatggccgccgcgagttccgccaattgttgctccatctcttgggacttgagttgcgcacgggaatagtatctaggtttgtcgaggtactccaggatggatggctctgatacctattgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacaggattatgcatatactgacttatcacacttacagcatgggttatatcaggtcttgtatgacacaagtatatcacctgtcccacaagtctttgataactctctttatttactgggtctcctaattcagcacacaacttatggttttgttcaatttgtgtagaggctggtcgacaaccaagcatacctgtgtcactgagtagatctaacgcatactttcattgtgaaagtactatccctttaggagatcttgcaatctcaatgcctaagtatttcagctgacccaaattcttaagttcaaattccttacttagattttcttttaatcttgctatctctatagaatcatccccaatgataatcatgtcatccacatacacggcaaagatagtagcgtgacatcccttatgatgatagaatgatgtatgatccccattacattgcttataacccatgccacatattcatagtgaaaaaaacgtgaccggtagatgacccggtcaccatgctggttcactggtttcacggttcaaccgtgaaccggtcggtcgaaccgcagtttactaagtacatgtaatatatatgtaatatatgtatttctgtactgtcacatacatttggatggtaggatggctacgggagttggcttgtaaccgatcgactcggggtcgactccccaccagtgcacatttccttcgatttttgctaaaaaaatcaagcctgtggacatgtatggcccaaaacacactaactcggcccagtttgtcttagtccgatccgaccaaagacggttttatgcctggttcatcgcaaaaccggctagtttaggcggttgaaagtggttcaaatgcatgtccggtctttctattcgaccgaaccgtgccaacctccagttccggttgaaccgccgatccggtccggttttttacactaggcacgcattacacgttgaaaacaatcaaaccattctcctggtgattgtttgagaccatataaagatttcttcaacctcaacacttttttccttcagtttgtgaagtgctaaatccaggtgggatatccatatacaccacttcttgaaggtctccatgtaaaaatgcatttttgacatctaattgatgcagtgaccaatcaaaattagttgtacaagtttcatcataatcaattccatatgtttgactataccccttagcaacaagccttgctttctacctttccttctttccattaaggttttgctttattgtatatacccacttacagttgacaactttcttcccttcaggaaatggtacaagattccatgttttgttcttctcaagagcctctagatcatccagcatagtttgatgtcattttggatcttgctttgcttctctccaattctttagaattcccactaaatctaccgatgctacaaaggccttatatgtagatgacaaagagtcataagaaatatagttggatatgttattctcatcattaccctcatcttgagcttcaaaaccatatcttagggaggtttacctacattgctttttacaccctttctgacggcaattggtaagttagattcttcttctctaacttcatcctcttctccccctaactccaaaggcacttgcacatgacttgcatctcccactacttaattatcctctacaacttattggatcactggaaatcttgccctccttttgtaaacttgaagattttcctcttcatgtggctttctcaactcttgctcttatataggatcattcatatcaactgggatttggccaatcacaacttttttctccttcgcttggtcatcttccttggaacccattattttatcctccctttgtttatcatgattacactagttgaattatcaagatcaacaaaaaaaagaacttaaatctattttctcatcataaaatggaacaaattctctaaaagtaacatccgtacttacaaatgttcattgttctgatggactccaacacttataccccttctggccagaggaatatcttatgaagatcaagttgggcatcagaaggtctgttgtttctgacaaagcatgtgcaaccattcacctttggtgaaagaacaaatacattcttgtgaaatatcatctcatatggtgtcttcatcacaagtattaccgatggtgcgcgattgataagatttgtagctgccattacagccacactccacaagaatttaggtacattcatagtatacatcaatgaacgagctgtctccaaatgatgatgatttttcttctcagccaccccattttggggaggagtatcaggacaagaagtttgatgtaatattccttgtgatgaaagaaagatactaaattcttatttatatactcccctccattgtcagttctaataaactaaacccgagcattaaaatgatttttaatgtatgcataaaaattctgaaaacatttaagcataaaaattctggaagcatttaagcacctcgtccttgtgcctcataagatatatccatgtcatgcgagagtagcaatcaataaaggtgacaaaatacttcattccactcatagaaaccacaggtgaggtccaaatatctgagtgaattagcataaagggcaacatacttcggagtcctctactcacatatgacatttttgtatgtttcccatactcacaagcatcacatactaacttatgtttatccactctactgaactctactggaaatattttacttataatttcaaaagatatatgtcccaatcgacagtgcaaaaataacaccttagctcttcttcacttgtggaagccatcaaagctagacacatggcttcattagtccttccccgatccaaatacgaaagtccatcatgcctgacaccaatcccaagtttcttccctgtttgcctctcctgaattaaacaattctcacgatcaagggagacttgacagtccatatgatcaacaagaaaactttttgaaaccaaattcactggaaagggagaaatatataacactgatgataaagtgattgaaggagtacactgcactgtaccctctcccttaagtgggcatgatgttccatcggcaatttgaattgtttctttacgtgtaaatgggtatggtttatatgatgcaaatgccccacgcatactcgttacatgtgtaatgcactagagtctaatatccaatttggataagaaccattgatggacataaatgcttgatttgaattatctgaggtggaatgaacaaagttggtaacatcaacatttataggttcagaagaacccccttcaagagtgaccacattagctttgtgatcacctctgtactcatagcctctacctctgttatctctactttcataacctcttccacctcttgctcctcctctatcaccatttcttcctcttccataactaggcttgtgagaagcacgacaatcacacataagatgccccatttcaccacaattaaagcactctctagttttattaccttgtacaattgcataggtgggacttgatgaagacgatgtggcataggaaatagtttcttcttaagctcctcttgtgccatagttgcaatagccacatctaaggtaggaagagtggtttggtgaaacattgcatctcttcttcctttgaactccggatttaagcccttcaaaaactcaaggacccttttacgctctacccatttcttcatttttgctatgtaattagaatgctctaacccaagaggatcataataatctaaatcaaatcacaaacacttcaactctgcgacatattctgccataggcgctccccctgtttcaaagcacttatcttctcttgtgccaccatcattagcatcatattaccttcttctgagtatagattagtgagagttttccacatctcactcgcactagagatggtctcaacagttgtagcaatagcagggattagtgaggtcaactaccacgctaccactaaagagttggtagtacttcaagttttccattctacacttgtgctctcaggctccttcacttctcctatgacatatccttctaacccctttgtctttaaaatcaacattgctctccttgtccaactcaaataatttttgacaccctccaacttaatatcattttgcatcaactcaattttttgtactgattcagcatgaggaacaattgcattgatagtagtagaggtctcactgagtttctttgcaagcatatctaccaattttcccatcacctgttcaattccttgattttcccccattacagcaactacaactacatcccttctatttcttcccataacaacaatatcaagcaaaacatcagtagaatagttccaaccttcccaagtgattgatttaaccaccgcagtacagatcaagttacaatgaccaaattcctcaccttcttaagtgaccaacagaaccaagtgcagctctgcccccaaatctcgtgtgccccttcatttcttgttgtgagatctcaacctaaccttgcaatagcagacaaaagctacagcagctacacagcaaactaacccccccccctttttcttgcaacggcaacagcaaaagctcaccaaatcctcgggccacactcctctgcttcctccaccagtgcaccttggtgcatgcgctagcctctacctgtcctgctccctctggtcgccgtgagcccgtgagtccctgtactgccttcctggccgccgtctcctgaagcgcctttgcgtccctctcgcgacgctgctcaagcgtgagcccgtcgtcccggcccttcaccgctggcttccgcgcctgcgccctttgccttccaacgcctccacgacgccggtgcgccacactcctgttgggctgtgtgtgtgttgtggcccaagaggcccatgtaccgatatgcttgcatatgtatagagtaagcaattgacagagggtgtgaagcttccagaaaaacaatcacaaatgtcttcatggtattagagcttggtcgccagcgactgcgtcgacactaaaccctagctggcggcggctatggccagagaagcgcggcgcaccggcggtgtacttaggggtgggcagaaaaagaccgagaccgagaaattcggtcatcaattcggtcctaggaggtgaaagaccgaattttgttcggtcaattcggttagtctcctcggttaaccgaatagaccaaaaagaccgaattaacaaaaaaaaagtataaatacaatctacaatccactaagttcaataggattaaactctaattttcacatccctacttcttctaggcatataacctaataagagtttttactcatacgtgcttacggatttttttttgtgatttttgtgttgaaaatttccattatttctctgcatatatgaaaatgttgctgaatttcggtcagaccgagaccgagaccgaaaagaccgagactgaatttgtcggtcctgacatttttgcgttgaaattcggtcttcacttttcaaagaccgaaataaccaaaaggccgaagaccgagaccgaaaatttcggttagaccgaacgcccacccctaggtgtactggcgtgtggtgctggagctcctgacgaggaagagagcgtgttgagggtggagacagtggcaactattgtggtgagggagcaaggcagcgacggttgctgtggtgagggagcgacagtgttgacggtggaggcaccggcagctgctgtggttgtgcttggaggaatccgacatggagagaaggtgtagctagctggaagcgccaacggcgaccgcatgcgcggagggcaagttgacgatggcgtgtggagtgaaggtgcgcttctactgttggcgattgtgtgtgtggagagaagatggtgatattgcttgctagcgtgtagaggtgctgattgagaaggtgcagctgccgcttgctgcttgagaaagtgttgcggatgctgcttgagaaggtgagaattttttctactgctactgttgagaaggtgaggatttggtcagattgaagtctcacagcaataaaagaaggggaacagattaacttgtggaggtgagaagaaggaatatagctgctataaccttgctgtaatgcgggaaaatcaagggattgaacaggtgatgggtaaattggtagatatgcttgctaagaaacttagtgagccctctaataccagcaatgcgattgtttcccatgctgaatcagtaaaaaaattgagttgatgcaaaatgatattaaattagaaggagtcaaaaattatttgagttggtgacggagagcattattgatcttgaagacaaagggattagaaggatatgttacaggggagataaaggagcctgacagtacattaagtgttgagtggaagacttggagtactaccaactctttaatattagcgtggttgttaacttcacttatccctactgttacaacaactgttgagaccatctctagtgcaagtgagatgtggaaaactctcactaatttttactcgggagaaggaaatgtgatgctaatggtggaggcacaaaagaagataagtgctttgaaacagggggaacgttctgttgcagaatatgttgcagaactgaagcatttgtggttagatttggatcattatgatcctcttgggttagaacaccccgtttgtatagcaaaaatgagaaaatggattgagtgcagaagggtcattgacttcttgaagggcctaaattcggagtttgaagggagaagagatgcaatatttcatcaaaccactcttcctacgttgatgaggctattgcaactatggcacatggggagcttaagaagaaagtattgcctagtgtcacaccatcttcaccaaatcccacatatgtagttgcacaaagtaaaaagatcagggagtgcttcaattgtggtgagatgggacaccttatgcgtgattgtcgtgctccacacaagcctagttatgggagaggaagatatggtgataagggcggggcaagaggtggaagaggtcatgcgggtagaggtaacagaggtagaggctatgagtatagaggtgatcacaaagctaatgtagtcactcttgaagagggttcttctagacctacaaatgttgatgttgccaaccttgttcattccacttcacataactcaaaccaagcatttatgtccatcaatagatctctttcaaattggatactagactcgggtgtatccagacatgtcacgggtatgtgtggagaatttgcatcatataaaccatacccatttacatgaaaagaaagaattcaaacggctgatggaacatcatgcccagttaaaggagagggtacagtgcagtgtactccttcaatcactttatcatcagtgttatatattccttcctttccagtgaatttggtttcaaaaagttttcttgttgatcatatggactgttgggtctcttgatcgtgagaattgtttaattcaggagaggcaaacagggaagaaacttgggattggcatcagtcgtgatggactttggtacttggatcgaaaggggacaagtgaagatgtatgtcttgcattgatggcttccacaagtgaagaagagactaaggtattacttctacattgtcgactgaggcatatatcttttgaaactatgagtaagatgttccggcagaactgagtagattggataaacataagttagtatgtgatgcatgtgagtatgggaaacatacaagaacatcatatgtgagtaggggactccgaagtatattgccttatatgttgattcactcaaatgtatggatctcacccgtagtctctgtgagtggaatgaagtattttgttacatttattgattgctactctcgcatgtcatggttatatcttatgaggcataagaatgaggtgcttaaatgtttccagaacttttatacatatattaaaaatcattttaatgctaagattcagtttatcagaactgataatgtaggggagtatctgaatagtgaatttggtagacttctttcattggaaggaatattacatcagacttcttggcctgatacccctctgcaaaatggtgtcactgaaaggaaaaatcgtcgtattttggagataactcgttcattaatgtatgctatgaatgtacctaaatttctgtggagcgaggcaataatgacgacaacttatcttatcaaccgcacatcatcaaggatacttggaatgaatacaccatgtgagatgatattgggaaagaatgaatttattgttccacagctgcacttgctttgttagagatcatagaccttctgttggaaaacttgatcctcgagctgtcaaatgcttctttatatgctattcatctggccagaaggggtataagtgttggagtccatcagaacgacgaacctttgtaagtatggatgttacttttagagaatctatctcattttatggtgagaagacatatttaagttctttattcattgatcttgataattcaactagtggtcatgatagtcaacaaatggaaggtgaaatcttgggtccaaagggacataaactatcaaagaaagaaaagtttgtggttggttcaattccatgtcctatgagtagtcctattgcacaagagcaagaatggagtaagccatatgaagaggaaaatcttcaagtttacacaagtataacaaggtctccaataatccaacaagttgaagaggataatcaggtagtggaagatgtaagtcatgagtaagggactttggagtcagggggaggagacgaagaagttagagaagaatttaacttaccaattaccgtcagaaagggtgtaagaagcaatacagggaaacctccactaaggtatggttttgaagctcaagatgagggtgatgatgagaataacatatccaactatgtttcttatgactctttatcatctacatataaggcctttgtagcatcactagatccaatgcaaagtccaaacgattggagagaagcaaaacaagatccaaggtggcatcaagctatgctagatgaactagaggctcttaaaaagaacaaaacatggaatcttgtaccatttcctaaaggttgtatgtgtgttgtggcccaagagacccatgtacccatatgcttgtatatgtacagagtaaacaattgagagagggtatgaagcttctagaaaaacaatcacaaatgtcttcagctcgtccggccgcagcgccactgctgatatttcttaacgatattactagaaatataattcccagcaatggcgctataaatattctcggcctagaaccacacacacatgtacacagcccacacacacacatatacacagcccaacaaaatctaacagtagttgcaactctaaatgaaattctatctacacttaacagttcaatacactattgtcgtaaatcatacatttttattctgatatttagccatctttgtgaatattaggctaagtagacattaatatttatttgaattgtttaatttttgatttatcatgcagtgactccattctaaggtcatacaacttttcggtgctttctgtcttgccaatctattcgaagctcatcaaagcaggactcagaatttggctctacaggtgtgtttcctcttcctgtacctttagaccattttcctgttccaaatacatgcagacatgaacattttcatcacctatccaagcaagcatattttcccctgataacacttcttaaaacttatcagaaatataacgctgcttctatctgaattttaatccttcaaaacagctgctaaatagtgctgggaagtttaatacgagtaagattgttntgcatttagtggagatgccgacggtagggtcccagtgatcgggtcaaggtactgcgtggaagcgcttgggctgcatatcaagaggggactggcaccttgtacctgaacagacagagctgaatttttgactatcatcagtgatgttacattctagtagcaatgtagcactgatgtagttagtcaagttagttgatggatgtgaatctgtattctagtagcagtgtagcactgatctggaaatcacttgcaatataggttgcaggaagatttgtggagtacgatggcatgaccatggtgacgattagaggtgctggacatttggtaccccttaataaacctgaagaagggctcactctgattgacacatttcttcttggtaaacagctcttaacacaccgatgaaaggtaaatttaggttaaaaggaagttgggactatttgtcctaaaagttgctcaatgagtgtcacccattattgtttgagaaagaagtgtcaaccattattccaggagccatggcatagctgaaattattccttttagggacagtttgaatttcagtctgatccttttgaatgctgctgtggcattctttcacttctttctatccagcctgaagctcttggtaacttttgttggtaaagcatctcaagtctcaagcaattacattgataagattgtgctaaacattcaaagaattaacaagggcaagttctagtctttgtttgaaaatatagggttgaaattatcattctcaacataaaactcaaacataaggaaaatatacagattaatgtatagggtggcatctagttgacacagacaattgcatacatgaagagcctacaatacatgtattgtttcatctatgtatgataatatcgatgacttattccttctttatttttatgtgtaagttttatctgggttgtatcatcggttgttttttgttggtagtcgcctgcctgaaagaaaggaattgattaccaccagtgcctgttctggcttgtcttgtggcactgcatgtccagctcctcttactgtggccattgtcaatccttgatactcaacaaatctcccagcaacctacattggatttgcataggtgaagaaattgtgcaatattacaaattgtaattcataattttacactttattttgattaatacacgtagatg

SEQ ID NO: 22381 - DNA, 1509 bp, Oryza sativa
agtgatcgatggggagtgtcctccggcagaaactattttaaataaattctccaattatctctaaattttaatcatacctttaatatatgttgtgaactcacctcttcctccctctttcttcttttaccatgaatatatcaaaagaccgtttaaccattatggctatcttctttattacttatattttctttaaccactgtggccacatctagattatgttaccaccggtagttttgcttttcagcttattagatgcagccaaaatttagatttagatttagattttaaaacttaatttcataattgattttttatattttttattgtagtttatttttaacattagcttgctaagagcacacataaaaattttatatgcaattttttatcactaattcttataatcagttctacactaaacgatgggttttctcactgctccacttggctggcaccaccttctacatgctcctccgccaccaacccacctaacatattccctgcctcctaatttatgacttctctagccaccattaaccttttatctctattgtcacaccttaaagtgtactttaaaaaaacagtataaacacaggcgactaagcaatcaaaaaataataaatatacataattagttgtttaaacaccaatgctgaaaatcaactagatggaaaaaatcctctcaaaatcaactctaaaattaaaattaaattatacaattttaatttgagagttaaagttaaattatataaacgagtagagagcgtcactacctagaacctagtatagcattacatgatctactctatcatcaagtacggatcctcctcaaatgttggacgattggtaataacaaatattatatacctcttatatactccctccttccaaaaatctgaaacctatttcattctttggtttttccaaaaatctaaatcctatttgtagtcactatatgctaaattaaattgttgatcggaaactaagaagtcattctaatacttattggttgcatgttcattggttttgccacatagtgagtgagctaattgcttcttggtattgatgaaaaagaaataggtctcagatttttggaaggagggagtacctcttagttcttgcttcaagctaccatgtaggatgatataatgagctagcagagataagacagagagagcagtaaccaccctcatgtaagtagcgacctctacatatataaactcataaagagatgagagaaagatacgaatagattgagtgaaaaaataaaaaatattatagtatattggggtaggtgtattaaaggtaatttgttgtatatactatctcttcattaatgagtaaataatatgaataaaattaaaggtgaccatcggttctactatatagaacttgctctaaggcagcagatgctggagagtacacaagcttatgtgtgaacgacgtagctacagatgaaaggaaaaatataacaaatgagatgagatatgcatgcgttttttttgaaaa

SEQ ID NO: 22382 - DNA, 18932 bp, Oryza sativa
  unsure (1)..(18932): unsure at all n locations
aaaataagtgaaagccaaataaatgagtgtcatcatagccccacgtactccagttttagactggcattttcaggagctaaaatcaatagtgtgatcgaagacttcattatcaagttgaacagattaactaggagtacgtactgtcaattaattgaacaagatgtgcatgcgtacgattgtcctcgtcctgcaaagctttttctccaggattattgcagcttttgggtcgctgcaatctcatacaccaatcacccttctttttcccattctcctcgtgtaccatcaatgatcgataaaccaagtggctgtaccatcaatgatcaataaaccatgtggagacagtaaaaattggttcactttagatgttgtttttcatcgacagataaaaaggaaaaacatcgtgctaattaattaagcatctatttcaaggattattatttaggcatctactcaaactttagcttagtttgtccgattcttgtcacatatagtactctgaaaacagtgcttctatagtaaaatggtactatctatattatttgtttttattatgctagacttagttgcggtgtctgtagtacgacataatgcagacaattaggttctcatgttcaacatataatgttttagttttttctatcttagctaaatttttgcaagattaattatgatgtagtttaaaataaaaagttgtaggagactagcttgtcccgttggtttcatagaacaggatatataaaagaaataaaaaagatatatattacatagtcctatacagataagctggtagtaactagcaccatgaacacaaactaagtaggaccgatatattgacactaagatatactaagaggtaagaatatattctctgtagactctagtattaattaggcttgaccaatgttcaacactaattcaaaatctttggaacctacaatctgaattaaacatagtacataatgaaacatctaaatttatgataacacatttatcagtcaatgataagagttagtaccgaccgtcagtgctaaagaagacacttcacattagatggtcggtaaagctggtgctaactgcctatctaaggcacctaggcactctatatgaccatcttggctagagtagatgtttcagagatcaagtggaattgaagctagagtagagaacatggaattgacatagtagagttaaaaaaaataaatgtaaatgtcttacttgaaaattgctagaattagtcatgatgtgtgatatgaataaaaaaggcaacgatgcattgcagtctttactatccatagtttcttggagctctattctccatctcacgagccagaaactttccattatcgctatatcactgtagaacatgtgcgacctgatctataaagatcatgtggactttactttaactcccacctttcatctagtgtctccatgaagaatgcaacacacactttttctttttgctttgtagcgagtggggtgtccaccattatcatcgtgtaccatattttctaattcttagatctcatgtcgcacttactataatatcaacttccacgacacctctcgcgacaaaactaattatatgacttcatactttttccccctaacagccaggtggtaaatgattatgtggaggcagtgaggcagcttgcttgccatgttcttgacctgctaggagagggcctaggcctcagggaccccacattcctgacaaggctcattacagccactgacaacgactccttatcaggatcaatcactacccttcattctgcgccgtcggcggcggggaccacaagtccggcggcggcccggcgccgacggtggccattgggtttcggcgagcacaccgacccttagaatctcagcgtcctgcgtgccaacgacgccgacgttctgccggacgccgccgccgccggcgacagagtatgggtccccgtgccgcccgacccgtccgcgttcttcgtcaacgtcggtgatctccttcaggtcagttacaaattcaagtaattgatcgattgatgttactatttcgttaaggccctatttagatcccacgtaaaaattttacactatgttacatcgaacgtttgaatacctgcatgaagtattaaatataggctaaaaaataattaattgtgcagattgtgactaatttacgagatgaatcttttgagcctaattgctccataatttgataatatggtgctacagtaaacatttgctaataacaggttaattatgcttaataaattcgtctcgcatgcttactgatggattctgtccccaattagtttttttattagtgcccgaacacccaatacgacaccatatataatatccgatgtgacacgccaaaattttataccctgatctaaacacgccccctaagttgtgttctttgttattgaaactttcgagggctcattcggaacgcaagattgaaaaaatatagaaataggaaaaatataggaataggataggaatacaagtataaaacagaggatttgaaaacataggaattttatgtgaataggtgtttggatagagtaaaggaaaaacataggtatctttaagaaaataggtgcactattacaaaattatcacatgctactattgaattaaacaacattaatcaacctaataacatgttttagttgcttgatggcatgatttgcctcgttcccacgcgaagggagagaaaaaagaggtcagtgtggattttttttttcctttgatctttcagtgatatgactagcgcaggaaatttcactacgtatttccaacgaacgttttcatgtgatccgaatgacgccacagtaaagtaatccatagtatctaaagtccttcatttttcctatgtttctcctccattccgaataagccctcaatttgtttgtacatatttttgcaggctttgacaaacgggaggctggtgagtatccggcacagggtggtggtcggcaccggcaagccgaggctgtcgaccatctacttcgcggcgccgccgctgcacgccaggatctcggctctcccggagacggtggccgccggcgcgccgcgccggtacagggccttcacctgggcggagtacaagaggaccatgtacacgctccgcctcagccacaaccgcctcgacctcttccacgccggcgacggcgacggcgatgccggcgttggggacgatgacgaccatgaatagctggacatgagagatcttggaactgtgcaatgcacacgaaattttggatcgctggaagtttgttgcaatttcgttggattggaatatatttatggtgcagtaattactaattaagtttgtgactttgtagtaacagtgatcagtgtccttgtgcattagtgcatattgtataggctacagcataattatatgttctgtttcaaatttttgtcctaaagtcaaatattcataactttgattcattgatttctaaaaatttatttagtttaacatgataagattcatgtttttagattatctatgagaaatgctttcataatatatttttcacatgttattaaactatataaatttcacatagtttacatgttgtccaactaattctagaaatttattttgtttctacctttacttttgtgtgtatgtttgtgtgaagaaaatagaacttcccttctctcttaggtctgaatctcttccctgtttcaatttttgtttcttgctaatgttgcagatattgtcctttgcttaagccttgaagcaaaaaccttagtcttacctgcacgctgcactgaggaacgtagcagtcatagatgttgagatccaaaagattttcgttgtctttttcccttaattctcgtggaggtactacgttttggtgtgaaggcttactctcgttcgttgtttgctttttctttttcttttttggtttttttttcccttgcaagattccttttgttgaaaggggactcctgatctttcttgtagatcttttttcccccaagggattgttgcgtacatcttccggtcgactgaacgtaacactgaacctttctcccttcgcggccacggtatgtggttcatgtcccaaaattctgaaccttcctcaaggctttcagagatcataaccatgtaactaaatctttcagagatgtgtagctcaaaagattatatatttgcagttcttcaaccttatataggagtataaactttcttagctttattacgattatagatgttactaattcaacacaaaccaaacaccaaaagttgagtttgagatgatctgctcaagcaatctgacaagttttgaaggtcaagatagaaccagcaacaatgcaacaaggtagccaaggtgagtcttgcgcacatgcaagactacaacacaagatggggggcacaataaaaacgtgtgacagttccagcgtctcaactctcaacatccaacagaacataaatcgataatcataacattcatagcattgttatatttcatcaagataacaggaaaatggtgtcttggttcagtttgccaagtgatacaagatacagcttaaataatgacaatggatacaatggttagggcttcgcagcactcccgaattaggagctgctggtggaccgaacacaacaacaaacttcaatttcctgtgtacacgagagccacagacctgaatcggtgttgctctcgtcgaccaccggtatcacccagggtagctccaatcccatcgatggcagctcagcaaaaacgaatgagcgcgcatcgaggaaaatgaatggatggatatctagtgtaaacctatactaatgtacatggctatagtgtgttcgtctcaagttaattgtcgacaagtactcgtagtatacttgtgcgtgcagagtagcatgtataaaagggactctgctgttttactcgacgacatgggacttggctgcacggcgtgagcacctagttctcttcttagaaaggcagcatgcacagccttcaagcagctcgaggtcctcatcgcaggtcagaatagaagccagctcggggttttccaatagcatcttagaggtcagaaaaccagcaatagtccatgtctgatatgacggagattgcttcccgatgaatcttccagagcgggtgtcatagtactctggccatttgtcagctgccagcttctcctcggccacagcaatggctcttcgggccaactctggtcttcccattttgatacaggccaatgtaaactgtagacaaataaaatacactggtaagggatgattcataagcataaaaggagcagaaagtttggaaacagtctgtcaatatctccatacctgccacagcagcgttggccaggatccaccattatgatatgaccatgggctgcatattaacaaaatgtttagatgtcaacaactgtggaaatgaaatagaaacacgtcgtatgaaaagctacacgaacaaactaagttgcccataaaaaatctgagtgcagcagggcatatggtgatatttaaaagataaatcagaagaggttttgagcccttgtttcggttattatgtgtttgctctgctaaacatttcttacaagataatatcagctggttacaatgtttatttagtggatactacatgtgttcactggatcagccaatgatttatgtgaaattatcattaactaagaggtcaggttgaacgtagatcatgaaaatactagcaataaagaccagttcaagaatccttacgtgttcttaggatcactgccggtaataatgcgccattcatcatcttccattgcggggtaacatatcttgaggggcatgtttgctatgagatcatcccatttctcatcaataaggctaagtattccctcagcttgttttggagtagttagagatgaagttattgcccaaaggttgccgagagagaagaacctgaaatccatgtgagctggctgcaggttcccgatgagatagccacctttttcaggaatccagtcaacaagccaagaagggatttgctcaggataaatgttgaatttgtttgttgcatcatgagagtattcttctgttttgtatctgtatatctcatttatcttcttcatgtcaacccagtagtattccctaatatgaaaggacagcgcactcagcctgttattaatggcacgaaggaggttttttgacccatcgttcataacaagcatttctcgtgagcatcgtagggcagagtagaacaaagcctgaaaagcaggtacaattggtcagttcggataatcttttgtatctagcttcaaagtagcagtatagaagtactgtctctaacagcacgttgatcccttcatgtcaggtttctttatcttaatagtgatataaaatagtaaatttatttactaagaacagaatttcctacagtaggctaaaccaattataaacaacattatcagttgctcagaaatatcattctgtaataatttctactaaaatccaacttacttgaatttcaagggggtgcccatgtattcccatcctcctgtctatcatgcatgatccgtctgtgaccagtaaagttggaaacatatcgaacccatcggacaaacacaagcttaagataagtttaatgccggtttgcacatctactctttcctgcagtgcattgtcccctgtaatcttgcagtatgccctcagcaaaataatccaccaaagtcctgtaaaattatttggggtaaactactttgataaatctgtcatagttgataaacgaatcaagtgagagagagagagagatttacctgaatccaccggagctacacgtccaatagctgactctccaaagtcagggtccaaaacttcctcaaatgcttcgttattgtcatcaagaggcacagccctaatcttaaagctagctggcatcaagccttgcccagggctgtaacaatcaacagtcttctcccagctctggccatcagacatagaaaaaaaatcagcaaataaaatcctaaaatgaattaactgccatgttgagacaataagaaaactaggctcaaaacaacatgaataagacagatttctgtaaccttactgttaagtgctagtgccatttgtataataggaaaattttgagaattttttatatgtatgtcagttaacatgtaagttttttccgttgaattattttcataatattccgaaaattagctgggcccaattcatcactagcagtatttattgcactagcaattcatcattttgtgacaaattagctgctttgattcatataataatatataggctgtctactggttcatcagactacgtgagaaagagacatagtattattctgcaaaagggaaaccttatctccatctaccccacagtagctaaagccatatagaatacgaattcatcataggtcataggactagacaatcacatctagcaagcaaattcaatctgaaacatgatattcaaagacccaaagtggcagtaaacttctcatatatatctaaccatgcataattctgtattttcctccccccaactagcaggaaaacctaacgtgcacgcaattagcagttctcagtacccacggtatgatgattactttggaatccgaaatcgtttggccccaaatttgaatcaggatcaggatctgaatcggctcacctgcagctgcagggtgtggaggaggaagttgcggacgatctcggtctcgccgcgcatgaggaaggcgagcgccgagggcacgaagtccctgatgaacacctggtcgtagttgagcgtctccgtgcactcggggtcctccgccgccaccgtccccaccggctcgccgcagtagctcaccaccgccctcctcagcagcctccacgcctcccgctccgcctccgtctcctccctcgccttgagcgccgacgccacctcctcatcggccgcagccgccgcggacgccgccgccgacgagggcggtggggtctcgaccgggaacgtgtccgggaagaggacgcggtcgaagaaggggaggttgccggagacggcggcgcggggatcggagggtataggtggggtcgccggcgaggcggcggtctgcccggactgctgctgctgctgcgacgccgcggatgcgaggaagggcaggcggcggccgtggaggtggtggtgcgggtgggggcatctggggaacagcggggtcgcggtggcgaccgtcgccgccaccgccgccgccgtggccgacgacagcagcctccggcggcacggcctcactgcgactgcggcggcggcggcgagccccatcggggtttgaccattcatagagggcaccacccacagctccggcgaagggcaccgatgcgataatcacaaacttaccagggggctctccgcaaaaaatccaataaagaggaaaggtaggtaactttaatgtaaatacggggtcggtgaggggtgtttctgcgaaagtgcgagcggggttcggtgcggtttaggtggtggaggaaagcgtaatggaggatggataggggggcagaggaggcggcctttttatagagtgcggtgtgtaggcgccacgctgggcccacctggttttaaaagtgcattgttttaaaaaaaattcaacgtttttttttcctctgtcctaattaggggaatcttggattggattttcgggacggtgaaattaccgtcgtgggactcgtgttttctattttccccttttctgcatctctggacagagagtttaattttgggctcgcagagtgtacgcattaattttggacgtgacaaatctgtagtcctttgacttgtaaatacattagggctgtgtttagcttttaaaattagggagacgtttagagaaagttggtagtttggaaaaaaaaattgagagtttatttgagtagaaaagttttagatgtgatggaaaattgagagtttaaaggaatagttctgtcaggcataacttgaacagtgcaatttactttaagtccctttcatgtgatcatttacttcctaatgtttatatattataggttaaaaatatgatcttttgattcgtaggaaaatacttaaaatttagagaatttgaatcctagagggaaaattcccaataaggccttcataagaaaggattaaattatatcaatttttttttgaaattcctataaaatgaaaaatcctacatagattttgaagaaaagttagtaagagctaaaacctttttaaaaaaatttctatcaattttatctctattatctgatttctatggttttcctgtagtctactaaaatgattatttgtgtgcaaaattaagtgtttttctatttctttgttttttttaatccaacctactaagaaaaccctaagtttgaaagttttggtttatatagatccggtgattctttttttccttcttacaaagttgacgaatagcatcattttgttcttggaataaaatggcttgctcaaatgaataacgtgtcatggcctaaatgagaaaagtcaaaactgggcaagggaaaatgggcagcgtgtgtaaaggattagtgggtatttctgtcattacgcaccaaagacagatcaaagaccagctcaaggagaaggaagacagctcgtgcgggccgctgtgtgagtcgtcagagaaaaaaaatacaaaagcgtgtcggggaaaacaattttctatacttaattaaaaaaaagtcgcccgcatccgtcaccaatcgctccgtacgtaccggcccattataccccttaaccggttacgcacactgacacgtcggtcccaccgagtggtgacggtccgcatggcccacaagtcagtagctactccgtagaatttttctccgtacgttacgaattagaacgcgcacccggtgccgtcacatgggatgcgcaccgcccaccggccgcgcgccgcgacgccgtgagcacgttttataataataaacctcggccgatattttttttaactggagacggatccaccgtccgatgggggatcgaacgggtgggatggatgccgcgcgtcccgatcgcgccgtgtggggacaggaaagggagccgttggttggtactactagtaccatgtgaaagtaaatacgaagtactagaggctgtctcgtggggcccagtggtcggtgactttagaaggtgaaattgaggataagatcggtagggggaaaatcctcacgtagtgcgagtggacacgtcacgttctgctgcaaagttttactactactacgggccagtcttttcttgttttcctgttggcgaatagtcgttactagtagtacttttatcgaaaataatgctccggaaaggaatttgtatccacaaacctatttacagtgttacctcatttatttgtatcaagccacggatcgacccgtttacatctttatttgtatttgagatttaagacagttaagtctgtgttcgggagtgatcctatccttcactctccagcacgcaaaacaaaatagcatttatctcataattaattaagtattagttaaaataaatttaaaaaatagattaatataattttttaaaataactttcatatagaaaatttttaaaaaaacgtaccgtttagccgttcgaaaaatatacgcgcggaaaacgagagaggtgagttgggaagataaagataaagaactcagcctaatacaagcttagagcgtgatgagggaatatgtaagtctgtacaacgtacgtggagaaaaaatatgtaattttctttttcttcgagagagtatgtcaaaatttgatggtcaaattatttgtgttaaagaaaatgagcaaacttctactaaaatattaaaactttaaactcaaaagtgaaaacaaaattaaccaaagcccatatttgaaaacttttcaatctaaattttaaagctttcaagttaagatttgaagactttatttttaaccttgatttgaaacttacaacttagatttaaggacttttgaatcaaaatttgagaactttttaattcggatttgaaaactatcaaatcaagatttaaaaatttcaacttaaatttaaaaaaaattcaaattaaatttcaaaactttcaacacaaattttaaaatctttcagctatttcttaaaaaacttttacctaaaatacaattagtgctaattaacgtcattagcgcttagcagaggaggggagcgcgcgcagctgcgctagctatgaaaccagcacgcacccattagtagtcttcggtataccctaccatattcctcaaatacgtactccctctgtaaaaaaataacttttataaagaaatttagatataaacatatccaaatttgtgtacaagagcagaaaagctgatttcttttgagaccatgaagcaggggatatggcatggatatggtggggattgatctagcaatagtaatagtatccaagataatcgatgtttacgtatcttagtggtggttatcgtagtattggagtaaatgtacatcattgatggtggaatagcagtattccatgcttcctcctaatggatgtaattatgtgaaattgattttattttccatcttaaaatataaagcatatgttgagattatgggcatataaggatttaatttattccataaataaatcatgacattacagatgaaaactagcatgaacgcatcattagatctacacatgtaaactacgcagaattacatgaacagatcaaatatgcgcaacatattggacacgtaccgaggtgacgaaaagaccgactgcttggtcgaaacttttcgcaggtgtctacgaaggcacgaaacacgcgagcgaagaggaaggcgagccgtcgcgaacgaacagggagcagtcgcacgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaaggatgaggagccaatttttcggaccattcgacgcgtacgtcgtgcacgcgcgccgcctgccctgccctgccctgccaggccaggcgaggccaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtaccgttagttctgcttccatggttgacctcgtcaaaattgtctgtttgcaagacctccatgaaacagcaccaccacccagtgtgaaaacatatccactagtggctttgatctcattcacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaaaaaatcttcgccttctttctgagtatagcccttagcaacaagccgagccttgtacttttcaatagtaccgtcaggcctaagcttcttcttaaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaagagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaatccaccaattagtagattgattaactgaaaaaacagtaggtaaattaccatacccgcttccatccccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctattcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccgactgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagnatgaggagccaatttttcggaccattcgacgcgtacgtcgtgcacgcgcgccgcctgccctgccaggcgaggccaggcgagcgagcgcgcgcgtgtgtttcccctcttctctccaccacacatgcttcaagtggctaggagggcatcctcccttttaagaaggtccccctctcctagaataagcaaggtggtactaaactccacatgcatgccatcccatgaggtgggcttttgtgattttccaaagaattaatcttcgagtgggctaaggcccattcattaattccaacagcatattagttatttatatggccttctgtattctttaactattattattttcataatatatcattgattgttgtatggaattaacattataaaaaagtacttgatatgaatataataatatgtaatagaatgtgtggcacaaaatatacattcttttctaaaaatatagatacattatatctccggacagaggaagtgtttttaaatagaagtcgttctagttctttttaccaggaacatacaatctttgcaaattactcgtagtaaaagctagttccaatgttctttaactcattttctcgtaaattattgaggtagtattttggcaataacacgtgcaatagcgtacaatcaaacctgttaagtggactgcttgcatgcggtgctagccgactagccgagcacacgttttgtctagttacgtacattcgagttatatgtaacctaattattctatagttatattttttaaattttcttaagaaaaattgttgaatgttcgctttttcttcgacgtgcgttccctcactcaatcaaaattgtaataaaatacaagaagtaggaggggtttaatcatgaatccattgtggaaatccaggtagcggtccgaaaagggcaaaagagcaaagtgagtagtgaaagcaagcgcatgttgattgggtgcgtgcataccacctttttactaagggatgtacaacatagatgcgtgatgtggatgttgttcttttttcctggctatagcctctcagtgttgtggtcttgtattttttttcctctatcaatacaaaacgtcgcactatcttgtgcgtgttgttttaaaaaaggcaaattttgctaaaggacatcgcaattgttgtatgtatttagctcacggacaccgcgaaagtgaacttttgggggaagacatcccataatcgtgaatatttgctgatggacaccgggccgtttccttttcactt

SEQ ID NO: 22383 - DNA, 19795 bp, Oryza sativa
  unsure (1)..(19795): unsure at all n locations
nnnnnnnnnnnnnnnnnnnnnnnnnnnnnnnnnnnnnntttaaaaaaggcaaattttgctaaaggacatcgcaattgttgtatgtatttagctcagggacaccgcgaaagtgaacttttgggggaagacatcccataatcgtgaatatttgctgatggacaccgcgccgtctcctctccacttgacgtgctgacgtggcagacgggaggctattttttgacgcggtcggacgtaaatacccctgtgccttatctcctctcatgcactcggtagaaagagcagcggcagagccgatggcgcccggcgacgttgttgccgatgccggcggcgatcggtggcggttctgacgatgcggctaaaagagaaagtgtagagggcatccttgtgaatctataggtggtggttttgtgcaatatggtggccggaatagttgtcggcggcgacgcgagcggcagtgactctcggcatgacagtgcatgacgagctccggctcgtttccatgtgagtgagtacatgcgtgcgtggctataaggctcctggagactcactgaaggtcgtctgaggttcggcgatggatggacggcaatggcgaccttcgaaatgctccagcggcggcagagaacggcaggtcgacggcgtcggctccttctggccttcgggctgtcaaagggaggagggaaacgattcaaagaccatctgaggatgctacatgtgcgaggaattgtgccgaagctcactcgggagcgaggaatcgaaggaatgagccggcggccggacttgaggaagaaaggttcgatctcctcaacggcagtgcctcggatcgattcctccagtagacctccttctgggatgccggcgatgcttttggcgcagtggctcggtcaacgatggcttgagtcgacgggaacggcgaagcgacgcacggcggcgccctggacaccgagaacgccgacgagcgcatcttcatgtgcttgatctgcagttaattaggatgcaaggacatggctagatcaggtagaggaagtagttcacgttcccatggataaaatgcgacgaagctcaccagaggtctctaagattggatcaaacaccttcgggcagagaaatgaggagggtgttcttggagataaggcgcaggggtatttacgtccgaccgtgtcaaaaaacagcctctcgtctgccacgtcagcacgtcaagtggagaggagacggcgcggtgttcatcaacaaatatccacgtttatgggatgtcttcccccaaaagttcactttcgcggtgtccctgagctaaatacacacaattgcgatgtcctgtagcaaaatttgcctttaaaaaataatcatcttaggttcttaacccaacgcatgagcgcttgaaaactatgtaatgaagaggattaaatacgaagatataattaaagattttatttcaataaagactaaaagatgatgatttccagtagatcataaggttaatgaatgtgtgttttggggattaggatcctctgcattagagtacaaaatgcagagatgttacagtaaattgcattagaagacatctgcaccatccattcatagtcctatgcttgttatcaacctccacagcatgaatgcgatagttctagcttaagagcccctttgaatcacatggttgaaaaaatggaggaataggaaaacacatgattttgataggaattgaagtgtaaaacaaaggattgcaaaacacaggaaaaacacatgaatgatcgtttgattggatcacttttaacaaccaaatttggtaatatcggcatcgggaaagaagattagattggtaaagtcggaggcggagattgagttcgaaaacagagcaggaatcggctggagtccagataggctacgattaggatcggctgggtctgagtcggactgggtaagccgatgcagccagttccgacaatgcaacttgatgtatgatatcgggttgaattgaggcgcttcaaggtgattgccgcacatggatagagtcctgagaaggcaattgtatctattaattaggatgttttatgtaatttccttagagatatgcttgggtaaaagtctgccgcaaagacttgtggtatcttagagtttgttagagatagtagtcgtgtccgttatggacatatcttgtaattctcgggtataaatagacccgagccttatgtaacttttaacacatacgttcaatacaatctcggcgcatcgccacctttttgctttagttttatttcgacgagttcttactttcgggttgagctgcatcggtttcgatcttcaacaagaggtaaaacttgctatgatggattatgttctcgggattagtgcttccatctttatgatactctaatcttgtctatataattcgtcaagttatcatatatcttacataatcttcgacaatatcgtcatttaacttacaatcggctaacacctgtcaacagaaggcagccgattaggttaaatagcgatgttgacctagattatataagatatctaccactctatgaaacttccagcggcttgattgtctagatattgttcttcttttcatacttaaatgctgcatcagttgagtttgatctattaagtcgtgcttagaatatcaatctctagcctgccttctggtcgccgattagggtagcgtcggagtttcagccgatcttacctgatttaattgtatttgctctatatgcttcagcgatatgttaaatctgtcctttgtgtcaagatcttatttgcatttaagtatattaggtttttgtttgatatattatacttgtttcaatattctgatatagagtagtatcggagtattagccgatatacgctagatctatctgatcggctatgctataaacatatataaggctgttattaatatatatttcaatctaagtgatttatactgtctcgacatggcgaccgatctatcccaatcacttgatttaagtatatattgatataggaactatatgttgttaatatgtacagccgatcgaatagatttagttctttattgtctatttacaactgccgattgattaacatatgacatcggctcaaagataaatgatatgtcatcggcacctagccgatcggctatcatttatagatttatccgcggtttctttgtctctatttcttgttgattgtagaatcaaatcaactggcacgctaacacacccgaaggcgagttttggacctgcactagagttaagcagatctcccaggtctgtcaacaatcacagaaaaaacgcaggaatcgaatgagagagatagactcaaaggaaatctttcaagaggttagagctcttgctaagtctcctccaaaatccacctgcaatgtgtcatttcataggaactttataggatttggaaaacttcaatctttgaatcaaatggccaaatagaaaattttcctatatgatttgaatcctacgaaattcctacctaaatcatttgattcaaagagccttaaaaagtagaatattgttgctacagtaccccggatgatttgaaccattcgtttttaatctgagtgctcaagtgctactgcaaaacattgtagcaccttgctttggcagtacaaaccgcagaggatccagatccgtgttttggttatacgacttttgaatttcaggagcctcttttgaatttttgcactagggcctcaaattcgtagagacgtccccgcatttaagaaccatgttattcaatagatgcgtatatttataagttagctaattaggcaagtatagttaggtagtactacgccggagtacatgttagagtacgtgcgattacccctgaaaagtgttttccagtagttagttaggtagtacccatcgctacgtttggcactcatattgaacggtaacgtggtaaggatgaaaactggtcctcgaagcatctattctagcatccgattgcacacggcctaagccatgacatgcctcggcactaaggcatccggactgagcttttacttttcaaccatccttttatctgcagagatcgatcttgaccccggtttacttgctgtaatagttgaccccatctcttaatgttaatgcaactcctagcttgtttgtccccttcaccacattcaggatttagacaggaaactgatcatccatgtgtgctcacatggcattgcacgcacattgtatcttttaatttgtttcaacgcactaacttcttaagatgtggtacatgatgtatgggaaaaaagaagaactagcagttgcttaattgtgcgtcattttcccgaaacaataaattgcccgtcaatgtcaagattgcagtgctggagtttgtttcacacacccatcacaccaaggagcatttccagccaagtggtaagtcataagtagaagtacttgcgattcatagcagcatgacgtacgggatcccaaaatccagtcaccttttcatttgaattttagttagcatgaaaattctagaataataatctaaatttattttgaaggttagaataatctaaatttattttgaaaggctagttagaatctaaatttgaaaattcatgagtttttagagctccatgaaatggacttcactgaccagctggtccacaccaaaccagaccacaagctaagatgacaaaaaaggagtgaaatttcaagtggataagagttcttggatgacgtggccgacatttgggacaccttttccttaggtggcactgatggctcctatcctcctgtgacccactagtctgtttgatcctacttggccttttttgtttatgtccagtagttttctcccagccatccacctaccaccacgtgtacgcccctcccacgaagcaaaattcgtaccaaataaaaactcctggaaaaaaacatttggcaaattttatctctacatttgacgaaattgtatttgttgctatctacacaaaatttcagtctgaaaacgaaaattactttgagagaaaaaaaaatggtaaaccatgtggccgggagacaagaaaagcgactcgatcggcacaaaagggctcacaaaagggacaccgagcgaaaacgagaccacgttccagactcaacccctactggttactccgtcgtcgccgggtgcggaaaatgatttcgcgtgccaaattatgtggcatgaaaaataccctaaaaaaacaattacatatatttattcatatatcccgacaacgacccgtcaaccgttggggaagaggagaagctgaggatgggttcctctccgtggctcacacggataacgtccgacgcggctcgacgcgggcgggcgggaggcgataacgccggcggacttggatgacaaccgcgggccagtcgccgtcggggaatagcacaaatgaaatgttgccgagagagttttttttttttcatgcgatctcccgagaaaaaaaaagaaaaaaaaaacgtctttgctttcgtcgtccgttcgtgtccgttccggcgtgcgaaaaaaaatctggggatggcaccgcggaaacgtcgccccgggctgggcgtttttgtcgtggaaaacgtacgctctcgctcgcggcgacgcgacggctcggctgcaaatatccacagtagcatgcagttcattctgcaaatgggagtagcgtgtgtgtgtgtgtgtgttttttgtgacgctgcgtcgttctggctgggatgaacaaatatccgagattcttttgcaatggtggcagtgactgactgactgactgactctgttagttgaagacgttgctgctagggagagagcattggaaaccagggaaaaggggcgtctgtttgttgtgttttcgcggaattggtggtttgcacattgttttaaaggtgtcatggagttggaacatacttgtatgagttattgatgtgtagggggtgtttggcataactcgagatctaagagtttttaaactatgaatacaaatcaatagatctggatctacaattatattgataacttttgaatgaatcatttagatgaaatataaaattttaaaccactataatttaatatacaaacttcaaatccaatgcgaatttaagatggagagttatgccaaataagaccctagtatgtgtctttacgatgatattttccaaatttctctttttttttaaaaaaaatctgctgttcacgaaagaaaaggtaacaccatattgctttcaaccagtgatatctaggggggtaaaggataaagatgtgagataagatggactgcaaaactacgaaggtaaaaaaaagaagatgacgaacgtgctttaggaagttctttttttttttcttgcagctgctttactagcatattctttgcaagtttatattaaggccaagcgtatcaagtattataatggagtgaagcagcaaggcaggacttcaaaattttgctttataatgttgacatgattgtgactaactacaactagaactttatcagcaattgtatgtccaggctgaaggaagaggtaggcgaatttgtcttgccggtggtggagatgtcaaataatgaaaatcacaatgcattttctcctgcaagatgctccttcacaacatcaacatccattgcttttgcctcatggttaaaagttcgacaagacaaactccatgcagtactatgataatgtttcaagatgttagctgtacactacaatctatcccaagtagaacgttttccagttcagctgctatacagtgtcaccagtgacaaggctaaaaaatacaaagaacatcaagaacttgtaggttgagtagtgtgcctatcttgaccctcaatcttttgtcacagtgaatcaaacaataccaaggatatcaggggacacaaagatgtatagggtcaataagcaactaggcaaagtaaacaaaagcagaatgcatcatctgattcataaattgcacaccactgtatgtgacattagggcgcctctatttagacaccgaatgctgactgaattgttgacctgacaccagatgataggagcgtagttctagtccaatctgcaacgtttttcttggcatctgaaaaataaccacaataaactcagagccatagttaaaagttcaagcagagtgcaatgtcttatatgccaggcacagatgtcaacatgcttgggtagcctagaagctgacttagacaatgggaaagctagaagtgatatctgaagctgacagaatgaatgtatttcctggcatacaatgtacttccccatggaattatccagttaaagacatccagagctatgaaaacacaagtacgtaaacagagaagaaccatctaaaactgatcagaataggtacacaaaacaatgatggcttcaggataaaggcaactggtctagattctagaacacattccaggctgaacatggtctgtttactaaatgaactgtactttcaaacaagatattgatgttgaaggttctattttctcagctaagacaatgttaaaaggacatgaacgcacagcattctgttgctaagtttaccattttgtaagcaaagatatagaaattcgtgcaattcacttccaatgcatacctgttctgtttctaactggctattttaagacaccaaaaaaaaaaaatcctctaacagaattgcatcttacatgccatgtagacttttctaacgagaaacacggaattctcttcaagagaagtctctcacctttgttgcacttggtgaagccaacaatgtttgctatgctgagactcaagcaaactccaacaacaagaaggtaatcagcatgaagtctgatgagtgagaatatcccaagaacaatccatgcagcagcctgaaacatggaaaaagcatgtttatttcaaatagccttcaaagaattacaattaccttcacagttagtaacctgttctcctagagaattttcttctgttccaaattattttctaatttgaacattattacagtaacaagaaaatgaaaacatgagcaactctacaataaaaggagcatcttttttttttacaaaacatggatataattgcttgacaatacgtcgtcaaacatgaacctgtgttaaaaaaaacacggatataatttttgtaaacatgttcctttttcaataaaaaaaacatgagcctatattgggcttgtttggcacaactctagctccagctccaccttagctccacctctggtggagctggaacttggccaaactgtttcagccccacctaaaatgggagtggggctgagtggagctctcttacaaaatgaactagagaggtggagctgggtttaggcagcttcacaacttcactctagacccaactcctggagctaagtttaggagttagagctctaccaaacagacccattgtttgacaatacctcatcaacatttatgtagtgttcacatgatgtattctgtatttgctttctcacagtttgccattatgggagctttaattgacgtgaactttcagttttgtgagtgtaaaactgtagatacctttatatgtaacactattgtagactacaattttttacaaaagcaaatcagtgaatcacagtccagattagtgtgttgggtcaactagcaggatatttatcaattgaagagatttctagccatccactatccctatcatgtaactccagcagaacaaatccttaatttcctagtgtttcatccagcttcaatgctgggtagctgaggaacacgtcagatccctcccagatgtaatcctctgcagaagcttcctgccctgcaacaaggatgccacatgcgctgcagggccacatggagctgaccaaagactttacgcttgccttgctccggtcgatgcttctaccggcctacgcagtctgtcctctgctctcgtcaatgcgtttactttctattttgcttttctcaagtgtcacttggtttatcagtgaatccatgaatgatttagtcttcctatcctgcaggaagccagctgcaatacctggtgcagcagccatgggaagaagggaattggggaatgtgagtttgctcgagatggatatggctaagggcagggagccagggattgatgactacatgctgtgattgcatgcgtttacttaaggatctaatctggctgcaaggggatatgtgtccttactcatgtctatttgaatgtttcacatgggaaaaaagcaaaatcatgatggcaacggacaaagtgatgaagaacttaagggtggaccaccatattcagtgacatgaaaccaaattttcctagattttaatcataaatgcaacagaactagcaaagtatatactatagagtatttccaagaaaaaaatcaataatactatagagtactgtttttataaccaatattttttgcatttacatctaaacggtcagacataagagtatcaataggttgactttacagatcatactacgacttgcattttgggttgaagggagaatatgacaagttctaattctaagtttacaaaggagaaaaaatagctatcctcagatcaacaaaattgtgcataaattacatcaaaatatcaaatcaataattaactatatgtgtagatgcacaccatgacaaaaaaggccgtacaaacaacacacatgtgcaaaaatgatgcacccaggggcggcgcaaggctaggtggaagctttacaaactgacaccatgcctaccagaggcacttcagatactttcagcatataggctcaacaattctacggtgaagtcaatctcgactctgtataaagatttgatacagacttctatggtttatcatactttaataggtatgctactgattgtcatctaattgcagttgtgcatttgacaagactgcaggcattcccttctgttgtatttatgttttattttcattttccatttcccaatgtgttcatatataaactgaatgaaattgtatatattcatatacggatactagaaactaaaaacgctgaatcatagtggagaatatcacttacagtcaagtacagagtccaccagaacagccatgagtccttcttgttcatcctagcaagagactgcagcaaaacggatacactaatttagggataagcaattgcaccaaaatgtcacaagtatactgagagacgaacgcaaacctctccatcaaggcactcaaacttccacacgctattgccctcatcatcgatctcattccaccagcgcagcccaaccaatatcctcccactgacgttcttgaccacccagaagtcaagtgctgccaggagcacggtgatgacaaagataataacaaagttggtcacgaacagcgcagacagtatgtagaacgccaatgcccctgccttcacatacaaacagtccaatcaacttagtaattgctagctacagtgtttatgtaaacaattacaaagaacattgaagaaaaacaggcgagtgagtaccttgaagaggacatggaagaaacatgtctttggatttgcataattctcgccgaccacctgcagcaacagaaacatatatcatcactatcatgccactcctaaatctcaatttaagcagcagaggaattgagaagaaatagttattagtgcagtcaagaaaccctaaccaaattgcatccacttgtcctagaaaccaaactgtaacggccgacccagatctcacaagaacaatttattgactcttttcttacacaactaaaactagccaagctcttgcacaacatatactaatctgggctggtccaatcagaaaaaccgaaagatctggagcaagtagcacaactccaatccaatccccaagcaaaccaactccttgaggttaaaaatagagaaatcaagaaccttccggccaggcggggcaagggaagggaagggagcggagggagctatcacctggtgttgatccatcgggctttgcttcttcgcccactccgcttgagttcttccgctgctatgctactgcttcgcgggatcccttcctcggttactcccttggagatcgaagaggacggggggtcaaatgcaaatatgtcgtctagaagaggggcggatcgcaaattctgcgtagagaatgggtagatatcgcgaggctggctggcccaacaaagttggcccaaactggtctcgtctaggcccatataagtataggaaaaagtacaccgaaggtcccttaacttgtcatcgagttacaaaataatccttgaaccgcaaaacgggatacaacgcatcccccaacttacaaaaccagtacaaattaggaccctcggtggttttcactccggttttatccgacgtggcaactgactcagcatgggacccacgtgggccccacactcagggtgaccacgtcatcatttcatcctcttcttctctccttccttctctctctcagttttctccttggtggggtgaggtgggacagggcagcaacggcgcctcggtggggcgaggtgggacaaggtggccagcgacggcaggcgacggaggaggagtagtgcgcaggaggcgggggagcacctgggcgcccggcgacaggcagcggggtggaggcaggcgcttaggcggcgagcgatggagaaagagtagtgcgcatgcggcgagggagcacctgggcggccgtcaacgggcggcggggtggaggcacgcgctgtggcgccggacgacggaggaagagcggtgtgcaggcggtggggaagcacctgtgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttgaaatgagtttataaaaagaaaaaccctaaaaaaatctttttccccccttcccttcttgggccggctcggcccacctccctccctctctctcctctcccccgccggccaatcggcctcctccccgcccgcgtgccgctgacgggcgggcccgcccgccaccctcgctgacgggtggggcccacctgtcatccctgtcctcccgccgctcccgccgcctcgcccgtgccctagcgccgccgccgccgcgaatcccgctgcctcccgccgtccccgcgcgcaataaagagggggaaatcactccccgtgattccctccctctttcccccccacttttccctctctctctccctcgattcgtttggaaatcctcccgcaaccttcgccggcgtcattgatggagccgagatcgccgcgccggtttccttcccctccggccgccctctctcactcccaacactatataaacgctccccgtgcctccctcctccgtttccgccgctcgccgctctctctccccgtcggaatcgagctcgcgccgtcgtcctctctctccgccatcgccgccgagcttcggtccgccgccgtcgtcgccccggacctcctcccgcttcggcatcgcctccttcggcttcgccgcgtcctcgccgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatttcgcttcccccttccctcccctctctcgggcgccgctccgtcgcgccggtggtcgccggcggcgaccatcggggcgcgggcgcaccgcctcccgtcggccgtgccggcgaggccgccttcgggcgcgccccgcggctgccatgtggggcccggccgtcagccgcccacgccctcgggtgcggctgacgcgtgggacccacggcgtcggccggcgcaagccgcgtgcacccggtccaccgtggaccgtgaggctgacgcgtgggccccactcccgtggacccggtccgcgcgcccctcccctcggctgacgcaataaatccgatttttaatttaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcctgttatttggagtttattagagtaaaagccttttcttttccgttggtcgtgtagacgctgcagcttcggaagatccgctcttcgtggaagtcgaagccggcgtttgggaaagcgagcaaggcaagtcacatcatccttgagcatattgaatcccagtttataaaattattttgatttaaattattgcattaccgctttatttaaattcccgcgttatcactgttttatttagccatgcctatttacctttgttatgacattatcattgctattgtattattattaccttgttcaccctagaataaacaaaaccccaactagtggacactctattcctggttccactagtttgaatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctgggacccagggtcgggttgccagttcggtctaaatcatcgtaggccttgggttaaggcaggttcgtgagggttcacggccttgtttaataatactgtgtagctctaggatcgtctttacaaaatggctttgggcaactaagtgacttttaaatgccgtttactgcaaaacttaacccctatattattatctccttgtaccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacatagggccgcagcttgattcacagaagaggaatttctccagccacattagcagaaaggctacatgctctcgaggggttacagaaccttagcccatatatgctgctacataactagaccaaccgcctattgtcacgccctgaagttcttctccctagccaaaattcaattaataaattgttgcaagaaattatttgttaaaggcaagagagaaaccctaaatcaaaaaaatgcaaataataattggaatcgacatgtggaatttttcttgggttctacatgtcaaaatatactaataggatttttagtggaattttcagagccttggaaataaattttaaccaattaaaaatgagcatgtgcaatatttaaatccctggaaaatcccctttttccttttctcttctttttcttcctttttcctccctttgtcctcttattgggccatcggcccacttcctcccgcgcccttcctccttgctgggccggcccattccctccctcctctctccgggtcaccgacaggtggggcccacctgtcggccccttcaccacctctagccgacggtggcaaccaccgccgaaaccgccgcgccgccgccgctttccccgctcgtcccgcgcccccactccacgccaacacgccccccacgttgccgaccccacgccccgacttctcccgcccacgcgcgcgcgcccgcaagggcgggattcaatttgaatccccccactctctctccatcccccacgtcggcgagaaatccggccgcctcccggcctcgtccgccccttcctcacccataaaaagcctcccccgagactcctctctcttttcccccactcgccgccctctcccgtgctctccactgtgcccgcgccgctcaccccgccgtccgccgctcaccggggagctccggccgcacgccgtcgctgctagggccgccgccacgctgtgcattcgccgctgctagcatcgccgtcgtgtgagctatcccggccgctgctcggttgcccccctccgcgcgcatcgctctccccacgccaagccacacgccggtgcttaccaccgcctccaaccgccggtagccgtcgctagtgccgtcgccgcgccgctccgttgccgcagttgcccttgcgagatcgagggccggctcgtccaccccgcgctccccgccgttcgtcgctcaccgtcgccgttcgtcgtcgcctcctcccacgccggccgaaccccggtgaggcaccccctctcctgtttttcccctttctctccctcctagcgcaaagccgcaccgccggccgcccgtgtcgccggccgcccgggtcttctccccggtcgccgccgtcggtgaccgcttgccaccgccgcatcgcctaaccggccggccggtttgaagccgagccgagccgaccgggtgtttccccctccccttgagccactgcccggtggggcccacccactagcaggtgccacctcctcccccttgagccgctgccgagtggggcccgcatgtcggcgccgcccccctgctgatgtcatccggggttatttattgcgcaataaatctattaaggccttttcttttattagtaaaaacacagataatcttctaaaattcatatctaattcatccgagctccatttaagtccattcaagtctcagtaaattcataaaaatgtatagaatccattaaaaatggttttgtttcctgtttcagtagacttatagcatgttttgcttgtgtgctttgtttgtcgtgtagatttcggccgtttcgtcgatccgcggttcctcgaagacgttgctgagacctcattagtacgagggcaaggcaagtcatgcattacaattgatcatattgtacccaatttacaaatgtcccgcatttctattaaatgttgcattattttataatatcatgtgggatgggtcctactactcagccatatattgtttaccttatgccattgataacttgggtatcaaaatgattagatgttggattaggaattgcttagccatgcttagttcaactagtacacaaagggagatcacattaatgcatagactttgattattggcatagctttggattagtgccaccgcaatggtgttagttaattaaaatacactacatggtgggctgtgggtgcatggttttgctagtcgtgcccatggtgattaaggaccggttcgcgggatgccctaaaagaacttatcgtacttaccacaagccaacgtgggcaacggctgggcttgtagtgtagctttcctctagccgacgtactcatgcgagggtgggcgtgatggagttgggttggccggggtgtctgtttgatcggcttccagattcaccgcggcacgagagggggaatgcccgttgcctgctggggacggggcgaaccctgaggtgtggtgcgatcggttaaaggggttatgcaaagggtcctgtcacggcctctttccggtatgtcgtggtggcatgtcggcgcacggaaacgtgtcgtggggctgtgtcttgtgggtatagttgtacacctctgataagagtaaaactattcgaatagctgttcccgcggttatgggcggtcgaccaaattcaccgtgattagtcacaccctagttagctaatgaactggtgtagtttaggtggttggttgggcctgttgcaacatggtgtagcgttggacagtgattggttaatattgattaattactgcaactgttttactgctttcaactactgcttttaaatgctagctttatgcaaaaggacctttagccttccttggacttatcctgcatcataccttctcttccagtatgacttgttgagtacagtgggtagtactcagtcttgctctcttttcccccacaccagagttgaagttcttctcagttggagatgtctcgaagaagttggtttcgtcgccgccgtcaaggatgcatgtggaatggaatcgcccgcaggcttagctcgctttaatgcacattcagcttagaaattctggttcgtgaatttctgggcgtgacacctatgctcttggtcctgaagtcatattgattcttcgtgttcggactcatgggattagccgatgaggtgacatccaaaccggtgatcatggtgatgtctattagagtcggggtcatcggcacttggttaaacaggaaggcattgatggtgttggaccagaaataggaggcggaggccattaaaggttcgtctttggctgagttagctatggtaaggtcgagtgcttggccgattccgatctcgtcccagtgaactctcttgctagccgaaatgcgcttgaaccatgtaatccagcttttctcgggtggagtttttccagtgacctagatctgggttggccaatctgaaaggaatcctattggtttcgccgatgatgaactcggtaggatcagggttaccaactgggccgaggaagtagtaattttcatgcgataggcttggaattgcaactaagttggagagatgctacaaatccagaagaactaggaaggggaaaaacaagatgaggagtaggaaatccaatctgatgtgagaaaaggagatctagctgatgagaacttacctcagcgtactcggctgatggtgcggcagatggactggcagatgacgacatcgccgtaggcggagatctggccggagaagggatcgcttggggatcgcttcgtgcaccgaggggatcgccgaagagagacaagacggagcttgcttcagcggtaaaaacggaggaaaacggtgtgagatttttcggggacaacggttggtatttaaagtgctagaataacggtcaggaaacggcaagagttgatttctctcggagtcgacgtatggcaaatccgaaacattatccaatatgccggacttggggggcatgtgttaacgaccaaatttggtaatccaaggatcggagatgaagaagaaaccgagatggaattcgagatggaaatcgtctagggaacagatttaactgatttaggatagtatcggggtttcaaccgatcttacctgatttaactattttttcctcatatgcctgattgacatgttaaatctgccctttatattaagatcttgtcgcatttaggtatattaggctctttgtttggtatattctacttgttttaatattttaacatagagtggtatcggagtattagccgatacatgctagatctatctgatcggctatgctatgaacatatacagtctcgttattaatatatatttcgatctaagtgatttatactgtctcggcatgacgaccgatctatccctatcacttgatttaagtatatgtcaatatagggattatatatcattaatatctacagccgatcgagtagatttagtttcttcttacttattaatgactgccgattgatgcatatatgacatcggctcaaagataaatgatacgtcatcggcacctagccaatcggctatcgtttatggatttaaccgcaatttctctgtctttgtttcttattgattgcaggatcaaatcaactggcacgctagcatatctgaaggcgagttttggacatgcactggagttaagcaaatctcccaggcctcgtgttttcacatcaacaccgcggcgaagggcgacgcgtcggtggaggtgctggagacagccggggagggccaagtcttccacctgtggcaaggccaaggagttgctcaacaggatggtcgccttcgttaacgtcaccggcgcgtgatctccgagttcgtggccacgcgccattgtttgcttttgggtgtgcgaaaaattttcctactttgatttgatgaactctgctatgttgtgattgaataaatgagacaatgagtgatttttatggttgttgactctgtatgtgttaatggaatgcacgannnnnnnnnnnnnnnnnnnnnnnnnnnnnnnnnnnnnn

SEQ ID NO: 22384 - DNA, 3537 bp, Oryza sativa
tgtggcaaggccaaggagttgctcaacaggatggtcgccttcgttaacgtcaccggcgcgtgatctccgagttcgtggccacgcgccattgtttgcttttgggtgtgcgaaaaattttcctactttgatttgatgaactctgctatgttgtgattgaataaatgagacaatgagtgatttttatggttgttgactctgtatgtgttaatggaatgcacgaatttccaacatcttcatatgagaaaattttgagctgcaagcctgcaagcctgcaaatctttggaggagaatgagagtgacagggcacattcacgatggagatgatgatgcggttgttggaggagaatgagagtgacatggcgcagccgcaggtcggcgacgtcggcgacgccaccgactctggcacggaggtggccaagagcccggtgtccatggcgagctcgcacctcagcatgttgccatcttacccgggaagaggggagagagaggagagataggagagttgacatgtgggcccaagggcatttttgacatttcacgcgatttctctttcctccccacctggaaattattattttaatgggtgcggtgtccaccagcaaatatccaacttttgagagtgtcttcccctaaaagtcacttcgcgcggtgtcccacagctaaaaccacgaagtcaagatgtcctatagcaaaatttgccattgctttttgttcttggtgctgagttgctgcagagaatagttaacaaagcttgcttcttaggtctgttgaccaagccaattaatgaacttgatgagaggggtttcccagtaatacagtatgctgatgacattttaattcttctcaaagcatcacagagagaggtgttctgtttcaaggcattgttgaattcttttgcacattctactggcctcaaagtgaattaccataagtcctatctctacccaatcaatttatctcatgagaatgcagtgctttttgcaccataggcacaatccttttacttatttgggtttgcccatggggacaactaggccaagggtagtggactttgcacccttggtagacagggtagagaggagattaacagcaagctcacaatttctgccacaaggtgggagactcacattgataaactctgtgctttcctcaatcccaacatactacatgtgttctttgcagctgcctgtttcagtggttaaagctattgacactgcaaggaaaaatgcctttggaggggaaacaacccaacttcaactagaagatctcttgcttcttgggatctagtgtgcagaccaaaggataaaggtggactaggagtcatcaatctaagagttcagaatatagcacttctgcttaagcatctagtcaaattttacaaagggcatgatctgccatgggttcaactgatatggaactcttattataactccaaagtgccacatttagtttggaataaaggatctttttggtggagggatatagtggctctatctgatgtctttaggggaatctcaaactgccatatcaggactggatcttcagctcttttctgggatgacatttggaatgataagataagaagcaatgcttttccatctttatatatggttgctttagataaaactatctctgttaagcaaatgggttctactcctcttgaggattgtttcttactgccattgagcaccccaagcttatggagaattcaatgttctagaggaggaatggtcctctctctctttgcagaacggtaatggtgatgaatggtctttcatctggaactctgataaatacatagctaagaggttttataagctcacatactcaaatgtgcatgtgccaaggccttttgtctggatctggaaaacaaaatgtgtaatgaaaataaaagtttttgcttggcttttatttagggacagacttaacacaagagatatgttggatagacgagattgtgcaaaggaaaacgatgacctcacttgttaattatgcttgaataatatcagagagacaagagagcatctctttttcttctgcccgttcattcaacattactggcagcatttgagaattgcatggaatcctgacctagaatttttccagatggcggttttggctcgcattcagttcaatcagagaggtttcttggaaattttcttcattgctgcttggcacatttggaagcaaaggaatgggaaaatctttcgaatgagcttcgctcgttcagttcctggaggactttattcaaagccgatgttcttctgcatttgtgcagaatgaagaatccactaaaacagattgtttttgattggttacaaacagtgtaatcctttgatcttttgtttcccttttgttctcttgtaatttgtaaataactttttttatttataaaattacactgcgaggcaaagtcctggcagtatttccagtcaaaaaaaatcatatataactaacatatgcatgttttaaaatatttttagattgtaataaacatatgtagttacctcatgctagatttaaaactgttttaaattctaataaacaaatgtaattaccacatgcattatttaaaattgttttaaattctaataatcatatttaactaacatatgcatgatttaaaattgttaaaaactctaataatcatatataactagcatatgcatgatttaaaattgttttaaattgtaataaacatatgtaattaccacatgcatgatttaaaattgttttaaattataataatcatatataactaacagatgcatgatttgcaattgttaaaaattctaataatcatacataattaacataagccatacaacaattgaattatatgaatattcaatacatccaaaacaatttacatcgtctacacaacaattagggcaatacatcggcggtgacggttaaccgcacgtactttctcctcactactgttccttccttgtgatcgctgcgtgagtaaggaatgtcttcgtttgataggaggatgctagggtcaaccgtcatcgcgaaaggaggttgcccctcaaactgatcataatcctcgacagtcttatcctcgactccgacgatttttcttttgcctaggagaaccacgtggcgcttttgctcatcgggccctttccccttctttcctttgctagacatgtccttcacgtaaaaaacttgtgttacatcattggcaaggacaaaaggttcgtccgagtattcaaccttgttaaggacaaccggtgtcatcccactgacatcaatcggtacgccttcactagtttgcctaacccattggcactagaacagagggacctatagaggtgcatagttaagttcccatatgtcctcaatggcaccgtaatacatgccaattgtaccatcgtgtctcatggcattgatacgaacatcactatttttgttcgtgctctttatgtcttgggctctcgtgtagaatatgtacccattgatctcatattcttggaatgtcttgatcgagccagataagcccctctgcaagaaagccagttattggttaat

SEQ ID NO: 22385 - DNA, 4587 bp, Oryza sativa
  unsure (1)..(4587): unsure at all n locations
nnnnnnnnnnnnnnnnnnnnnnnnnnnnnnnnnnnnnnnnnnnnnnnnnnnnnnnnattgttgcagaaccgtgaaatgtgctttacggaataaattgttgtttaccgtcattattgctttccttccgagagtcccctttccccgtagtctcccatcatggcgtgattcgggcaccccgattgggcaaaggtctttaataaattctatgcagaattcaatgacctcctgtgttccataccccttggcgatgcttgcctctggacgagcatggttatgaacatacttctttagaacgcccatgtacctctcgaaaagaaacatgttgtgtaggtacacaggtccaagaatacagatctctttgacaaggtgacaaagcagatgcgtcattatattgaaaaatgaaggtggaaatatcaactcaaagctgacaagacattgcatcacatcattttgaagggcttctaatctatccagatcaatgatcttatgtgaaattgcgttcatgaaagcacatagctttgttattgttgcccgaacattgtcaggaaggataccccgaattataactggtagcagctatgtcataaacacgtgacagtcatgagactttaggtttgtgaacttcttctccttcgtgcttattattcgctttatattcgaggggtatccagacggtactttgatgctctccaagcattcaaacatactttccctctctgccttgctaagagtgtagctggctggactcaagtaatggcttcctttcttctttggttccaggtgaaggtcgtcgcgttgttccatatgcttcagatcattacgtgctttcagtgtatctttcgacttcccaaatacacctaggaagccaagcaggtttacgcaaaggttcttagtgatgtgcatcacgtcaattgcgtagcggacgtccaagaattcccaatagggtaactcccaaaaaatagagttcttccacatcgccgtgtgatcatcttcgctctctataggttagctgccatgccccctttccaaacactactttaagatatttcaccatagcaaacactgctttcccgctgcgatgtttaggcttcgtacggtggtctgccttatgtttgaagtgctttcctttcttccatacagggtggtttgcaacaaggaattgacgatagcccatgtacacaaccttcctacaatgctttagatgcgtactttcactttcatccatacagtgagtgcaagccttgtacaccttgtttgactacatggatagattgttaagtgcaagctaatcgttgatggttacgaacagcagcgctcataggttaaactcctcctgtttgtcctcatcccacacggggacaccttctttcttccacaacaatttcagatcttcgaccagtggtcttaggtacacatcaatgtcattaccaggttgcttggggccttgaataataatcggcatcattatgtacttccttttcatgcatagccaaggggggaggttgtagatacacatagtaataggccaagtgcaatggccgctgctcatctctccaaaaggattcatgccgtccgtacttaaaccgaaccttatgtttcgttctgtcgatgtttcaccactacgaaccatcggcggggtgtctcagcatcccgtcttgttgacgttcttctgcgtaccaacgcatcattctagcatgtcccttgttcctgaacaaacgccttagccatggtaatatagggaaataccacatcaccttagcaggaattatcttcttcgttggctgcctgtcaacttcacctggatcatctcgtctaatcttgtatcgtagtgctttacaaacagggcatgcttctaggttctcgtactcctcaccacgatataggatacaatcgttcggacatgcgtggatcttctgaaattctagtcctagagggcagactatcttcttagcctcgtacgttgtctcgggcaatttgtttccctccagaagaatgttcttgacgagtttcaataaatcgccaaatgtcttgtcactaacactatttttggccttccattgcaagaattacagagtggtacccaactttttgtgcccctgttcgcaacctgggtacaacggcgttctgtggtcctctaacatacgctccaatgtatggtcttacttttcactttcacagtccttcttgacgtcctgcaacatctgaccaagatcatctgcagcgtcgttatcgtcaacatccccgtccacctcgcccgttctatttccttcaaatccagcgtactgagcccagtccggaatgttctcgtcttccatttcatcttcttccatttgaaccccttgctctcagtgcgatgtctaacaattatagcttggtatgaaccccgagtacaagtggaaatgaatagtccttgatgttgaatactccttctagttcttgcacttattgcatggacaacaaataaaacccttatgtttgttagcatcggccactctcaaaaaaataatccacgccatcaataaactctttcgaccgctggtcagcgtacatccattgcggatccatttacatgaaatgcaaaaaaaaaatcataaaaatattcaacgaaaatgaaacccactaaacagtgatataataatgacatatcaatattcatagaataattattttttaattatttttgaagttttaaacaaatatttaatgtattgtactccttttaattttcaatttagcttgttttctattattttagattaattttcaatatattttccttctcaactattatataaaaccttttataaaattgtaaataaacaaaatttctatgtattcttcttacctacactgattttctctctcatcaacttccaacaaagttttagatacaataatgtgtacgaaacataggtccaaatgtaatataacaacaaaaaaaacattggaggataaagttgctaaccttttagacacctccgattgtatataatcaccaaaataaattcacaagaaattttgacatgaccttccctcttgtttgaagaattttgaagcttggctcgggctggaggaggaagaagatatatataaaggggttgatatttagtcccggttggttactaaccggagctaaaaatccccgggatctttaggcccggttggtaacaccaaccggaactaaagttaggatctttagtttcggtttgtgttaccaaccggtagtaaagatcccggggggctgacaaggtctgacagcatatgaaccgggactaaagatcaaatagtccctttgctcttattaattgggactaaaaattctttttagtcctggttttcagtggaactcagactattatggattttggccgactgacgaaagatagtttctccaccggtgtgatctaatgactatatcacaacaagccttgttggggacggagtcttccaagtctattagactcaaggagtgggtacaagatgttgaattgttaatgctggtggattcactgaacaaacatcaaacaactttcattcagttataatcagaaggaaaaccaccagaatttcaacaatataaattatctcggagaatagatcgaccatagtactctttcttcgcctttgtcgtttcgtcaaattaattatcgataccacgatatgacaaatcaaatttagttcatctatctatctatcttctatctatctatctatctattatatattaaaagtccatgaaacatcctgaaaacgctcctaagtcgacacctggcacccctaaaaacgctcccaagctgctaagtggcgctctaataaattagataaacatctaaccattgatttttacttaactcggtggacccatcagttttgaccattagattaaattctcatctctccaccctaatatacgatggttgcatgatttggtcccaccaaaataattagttaagacttaagagcaaacaaacgcagagaatcagttatttctctcccaaaaaaatcaccgcagtattaattcttggaaagaaaaccgacgttgtaggtttaatgcaggagcctgggtgtgtgcttccatcatccaaaaaattataccatcgaaaactttttaagtgaatatcacctttgcatcaaaaaagtgaatatcactaactgctctaaactatttacagagttaggttcggattcatgaatattgccctcaatagttagtttctgaattttcatgtttctgtttgattaccagggcctgatgaaattttcacggatgctaaatctcactatatcaaattctcatctctcctccgtaatatatgacggtttcatgctttggtcccaccaaaataattaattaggagtaaacaaatgcagagaatcagttgtttctctcccaaaaaaaatcaacaaataaattttcagatgcaaagccataggaaaagaaagcaatgcgcctctagcttactttttcaaccaatatcaacgacatccatctacattttttctggaacaagcagcaacaaccaaggttgaaacaatcctaatcgtatcannnnnnnnnnnnnnnnnnnnnnnnnnnnnnnnnnnnnn

SEQ ID NO: 22386 - DNA, 4902 bp, Oryza sativa
  unsure (1)..(4902): unsure at all n locations
aacatctaaccattgatttttacttaactcggtggacccatcagttttgaccattagtttaaattctcatctctccaccctaatatacgatggttgcatgatttggtcccaccaaaataattagttaagacttaagagcaaacaaacgcagagaatcagttatttctctcccaaaaaaatcaccgcagtattaattcttggaaagaaaaccgacgttgtaggtttaatgcaggagcctgggtgtgtgcttccatcatccaaaaaattataccatcgaaaactttttaagtgaatatcacctttgcatcaaaaaagtgaatatcactaactgctctaaactatttacagagttaggttcggattcatgaatattgccctcaatagttagtttctgaattttcatgtttctgtttgattaccagggcctgatgaaattttcacggatgctaaatctcactatatcaaattctcatctctcctccgtaatatatgacggtttcatgctttggtcccaccaaaataattaattaggagtaaacaaatgcagagaatcagttgtttctctcccaaaaaaaatcaacaaataaattttcagatgcaaagccataggaaaagaaagcaatgcgcctctagcttactttttcaaccaatatcaacgacatccatctacattttttctggaacaagcagcaacaaccaaggttgaaacaatcctaatcgtatcaaacaggcgagtgatgcaagcagcaacttccatctttttattgtttgatctcttaacatagccttccactcctctatttttttaagcatataatttcgcttttttacctacaattttatactacgtactccttggtgatgttgttcgtattctgatctgtcgctactagcttctacaacaaagcgatatatcaaagctcttgcctcttggacaatatattcactaattaacatcgggtatttgggtgctgtcagtttaattttgagcacttagtcaagacgtcttgatgctgcgtgctttgccaccagaaatttgttaattgattttttggataatcattttggaagggtaatgcatgccgcttttttaggagaaacatattacaaacacatgagtttatatacacacgcgtacacttatccatagaaaacatattcgagagactgagccaatgatatatcttcaaattagtgaagtcatcataaacgcctcgctattgataggaacgttgtctactacaagaataattagccataaatatgagacccatgtcaagtctagatcttaaacctaggtgggtaagttccaccataggtaactaaccagccacactcactaattgcagataatgtacgtggagcccctcttccctctccttaactccttttttccatacattatttgagataaatgtagtatataaataataaataaactattgtaatttttaaattatatatacaatttttttattcgaccacaattatattctttagaattaaatcagttcatatcgatttgaccgattgcgttatatctcacagccaaaaaaaacacgaaaacatatgttatagtgtcatatatcacattataatcataaataactagaattagctctaatatgtttgaaaataaagtttactaaattatattatttaccattaacttaatattaactatactttaatctgtaaaataaaattatattttaggtcatatttttattcttggtctgtaatccaaacggacgtgaaaattataaaaaaagatgacagtatggagtatatatcactatatattctttatcggttataataatatgtaccattaaattagatttacaatataacaagaaatatgtcatatctttgcgctttacatggcatttgagaattataacaaaacgtgaaaaaacaatttagtgatatgggtaatatcatcacataaatatgcttactatgtagggtgcactctatttggcccatatcagttcacaaatatgcgcgactgaattagatttacaatatcaacaagtagcaagtcacatccggggccttgcatggcaatcgagaattatgacaaatcatgataaaaaataacaatatggattatatgatcatataaatatacttatcatgtggattctaatctatccggactatacggggataatctaaaatgtcaattcaatttaccaaatcatgtataagttgtacgttttgtagactacaccctaaatattaagtaaaataatggattgagtacacgtcgtgttttctctcctttgatttctattaaatacgtatggtgtgtgggtattttgtatatactaagtttggttaattagggaacataaacaatactaaagttatatatgagaattcatgcattaaaaatacacttcataacaagaacgtacttaacaaaaatgtactttagtctatggtgcttcaatatttataaattctctaaacatactaattatttctgctcttatttcaaactaaattcattttctccacataatataagagatcatatgagaaaaaaagaggagggagaagaagtaaatagatgtctgccattaaacagatagaataaagacatctataacatacaagaaaatttgttgattaaggtttataaactccaaatgtaagatatgctaatttctaaaaaaaacacacacatggtacacataatagttccatatgaagcaacactattgttgtgaaacaatagtttctcataaattaaaaaccacatggtttaaataaatttgatttagaatttatatgttgaaaggtaattagaagaaaattaaaagcgacgttcacaacaatctcaaataaattattgataaaaaacatgttcagaatagattaaaaaaatattttaagaaatactcatccacacataagtattcataattaaaattcaagcaacattaaataaggtgtcccgcacatgtgcgcgggcaacctttctagttctaacaaaagagcaaacttaggaagccaaaacaactctagctagtctggttcatggatgatcctccaatggatgatcaggagccacatgcgtatatgcagcttctggtgcagcctagctatgcactgcagaagtagctgaagggcagcttgggcctcgagtagtcggcggagaggatcttgccggcgacgacggcgttggcggcgtcggtgtagtgcacgccgtcccagctcacgaacttgctgccgtcctcgcacacccggtaccccgccccgaggcagctcacgttgaagtcgtagttgtacggcggcccggcatggccgcagcacgccattagcggctcctcgaaccctacaaaaaaaaacgtttgcatcttcttcgccatcaggagatcatcaatggcgtattaattagtcatcatctgcaggacacgatcgatcgattcgagatctcgattgggctagctagctctctcaccgtagctggagtggttggcgatgaggtcgtacttgatggcgaggatgtcggtgaagacgatcgttgcgcccctgagctgcgagctgagctggtcgcagatggaggagagctggctgttgaactcgtaggccccggcgttgagcgttttcaggcagccgctggggtcgaggtcgccgtcgtcggccctcggcacggcgagcttctggggcaggcagccgagaggccccgttccatggatccacaggttcttggctccattgtaatacaaactctgcacacacgtacgatttcagaattaattagcactgacacactgacacaaatcaaacatgaacactgtaaattcaacgattaagggagtgtttagatccaggggtgtacactgtaaagttacactgtaaagtacaccgtaaagttttgatgtgtcacatcggatattatatacggtgtcgcataggtattcgagcactaataaaaaaactaattacagaatctgtcagtaaaccgcaagacgaatttattaagcctaattaatacatcattagcaaatatttactaaaacaccatattgtcaaatcataaagcaattatgtttaaaagattcatctggcaaattagtcacaatatatgtaattagttatttttttagcctatatttaatactttatacaggtattcaaacgttcgatgtgatatggtgaaaaattttaaggctagaatgtaaacagggcctaaggttcacatgtatgtactatgtacctggatggcatccttgatctcggagaggatggccggaaacctctggcggacgacgtcgtcgtaggggaggccgccggcggagaaggcggcggagaggtcgttctggccgatgtcgatgaggtagagcgcgttgcggaagccgtcggcgtcgacggggacggcctcgccgcggctagcgagctcgagggagcgctgcttgaagtggatgaactgctgcacctggatgtgcagggagaatgcggcgttgcggggcgccgtggcggcgccggagatggcgaagttggcgccattggtgaagtcggtgcccaggggctccaggtacgggctcaggtagctcatgttcaggctctcacctgcacgtaacgtttggtgcatacacattgcaaaccaagtataattaattatacacaagcttaaaaaaaaaacataacgcgtgttccaatatatgctcaaaactacttcaaacatgcatatacttagtatacagcagggttttcaatttccaaataaggtttttgccggtggtgaccaaaatttccaaaatcatcaaaaatttgggttttttttgaccgaaattatttaaaaatttgattaattttgaatgaatttgaataaaatttgnnnnnnnnnnnnnnnnnnnnnnnnnnnnnnnnnnnnnnnnnnnnnnnnnn

SEQ ID NO: 22387 - DNA, 1239 bp, Oryza sativa
caggtacgggctcaggtagctcatgttcaggctctcacctgcacgtaacgtttggtgcatacacattgcaaaccaagtataattaattatacacaagcttaaaaaaaaaacataacgcgtgttccaatatatgctcaaaactacttcaaacatgcatatacttagtatacagcagggttttcaatttccaaataaggtttttgccggtggtgaccaaaatttccaaaatcatcaaaaatttgggttttttttgaccgaaattatttaaaaatttgattaattttgaatgaatttgaataaaatttgaccaaattcacaagaaaggcaaaaaaccgaaaatttcggatgagatatgtgctggtggggggcaaaatttccgaaatttcaatccctggtatagagtggttttccggtttgtgagaggttccgatccaagagccaccaccgtattttctagtgaaaaatttagtacctattaatactcggatactaggaatataaacatattataaatagcagatttttaaaagaatattttagaaagaagataatatgcgtgcacatcttttatataatgagaaaaccgtgtacaatagaatatcgaccaaaaatgtagtgaaatttatcttgcttgttgggtcccttgcaaccaacatgggagtaggaacagttgcatgcatcacctcaagcagaaaacagggcaccagatcagctggctgggaactccacagtacacaaactcaacagacaattttgatggcagcaatcaagcaatacagcaacttgaattgatctagcctagttaacaatgcaacaccggcaggcgtagttgcagccttgcaggaaatagactgccgtcataagcggtgaccatgtaatgtatgcacggttagcatcagttaccctgttaaaaaaaaagaatggattctaatatcttgaggggatattttctcgtgtacttttttttccaaatttgatataaatagtttaaaaaattctaaaaaaaagttgacaatgtagagtagaatgatatctactggtacaccaaaatcaagttcaaatttgctctacacatcgagaacaaaaagacaaatttagatgtgaacaggacactactattcatatgctaaatttatcttttttatatctcaacatgtgagttaagtgtgaacctaagattttgtgaagttgtatagatatgttgtactccctccgtcccataatataagggattttgag

SEQ ID NO: 22388 - DNA, 4948 bp, Oryza sativa
ttatattgtgggacggagggagtatgagtgtttttaattttttttataactgtttggatggttttgaagcaagcgagggaacatgccatcgacggatcaaaatagtttccaaaaaataatagaaatggtcgttttaaatagagcgtagaaaaaacacaaaaatcagaagagatagattgattaaaacaatatctaagtggttgaagctcaggttagaatttttcaaaaattgcatggttttcagctaatccaaaggaaattcatatgatttttttatagttattcttttgatttcaaatgaccacataacaaaatgttttataagactaaattcctctaaaatttctctaaagaatcctaatttgttcgaaaccctttcgtttggaattaatggagggaatagaacccaataagcaaatcccaacaattaactgacaagtactagagacagacagtcaccaagcagcaagatctgttttatctctgcaagtctgggccggattttggtgggaccttgccatgtcgatgcatgcgcaccctttgcgtcattctcttgagttgatcagagcgtgcacgatggattaatcagagcatcacaatcagccactaacactgctactagcaggctctagttgctacggcaaactactcgccatttcattttcagtgctgattgagaagagcgattgccacgaacgtggaagaggaaaacatgatatgcattttccaaaggagaaaagggcagttgtttgccaaaagcaaaattatttgtgaaaagtgtgctggcaaatacacccactaattaaagttatttgatttggcacaagcaagagtgtgcatgcaaattaatacactagtacattccagatatacatttttaacaaaattgcggatatatatttttttgaatgaaggatttaattttaattcaccaccagtgtttgtaactttaattccgtagaataaatagaaatgtagtatcatgtaaatattttaaacaacaaattttgcgatgcaaagtacattttcagaaaaaaaaaactactgcaaattaattagcactaactaaaaaaaagagatttggagggagagacgtccctccaagaatttttttaacaagaaattgtgagcgtattgagattgaacacgggatcttggggttggaaccacacacttcttgtcactgtactatcaagtgcatctcaattagcgctaattaatacaaagcgtgctgagatagtgagatgtatgagaacaaactccctaatatagtaaataaaacaaaatatttaatgtttagaaaaaaatatcagaataacattatatgatagtgtaattttcaaggcacacgcatacttatttttctcaaataggctttttgagaaataactgtgatgcatggtccatgttttagaaattaaaatatattttgtgtgcttaaaaattagtactagatatttagtatgaccaaaaaagaatgttctagtattaattaattatgagataattcagcgaaggaacggccagctactagttggttggaaaaaaacactgcctctattaaaaatgtggatcagaacatgtctagatttcttatattgggtttgttcaaattcgctatactaaaaaaatattgaattatgtattaaggacacaatactaaaatattttaggacgaatgacgcatcgttttgtcatgcatcgttcagactttgaaacaaggcaccttaacgttacgccaaccacacatagttcctggaagtcctgagactttttcttttttcttgtttctcttattttcaggggaaaagacctgaactgtttgggctaagttacgttactgtgctgttccgttttagatagacaatgtagaagcacagtagcaaaaaaaaaaaaaaaaagagagtaacggcgtgttcgatcggtcgtccggtctgtgtcgatcgagcaaaatcctgaaacggtaggcgatcgattttggtgtgcacgcgcacacaccatcgtcacagattttggagaggagtatgggtggaaggtggaaggtggaaggtgtaaggtgcatgtgactcacataggtggtcgatgacgaggcggccgtcgcagaggcggcccgtggcgcggcggaagaaggcgcgcccctcggggagcgggaagtagtaccccatcccggccgcgatgccgcccgtgtccgtgttcgagtcgccgaacgcgaacaccaccggccgccgcgcgcacgacgccgacggcgacggcgacggcgacggctggtctccgccgtcgtcgctgatttctccggcagccaccgccaccgccatcatcactgctactactgccaccaccgcaacgacgacgccgctactagctgccatattgttgcctagctcgatcgatcacgtacgcgtgcaagtggtggctggacactagctggtaatagctgctttgcttacgcacgatctcgactagctggatgagacaaattaaccgagatgatagctaagcaaagatcgagcagcctggacctggagaaggcaggagccgaggagctagcatatatagcgaagacggggagtgggcgggccccgcacaacaacacgcgctcgcgcacgaactgggatcctcatcatctcgcgatcaaatgatcccaacaccaaggcggtggggcaagctgcagcaattttcacgtgaatttcgtcgcggttttgcgataaatacaacttacagttttagcaagtttctcgctattcatacttagcatattgcctatactttgcaagaatttaaaaagagtaaatatcacaaaaccccagattttggggcacatctatcacaaaaccacatcatgttaactaatttttatcacaaaaccccactctttcttggggcatattgttgcatgccacccatattccgttgctctcctcttgtgcgccgttttgttcgccgttttccgctcatgtcgccgtttccaagattacgctcatgattccacgacgaggacatccatacttaaagcgggaatcccctctgcatcatcactaggcgtgaagaattggcgccaacctaggccatctcctgctacttctctgccctagacaacaacatagtacataacttgatcgatacacaacgaaggatcaaggagacccatggaggaaggagattagccttgttctgaactttgtagtaggtaggattgcttttcccccacttatttattgcagatttggcttgctaaacgaaccttaattgtctatatggatgatgggtttgaagtttcccctttggttgctgaacctgtgataatcttagttggataagacaatattgcagcagattaatttttggctaaattgtgcttttagtcatcggtgattttcttgatatgataggatggaggatgacatttggacactgaatttgttctgtgatggtgctttaaatggcccgatgcatgtgcagaaaaatatggatagaaatatcatttgctacttcaatttggttggactgatcgttgacattggctacttagattgtgattttatctacttcctctatttcataatgtaagtcattctagatttttttacatacatatggatgttagtgaatctagatatatatgtgtctagattcgctaacatccatatggatgtggaaaatgctagaatgactttgtcggtgatatgggaccgggagtatcatgaccagaggcttgaggcagacgcaatcgcccacgtggcctggcaccttcgggaacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctcacgcacgccttgccccatcccgtcaagacgaaagcctctaggcactcgtctcaagccggagctagggtgttatctcttagagatggcacgttagccctggtcagatttacaccaggcttcatcctacccattacaggcaaggtgttacacgaagaagggcaaacatgcacgttgttaagctgacgcgtggtggacaagaatgaccggtctggcactggtcgggtcatcgacagacagccacggtcccgcgtcatctctgtcttcgggggaggtgggggtaggtgtgggctgtcccatcagaagggctcccggatggaaacccgtaccgatctccgcccattaaagagaaaaagaacagtccagtttggaaagagaaaggggcatgtggtatccccttgagatataaaaggaggaccttgcccatttagagggggacttttcccttttggaaggctgagaggaaagggagttaatcctttgtaacttgtccatacacaaatccacaaaaacacaggagtagggtattacgcttcgcagcggcccgaacctgtatacatcgtccgtgtcttgcgtttcttccggggacgcgatctttccacatacagagagagcttgagatctcaccctaagcccccggccgaaccggcaaaggggggcctgcgcggtctcccggtgaggagccacgagctccgtcatctggcgcgccaggtagggggctcagtgtgtgttttctgagctgtcacgtcctgataaattcatcccgaattaaaaatcattctctaaaaggaataatagaattaattaaaattcgaaaagaaattggcaaacactaaaatacgtgcaagaaaaattcaaatgtggcccggagaatttttgttaaattctccttggtctaaaaagagccctc

SEQ ID NO: 22389 - DNA, 665 bp, Oryza sativa
  unsure (1)..(665): unsure at all n locations
attcgagctcggtacccnnnnnnnnnnnnnnnnnnnnnnnnnnnnnnnatcaaggctggcctacgaatatgggtctacaggtttggttcttgcatactagtttgccttaagaatttgatcaagatattatgttatgctacaaactacattatctataagggacaattgcccttatatctcattttttcttcatcatgctttcaaaaaagtttgtttcatttccctgcctttgactgtcatgagttggtttagtgattttttaagtgccactcaagtagactcatacttacattcaggacctgcttttacttatgctcactaaattctgtataatttcgaattcatcaaagtcatcacaaaatttgggaccaacacgagggaattatcaatttgattttacagtggagacgtggatggcagggttccagttattggatcccggtactgcgtaaaagcccttggccttcctgttaagtcacagtggcaaccatggtacctaaacaatcaggttgttaccctattacatattccgtgtcatctacgtgtattaatcaaaataaagtgtaaaattatgaattacaatttgtaatattgcacaatttcttcnnnnnnnnnnnnnnnnnnnnnnnnnnnnnnnnnnnnnnnnnnnnnnnnnnnnnnnnnnn

SEQ ID NO: 22390 - DNA, 728 bp, Oryza sativa
  unsure (1)..(728): unsure at all n locations
nnnnnnnnnnnnnnnnnnnnnnnnnnnnnnnnnnnnnnnnnnnnnnnnnnnnnnttgctcttttgatggcttgggcatcttgagcatcggttccagggataaccttgagagacttggtcatgtcagccacattcttgatagccgatctcaatctggacttttgttcttcaatggcatttggtagatcggatagcttttgcttttctagatccagctcggcgttgcattcttcgagttgagctgttaaatcaattttgcgagcttcaagccgatctatattcgactgaattggcccaacatagagttgatctaacttggctttctcttcatgcacaagctgctgattggcttggatagtagcttcaatgtttttccgttctcgccgatcggctatccgttgcttagccttctctagcttaaattggtgttgttcaaggtacacggctggagtgatggtgtttaccagatcgtccagaattgaggcttggatttcagcaaatcgtgcccggattgaaccacaatcagccaccagattatccaggaagattctagctgaagggatatgtcttcaagtgtttttttgacagtgtcgtccaaaggggctagagccttacttgtaggttcttcttctgtctcatcaaagtaatctttgatatcaaaagaaaacagatcggctaaagcctacaaagagaaatttaaagacatttgatgacaaacagatatagccg

SEQ ID NO: 22391 - DNA, 13448 bp, Oryza sativa
  unsure (1)..(13448): unsure at all n locations
ataagacatggtatgtggtgggttctaccaagatttagtcaactactattaggtatgtggtatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccaccctcagccagcataatctgcagactccaattcggagccggaaaatacataagatctgggccagaaaccacattcacagccaagctcttggcatccatgttgaactcaaggatgcagttctccacgagcagccagtagagaacattcccaacaagaacaggaggcttcatgtcaatggcagaaatcttttcccccgagatggattcatcaagatgtctaagccctaatcccaaatccaaatcgtgggggatcaccgtcctcccacagaccacctcgccccattcgccggaaagcgaggagtagacgcaggcgcaggggcggcggcgctggtcgatgaaggcgaagaccacgcggaatggggtggggcggtggcactcgccagcgtcgcagagcaaggcggcgccgcggagcaaggctcgccggagagtgggtcccagaccatgaggaggcggcacaccgagaacggcgaggcgaggagcgcgcgcccgccgcggcagccgaggaagagccagcggccggggtggcggcggagggagaaggcctcggcggggacgcggtcgggggctcgcccggtggggacgaagcaggggacgttgaaggagttgtggaagaagccgaggaggggagctcggcggcggcgggcgtgggagtggaagcggcggtggaaggccgggtcggagacgaggcggcgccagcgcttgcagaccagggagaggcaggggagggaggaggggtcaggcgggaggatgtggaggatctcggccagtacgtcgtcggggaggatggacaccggcgatggctcgtcgccggcgtcgccgagcccgcggcggcggaatgggcttggcaccgccggcgggtccatgacaaacagttgtggactcgaatgggaagttctcttctttaggccgggtttagtccaaaataattctttaaactttcaatttttccatcacatctcaatttttctacacacataaactttcaacttttcaatttcaaacaaactttcaatttaatagaaaatgagtagaaaacgaaattagcttgagcaagtttggattccgccaaaattaaaggatcggagaaggctactgcttgtctgcttgagcgcgcgctcacgacggggacagttaaccaaggttgtcattatctgattcgtatagtagggtttgtttgggacggataatctggtaaaagctcgtggcttttagtttatcttatggtttttataacagaatctgaaaaaaaaaaatttagggagagcttataattgtgagagaagcggtagctacctgccttcactaaacaaacccgctgccagtcttcactaaacagacccttagtattttacgataataatatcctatcaagctgaaacataccgatcttacataatattctaacttttatagtatcccaatctccacacaattctataaaattttaggtagtatctcgatgttagattcctacaatcctataaaatattatttaaaataaggtgattgaaaatagtgtaaaaaatatgctcaaattcacataaaaaccgattaaatttatcaaaaccaatattatattatttaatttatacaacatattatatattttatataaaatatgtatttttaaaaatctgatagtatcttgaatcccgatcctatggtagtatctcgatcctatgatactacaaaggagaaagtccaaataccccccacctcaaaaaaaatttaataaaattggatggaagtccgtttagcattctgaactttgaaaccagatattgaaccccttaaattttacaataccgtttatataacccgctaagatggtttcgcatagtagtttttatctaatttgtatataagtttgatgagtttgatcacataacatacatattggacatatatattaaaattccgatctaaatctttctttttactccttgttagctaccatttacaaacaagtactaacataataattgtatggcataactatataaggataaatttgtgatttagaactgatgatatgcaaatatgttagattagttattcaaagttattcatttaagctttcaaaatatgcaaaccaccatccaaaaccatcttagggtaatatggatggtatggtaaagttcagggagttggatgtccagttttaatgtttttaatgtttagggtgctaaacggacttccattcaatgtttaggcgactatttggacttcttcctactacaaataacaaaacggtcttatataatatctcgatactgattaccttgcatttaaatgttcgctccgtccatacaaaacaaatataattacatgatatggcacaccttatgtgaagcctcacacttttaacactggagataaaaagtgccgaacttagattattatttaacaaactattattttgccaaataataactacactggagataaaagtcaggcaagtctctcttatgatcatgtttgtcgacgtttgatgtcgcaattccggtatttgcatagtatgggaatcgttggtactaggatatacgcgagattgaggtaaaagagatggagacaggatttttatacaggttcaggcccctgaattgtcaggtaataaccctacatcctgttgcccgaagccgatattactcttattcaccataatcaaaacagtataatatttggggtagcctatctaactgttgtcgatacggcggtctgaaggtctgactcgtagtcgacaacagggtagtcttcctcctcgagtccgtgcccgacgagatcagagatagcgctttcgtctctcttgacagtatccggagacaccgtaggggactagccgtgcttatccccgaagtcaatatccgacgtcttgtcttagcgtatgttggcttgtatgttgtgacttctgttgttccttgtatgttgattgtctcttctatggtgggtgtcttatatttatacccataggtgtccccttgtccaagtagaactatagaaaccaatatgaatacaatccaagtagtccttgtcgtttccatgtagaactctggttgtctttccttatccggaactccctccatatccgaagtcagttcccgtataagacatggtatgtggtgggtcctaccaagatttagtcaactactattaggtatgtggtatccataatcctgacaatgttgatagatgataattctatttcaacttaaaaacctatttcataaaaatatttctcctagtattgcatcaaaatatattttctagaatataataatatgaactatgatgatatgattgacaaaccgatgatgatagagatcattgggatactagtatggtgggtagggggagctcagggatatgatgattgatgatgatggccggtcagggctctccctacatacggtgtataaatataaggactaatcatcccctcactcgtatcagagaaccatatgtaccgtgtcgaccatagatccattttaagacgggctggacctagtaccttatcaagtttattatactctacatgggtacgtagtagtaggatgggagatgatataaacctcatgaatgccgatgatgtgcattctaggtgcatatagtagcgcggtggtatggagagctgataggctcaacacaaacatggagtgtaataaattgaagtaggggaaaagttctgtactcttagcatggtgccgcatctagtgaagtgagacagtcaaacatgttaagagtatctatgggtacaatgatacaagcctgcgcgatgcataaattgtgattcacgcctgtctcttggattggagcctaccgggagttgctacaaactctattcaatgttacgagtatactctagcttttatacgcttccttccgaaaactcttttacaaaacagaaatatactttacttttgatgacgatgaaggtgatgatgttacaaaagtatagtgttatagtatatagatttaggggctgctcagattgatgccattttcaatcatactatttttttttggcaaagttgcaaaaaaatgtctacatttggtttgttgcaaaatttgatatatacataagaaattctaccaaaattttggcaatattgccaaaatttggtaaggtttattttggctacaatctgaacagatcttatatattattattcatgcatatacattttgctttcaatgacttgctgagtacgaaagtgctcacccttgttgtataacccctttgtacaggtttgattccttgcaagtgtaagatggattagcgatggcctttaggactctcagggacgaattaaaaggtagttgtaactcactactagaaaaaagatttttcatagcgttacattatcattttcgctgacggtcatacacgaaaaccatcggcaaaaacataacgaggggtgggggggctacggaccgctagcgattttcgctagcggccgagttaagcggaccgccagcgaagatgtgctattttccctggcagtccactttggtaaagagcaccgctgcaaaaaatccaccgcccaccaatatttttcacgcttctccgcctctctccctcctctcaacgcctcgctaggcgggggtccaggggcagtgactcgcgaggcggggtgtccggcggcggcgactcgcgaggcagtggatccggcagcgccatgcctcgccgtcgccggatccgccgtcggcacgccttgttgccgccatatctcgtactaagtttagtttatagggacaatgggagtacacaaataaattattccatggtcaatactcctcaatatggtttgaggaggtactagggtccacttaaacactacagaaaaaaagtgtgaattaagagttgatggtaagtgttttttattactcactccgtttcaggttacaagacgttttaactttggtcaaaatcaaactacttcaaatttgattaagtttatgcacaattatggtaatatatataataccaaattagtttcattaaatcaacaattgaatatattttcataataaatttgtgttgagttgaaaatattttttttcctataaacttggtcaaacttgaagcagtttaactttgaccaaaatcaaaacgtcttataacctgaacgggagtataagcgtttcattatgtctccgtttagaaaaggtcaagcggttaccattggtattgtcttgcaaagagctttgccgtctaattctccgaaaaggattaatgcatcactggttatccaaaagctgattataagccataatagcttattagcagaaaaaaaaagtaatctacgtgtaaaactcttgtatatgtatttttagcgacttaaaatctaatgccaaaaaacaatgttgaaaatattttaaaatcaacttcaaaactaaattttggttttcacttattctttttagtaatcgatggggctgttagtcgaaatctactatgtaggtactatgttctatattcttattatgtatctccattctccactcgatgtggccgggaggcgcccccaacagatttgccccatgctggaaaatagataaaccacatctactcataggaacacgctctttgttcctaccatcacgattgtgcctagtgtcaacatcagcaaaataccttgagcaagcagtcaagcactcatttgcgacatatgcctctgcaatggagccctcaggccttgccatcttcctcacaaagcgtttcaaggtcaacaacctacgctctacagggtacatccatccatattgaactggaactcttaggattgcatcatcaattaaatgaatgcacaagtgcaccatcacatcaaaaaaggcaggcgggaaaatcttctcaagcttgcacaatattattgggatttcacctctcaaaggaaaatgccttagaaccttttctggaatctgccttcggctatctgcatccctccatcttgaagcaccacatattgggcatgcatccattttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtccaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgacttcgttcttggtccatgattttgatctgggtacagatcctgtaccatacggtacatttgatcatcttctgggtcatcctgaggctcattcgtctcaaattcaacattgcagctaacatcttcattcaaatgctcaacattttcagtgaccatgaccaatggttctccatgatgtatccaccgagtgtatgtgttagacatcccgtacataagtaagtcatcctccacacgtcctttatattgatgtaaccattcaaacacttacgacatgggcataatatcttctgactgccactcaaatttttagaaacaaagtccatgaactcggtgaccccctccggatgctccttgctaaacaacttacaattcatccaagttctttccatctgttacatattgaaataagacaagcatcgaatcaatgactgattattgcccagactactattttcctatttctatcacttcaagtctgtggtttcagttcaaaatttaaaaccaaaacataagttcttctcatatgtacctttcttcctaattgaaggggatggggcagtctctggtcgacctcacccgccgtctgaagtgatcccaggctagagctcttgggggcttcctagcggttgagcccgtgaagcccggcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggacggggtggggcttgggatccagccggcggtgccgggctccagcagccgcgttgggcgaagggcgacagcgtcgagctccaacagccgggcgctacgttggggacagggtggggctacagcctgcgtcgtcgggctccagcaggagcaatgggaaagggcggcggcgtcgggtccatctggcgcgatggggaaagggcggtggcggcggcgtcgggtccagcagccgcgatggggaaagggcagcggcgtcggtccttgccagatgtgcgttgggattcttatgtctcccagcaatagtgtacaagatgaaaagaatcaaagattacatagcatcggaagagtagctcagtggtttgtttcattgtttgtacttgggaagccagaggacgtgggttcgattcctcctcattgcaagaagtgctacaatttttattcttttcaagttaatattacattttttattcttttcaagttaatattctaaggtcccacatgtccacctagacatgctcacgtggctgtgccaaggtgttccttttttttaaaaaaaaaatgatttttaaattatgacaatcatattcattcgcttttgtcatgaactattgtcacaaagaatgggaaaggcacatggtgacatttgtttatgactaaattacaacttagtcacaaacgcttgtcattcaaagaaaaattgtcataaacgcatcactactgtgactaaaatgtgttttgtcatatgaaatttgtcatagaaggccaaatttcttgtagtgcggtggaggtatgtttgaagtgtatagtggcaaagttgacattcggtgttatttagctatccaaattgctagtctattcgttgtgtacatttacacgattaatcaggcaaagaacttacatttctttagaggctacgacctcgaaatgattacacatcggttcacattgatgaagcccataaaatatatttcatagatgcatatatcatataaattttgaacggttggatcataatctaaaggctagattgcatccatgtttcctacattcttttaacgaaccggtatacgctggtggagaaaccctttgtagtcccggttcgtaacccccctttagtcccggtttccaaaccaggagtaccaatccgggactaaagatcgctatctttagtcccgggtgaaataaccgggagtaaagattgatctttagtcccggttggtgttaccaaccgggactaaagatcgagctgaccttttttttttttgcatggccctgttgctgcatggtttatatatatatatatatatatatatatatatatatatatatatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcatagtagaattcacccttgggatcaaggatttcttcgttgatgaatgccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagctgcacaagttagttcctgcttttgctttgcgcactacaaataaatgacaaacaacgagagatctaattaatataaacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgttgggccctttgaatctccattctacaacgataaaagggagtatattattttctatagtctacttatatacaaggacctaattaattaaaggagacgtatagtaagaaatctaactgaacgatatacttacaaaatccaacaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcaacagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatccagaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcacagctgctacggtttcctgacgggctcaccattgcaggaggaatggtcggctggggatcatgggaccgatgtgcggccatgcgttcatcaaccttccttgccacctcctcttgcatgttgagttcgtagctcgatacccgaaactctaggtctgcaatcttcgcctcggtatctctcttgctcctcatccgactccggtacgtgtggatgtcctccttgaaaccaatcttccaaggaatcacccctttccctcgtgttcgtcctggatgctctggagtctgcagggcgagtgtcagctcgtccttatctctgtctggtcggaacgtgccctgagaggaggcttccactgcatctgttagtcgtcgcgcagcctctcgtatctgatcgccgaagaccagtgagccatcggctgggttgagcgttccaccgtgagcatagtaccagaacttcgatcgtttcggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcttgcccttgttcgcctgtcttatatgcaacgaactcgtcccagtgatcccttagctttgggaatgtgtcgaagttcagtgtctgccccttcagtatatacttctggtacatatctcccttgaacctctgaaactgttctaccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccatactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtgtatgctaagtgtttcgtgcgtatatgctaagtctaattaagactacaatagtcaattgctacttgtcgcaccaattccgtagtcaataattacatactaagtctaattacaaataaagtaatattatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataacattagaacactacacaatcttatatgataagtctaattacaggtctaataatcttaattaattgcattacaaatataacgatcatttatattattacgtcacttgcctgctccaattccttctagggctagctcttccactcaggtttgacggacgactctgacaacacgtcttttctgcaagatacagaaagatgtattaggataaatgcgaagtaacatatatatatatatatatatatatatatatatatatatatatatatatatatatatat

SEQ ID NO: 22392 - DNA, 408 bp, Oryza sativa
agacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtgacagttgttccatcgtgtcccatggcatcgacacgaacatcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatg

SEQ ID NO: 22393 - DNA, 38349 bp, Oryza sativa
  unsure (1)..(38349): unsure at all n locations
gttggtgttaccaaccgggactaaagatccggggggggcctgacaggccctgacagcattcgaatcgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatgtattcagaccctatttagatgggactaaaacttctaagtctcagtcacatcggatgtttggacactaattataaatactaaacgtagactattaataaaacccatccataatcttgcactaattcacgagatgaatctattgagcctaattaatacatgattagcctatgtgatgctacagtaaacattctctaattatggattagttaggcttaaaaatttatctcgtgaattagttttcatttatgtaattagttttataagtagtctatatttaatactttaaattagtgtctaaatataaaaactaaagttaagtccctaatccaaacaccacctcactctctctattctttcctgattaagggtttccattagaacgcttttgacaccaataaccggtgcccgttgaaaaactttatatatatatagattgcactaaaatatcaaataaatctatttttttagtttataataactaatactcaattaaaatgatatttttgttttaggtgcccttagttaattttagtgctgatctttccattaaaggccgagtttagttctaaactttttttcaaacttttaactttttcatcgcataaaaaatttcctacacacacaaacttacaacttttctgtcatattgtttcaatttcaaccaaacttttaattttatcgtgaactacacacactgaaaaaaagaaatctaaatcctcatcaatctcgaacgggatgcgaatttcatccgatttataaccgctccaaaacccttctagaacgtctcgtcgttcaaatcgtccgcaccaaaaacccacacctccttttccttcttcctctgcaagcaaagcaacccggtcgaacaccacacgccgcgccccctcctccactcctcctctctcctccgccgccgcggccatggtgctcgagctcgaggtccgtatgccctccacccctcccctcccctcccctccccatttcgtccctcctctcgcttccccccattccgcgaggcgagctctagccgcggcgagcccggccgctacggcgattgaatttctgacgggttttggaatcgcgcgcggtgcaggcgacggtgatatgcgtggacgactccgagtggatgcggaacggcgactacccgccgacgcggctccaggcgcaggaggacgccgccaacctcgtcgtcggcactaaaatgacggttcgtttgcttgcttcgctgcctccgcttacgcggcgttggattggattggattggatcttttttctttttgggtggggttttgattccgggattttgggggcgtcgtgtgcattgcagtcgaacccggagaacacggtcggggtgctggccatggctggggacagagtgcgcgtgctcctcgcgcccaccagcgaccccgtcaagttcctcgcctgcatgcacggtgcgtgacttgccccctaattgccatctaattctgtgattttgcctgtttctccaacgatccagaatgtggggtagttcattggtcaatccatgatcactttggtttggtttgttgtgtttcaggattatcagttcagataaaatgattgttggttaatggttgagatgatatattgatcaatccatgatgttgtttgccgaaaatgtaataacgattccagaatgtgggcattgatcaatcctcttttgtttggtttgttgtgctccatcaggattatcagttcagatagaatgatggttggttggttagagtgcagatagtttattgatcaatccatgatgttgttacttgtttgccaaaaatgtaataaggaattaaggacactgatcacattttttgttagtagagtagcacgaaggaaccattaacttagcttatcctcctggaattcaattatgaatatatagtcctgtcttaagaaatatacacaccttctgatcggcgagtcttctccaggatgatcagtttagatagaaatgatgttggttagcgcgcagtcgtagtttactgatcaatccatcatgttatttgccaaaatgtgacaagcacactgatctctttattttctaaggtagtgctaagaacactctaaggaagcattaaattagcttatcctcatggaatgcaactctgaacatatgttgtcaggatcactgagtctaatgtgttcagtgttcaacgaataggtaagaagaaccacgacgagttgtcgtttctgtgttgcttatggaatatgttaatcgcattttgttgtacgatttggctaaattcatgcaaagaaacaatgcttagacatatctggtgtctcccctgtatggtccacttgtttgtaaaggaattgtggtaataattgtgcatttgtactgtcataaactcatcacctatatttgctttcattttgatatgccattctaaaagtattatctatattacaaggaagagatgatatggatgtaatgagaaccacaaaatgttaaatcttgttgtgatcgatcaaatacttgatagttgttaacactgctgctttaaagaaatcatgtgtcacatattcctataactgaaacactttttatggcagggctggaagctagtggtgaagcaaatttgactgctactctaaatattgctgaactggtacttaaaaatcgtcccgacaaaagactgagtcagaggatagttgtttttgttggcaggtaccgcaaaaaagttgcatgatagattctgttccaaacttctcctatcacaagtctatgttgatgtgaattggatgccgtgtatttgtgactggagggagcaataacaatctgaaatttttatttgagctgaaattatgctacattgtcccttgcagccctgtaaaagatgaaaagttagagacaattggaaaaaagctgaagaagtataatgtttctcttgatgttgttgaatttggcgaatctgacgatgaaaagcctgagaaactagaagctcttgttgctgcagttggtggcagcagccacatagttcacatcccacctggggaagatcttcgtgccgtccttgccaagtgaacatctattatgttatctgcaggatcttacccaaatacctagtgctagagtatgctatcactaataagtaataatcctattcctttcacagtacaccgataattactggagatgaaggagggggtgctgcagccggtggagcatctagatatgaatacaatgttgacccaaatgtggatccagagtttgcagaagcacttcgtttatcagagatagcaaggcaagaagctgcagccgatggagcatctagatatgaatacagtgttgacccaaatgcggatccagagttagcagaaacatttcgtttggctgcaggggaaccttcaacctcaaacactgatactgttctcttggaatctgactcagacacttatgttccttttcatgagttcatacaaaataatccttttgtgactggagcggaatctgcctcagatagacctgctgacgatgagagggcaacggtatgctactacgtgtctatgttacagtgttactatccttattgagatcactggctttctttgtgcacaagtccaactactatcaaaccatgaactctatggctgcagaattccatcaagcatatatttgtatttgcggtgatgtctatcagtttattgcctcggagcactcatccctcaaaacatcaaaaatcactgtgcacccatgtgtgctagtgcgtatagcaacaccctatgaacttaactgcccttgggaagtgcttgttctgtcccgtgtagtattctccagaaaaaaaaaacataactctagcaacaatctgtttccaaatcagtttttagtaaacagtaatctgattatatgaatatgaataaacaggaactacatttagacttctaatcttggatctgtttagaattttaaatattccctttttcttatttgggaaccttattttcttttgaagcgccttgaatgtgttgctagaatcttgagccacttcctcatttgttgtgcttaccttctaaagatgcaaattgccctgaaaaaagattgaaatggtcatgattattaatcatcatcatttgatttctttggtgctattttactggcaggataacattaacaatataattggtgagataattatagatgctattatcaatgatttaagatttgaaatatatatcctatggttatcagcatatgcaaaatgtagctacaatataagtcaggattacttttctgggttccttgcgttttatttgggaccttttgtgttttacattcatgttcaattgatgatgtttgaagttttccatttccgtcgcagcaacttttattggggtgttgttgttgggggggggggggggttccaattttgttttatcttctatggaacattacaatgttatcagacaagctagttatttatgtcattcaggaagaagggttccgtatgatacgagaagctcttgcaaggtctgcaaatgcagcacatgctgaaatatcaggcaattcctcatctgggcaggagttggaattaggttaagcgagaagattaactacatattgttaacatgtgtccattgtttttgccatatggaggttggcaggttgcgcttctggtttttttaagtcatttctttgttaataatactggcattaaacaatgtgagtttcatcaattgtgtactttttacaacctaagattattttatttagttgtataattgatcatatttttttgctatccacatcagaaggtttattttcaacagaagaatacctgttccaactggtaaggtactgttatatgatgtcaaaaattgtgaccagctagagtaatctgaatgaaaaacataagcaaacttgttcttcacaattagcagatagagggatccaaaataaaatcataaaaacatgccatattacaaactatatatgctgatgatatctttgtgcattgtttatccaacttaggtaaggctgaattccattatcgacaatgagtaaactatgtttgtgcagacccatatccatccattgctcttgcactgcattcaaactgagtcactagtatgttttgtgaattgatacttgtttctcagaagaattgaaaggagatctatttttggttgggatggctctatatatttgttgatattctcgtcgtatgatctattagtctctcaaatgtgctgtgatgtggtgcagatccgcaaaggactggagagatatgctttcagtttgaagtggaagatatcatcaatttggtgagacatgaagcttgacgttttctcagcagccatgattgtcccatactctccacaatccttacaccagtctcaattatattgatttactaatgaacgtttatttctaaaaacaaattgcgtacagatatgctggcaagggtggcagcaatgcaaatacaggaggtatgctttttgtatgacagtttctgcttgttaacatatggtttgctattatgttcatcttaaagttaaaaaggtatatgatgcagacctgcaattttgacccacttacacatctctcacctctcaaatatcccatcaagtattgcttcgctagcttggctgtgttcccaactcatctccctcgttttccgcgtgtacacttttcaaactgctaaatggtatgcgttttgcgaaaaatttatataggaaagttgttttaaaaagtcatattaattccattcttcaagttttttatagctaatacttaattaatcacatgttaatctattgctccgtttttcgtgcggaggggaggggttcccaacccctccaagagaacagtgtgtttgaactctttgaagcacacctattttgcacttgataggagcgaagagtcaagagcttaccttttttttatatatataattcaagaaacaactgaattccgtgcattgatcttttacagttaattgtttcaacacactcccaaaaccacattaacgatgttatatttctctttgactgtttgtttcaagggttcatctaaattttctctatacctgtctgtgtaaattcatttatttccacattggcccatgcatctgaatactggtggagtgatgctgttgctttgtttgctcagcaagaggaggaagaggagggagacgagcaagacgaggcagatgatgacgtgtaaatgtcgtcaggtggttctgtttccttcgagctcctttgttagctctggaccggatttgtagtcagatgaatcgatcatagcatacataggaatatacgattggtatagccatcttcttattgtggttctctgtaactatcgattgaaccaccatattgcgtagtcaaaggaagaagtagagaaagagctgagcctgttagaagtagtaaaatactttgtacattgctgtacatgttggatcttggatttccctggttttgttacgtcgtggtagagggaggtccagtacttgcgggtatgttgtgaaaaacgttcatgtgtacccagaaacattgaggttttgagcttttttatctgctatagcctatacattggaattccttataatctgtttgttctgcttttacagggcgatgtctaattttctatgttcaccgtgagaaatgaacaatttctcataaaattcatgtgcttttatgtgtctcaaataattctcaaataatacgggaggaggagaaaacgtgcggaattggaaaatcatacgggagaataatttgttttgctgccaccaaatggaaatgtatacatattaaagggttaattggatatatgccattgcaactttgctaaattaaaaaaaataccaccactattcattatatcaactatatgacactggaaatttctaaaattggaaccatgccactcccgtcgctttttcatctcctctctcacgccatttcaggtcctgtcctagcacacgcacgcggaagctagggcacccgcggagcagggctgaggatgcgcgcgcggcgcttgtcggggataggagccgcggaggcggcggagccgcgccgggccggctgaggtggctgaggtgcgcggaggcgcgtggagccatggaggcggcggatgcgcgcatggccggtgggggcggcggggccacgcgggggcgggcggggctggtggaggcgcgtggggccggcagaggcggcagagtcgcgcgtgggctcgcgctcgtccaccggctcgtcgccaacggcgacccgcgctctaccccatggtcaaggagagcacgcagctctcctctgatgtcgccgtcgtgctcgccgtcctccttgaccgcttcttcgacatggagcaccgccaagcaaatcgacgacctcctcgccttctacggctggtgcgatgacgtcggcctcgcgcggtaggctgacttcgccgatgtcaagcgcatcaacgacagaaggcatccataggcggcgggctggacccgctgttgctactgctgcggcggcggagccgcgtgtagccgtggataggggatgaggacgggaatagagacggcgtgagcgagaaggacggaaaatatgactggagtggcatggttctaattttagaaaattttagtggcatgtagcatatatatcgaatagtagtgatattttttcaatttggcaaagttgcaatggcatagatctaattagcactattaattaacgtgaaattacttcctccattcattaatatatgatagttttaacactagtttaagtgtagttttagcatcgaaaaacgttgtctattaatgactgagggattataattcatttaaggaaaaaaaagttcattttgctcccctaaaagatttggcctttgtctcctaaataaattttcgactcattttacacctgagctattagcattattttttttactttatataagttgtattttgctataaagtttggtaggattggtagatgcattgtaaccttaccatttaatattttctcgaatttgttatcattgtttacgttggaagtatatgtaaaactatctctagcgcttccgcacattgtatggctatactcaaccttttgtccaaatagacgggaacattactgccatgtgggttctcgcaaagggttccattagagacatactcaaagaccataattggagcatttttctctgtacaacatccaattagcctaactacattcttatggttgacttggctgtggacaattacttctttggcaaactcttcttctgaatctatgcgggaatatcttttcaccgcaactgcagtgttatcatcaatgattccgttgtaaacttttccgaatgaaccatttccaaggctagtgctgtagttgctggtagttcttttgatctcatcttctgtaaaatactttatgttatgattattcttagctatccattttgccttgtcagctccttggataaaatctctaagcttattttctggaagacctagtttatcttccattttgtgatgtgaataattaaagatctttctttgaatgaaatgctgatcacctttcaccacagaaataagttgttaacatagcttgtacaagagcaactcatttatttcctgttgtagtataccttaatttgtgtcccattaccatattggatttgtttcacctgtatatttgatcatttttgtaatgcatcttagtagtgagctgtggttaggggtgtgagtaaatctcacaaaactaaagatatgttggtaaaattagcttacaacagtttaaagtgtgacaaaactagaggcttttttcttgaatttatcactaagccacagattttcaaggtgaaccagaaatgttttcttattctaatgagtggatcccacctgcagttgatagacaagctgatgacttctggtgttgcctttttttttctttcagaaaatggattaaaccagcctctacatccgaaatggatgtgcatggccattctggtaccctctagcatgcacagttttgatttatgaaaacagtacaagtaaaatggacaataagatgttatgggttaggattcatagggggtaaacaccatcgggaggatagccgggcggcgacggctgctagggatgagagggggacttaggttgggagagactaatcttgattcattgcttaattagaataacggtacaatctatccttatatagatggagggaggacccaatctaatcttatcgaaccgactctagctatccttatccctagggcctcgacccatcggcccactacttatgacaaatatgtaggagtaaaatgggatcctgttggctttaaatattcaaatcctaattttctagttactgaaatactgaagggagcagctagattatagatggtaacctgtaattgaatttacagttaagatccaatctatgctggcaggacatttgtgtaagtatttagtaagacaccctgttttgtgaaaactttccaacggtcgttgaaaacttataatctgtaatagtacttttattcttgtgaaaaaatgagaatacaactaaatcgagaaattatcagatactactatactagagaggaactctagaagtaggaaactaggaaagaaatcgagagagatgagttgataataccaggcctgaacagaacaactgaagggtcagccgagattcatccagcttcgcttcggctggtgctgatttgatttcaagctactattattttgccatggctgcttgcatcctagcttagcttgttcaagctaatgcttctcccatgaatgcatgatatgcaggcaaagcccaggatgatgagacgacgacgacgacactgccattgtatacaatacatgtctctgtcgggcagctggtgaacgaactcgacgaaagagtggagttggaattgactagcttgtcagcctacgcgcctgttgttctcatggtttacttctcgcactgtcgtagaaacatcgatacaaatctcttaattcatcgctgacggttgttagaattcacagtgatattggcaagttggcagctataaccaattagtacccccccttcttttttatccaaaaatgtaagcattttttttggagttaggtagtacagtactaagtaggatttaggtagtatatgcattattaaaaattttaaaagtaggtgtaattaaacaaggtaattttgtgattggttcataagagtagtcatagaaattacatttgagatacttatgattggttgaaataagaggctaggtgaaaaaataattacatttttggactaaatttaaattatcaccatcaatttaaattttaaattaaactagaaaaggtgcccgtgcgttgcaatggatgaagtctattttaattttattattgttatagcaacaggaaaaaaataaaattataataattactatatgattagatatagtttttataatatcagctctttaagaaaaatatattcttcaaatagacctagtaatcttatgtgcaattcataatttaccataataataataagaatataaaaaagtcttcaccctaaaaagtggaagaaaaatcataagatgaaaccaagaattgagcacaatctcataacggaaaatgaataagagtggagaattattgttttaagggtaactggagtctagtttaatttttcattatgaggacgatataaaaaaaacgtgcataacgtgtaacgaaagcacttcggtttttagtagtgtgtgatctccaactgctctttgttagacgaaaccaggcatagtcgggacggttacttcaatcctgagaccagtcattaaaacaaagagttatcatggtccaagaataaaaaagacgttttctcaaatattttatttagtgggatataggattagaaatattaatatcaacgttaacagaaagtcgagtcaatcttctgttagttattaatttctctatcgaacaattgagtatgatatcacagaagcatgagttctccttgaaagccaagcattattttgtgcattaaaatatttccggttaattatccgccttgcaccctcgctgattagtttttttttacggacccttgctgtttagttgctctggacggaaacggattcgatttacatggcggggttgtttgacgcgggaaacgctttgtagacgatatcagtacgaatcgaaaacggacgacgtacgaaaacttgtggcaaaaatatcttaaacttttacaataggtaaagatagttagaaatatctatattttatgatgggagggaataattatcaccatcagttcttattgttcatcaattcttattgttagtttccttgtagactctgatattgtcatcttggggccagcggactcgtaggacgccatcatctcggtccgtgtggcattggcaattggttatggtaaatgaagtggacatggtgtacatctctaccattataagtcatttatgtttgagtcggtttttaaaatttgttttattttggaaatataagtccgtgtttgagtcagattttaagtttgtttgtttttaaaaatacaaaagaagtcatataagaaatctatttaaaaaagctcgcatactaatttgagatgaaagtcgtactcctaattacagctcatgattatttttaaaaaaaattcaagcgaatttacagtcatatgttgaggaaagcctgcaattgtttcaggctttgggtattactatttactcactgactgcatcaaactaaaactgagtatgcatcgtaccgaacatagattgtttgtcaacaataaaatttcttaagaaaccaaacagtcatggtcaaaacgactatgactatcactacatgtagatggaggtaaaaaggggcagcctattgactacagtaactgcttttgctagtgagcctgagggtttaaaagatacatcacactaactctcagaaaatacataatagcacacctggttactggtgttccagattaaatacaaataaaagtaagttcagttctgaaaacgattacacacaacatggaaataataatcaagcagattgctctgacaggttactttgctcctcacgcattcctccaacagtttttaccttgcccctgctcctaggcctttagcatcactcattcttcttctgtaaatgtcgtcaattatatacatcacgcaagacatttctgaatgatgctgtagactacaataactacacaatagagagattcttgaaaaccagccttattgaaacatgacttacaataatttaaactcaccttcatcactactaggatagggcagattgtgcctataattaaaactcatcttcatcacaggttcacaactagagtatgacgcactatcatataaattggacgaactgggattgggtggttcatcgatgtcgatggtgccctgaagcatctcaacaaccttctgcatggagggtcgatggtctgcactgaattgcatacaccacaaggccgttttcaccatgtgctctgctgtggccatgcttctggcagaatcataggcctctgcctggataatgcatggatccaggcagtccacaattcgttgctttagataaacttcctgatagactatattgacgaagtcaaatgactttctgcccaccaactcctcccagaacatggtgtcacggataccaaagacgatatccagcagcagctgaccgaagctgtagacgtcagcctttgccgtgatgaatccccgagagaaaaataacctctctggtgccatatacatgtagttacctggtactacttcagtagtcatgatggtactctcattaataattataggtgttggcttggacaacttggagcagaagttaccatccaggagaatatcccacggcgtgatgctgccattcagtgtgtccagccacttctcgtgcaagcatgctatcgcgttcgccacccccaacgcaataaagtgacgtgtattcatatccaagagtgacctttcccctgtttcttcacccttctccacaactaggtaattgcaaagggcaccattgggcacatactcacacactgaaatcggatgatccatctccaggcaacaaccaaagagcttgacaatgttctgatgttgcacttgagattggatgatcagttgcaaaacaaactcctcacgagattcactcacgttagtgaaaaccttcactgccactctggtattgtcatcaatgtctcccaagtaaacatcgctgctagagcttttactcagagcagttgagaagttctgtgtgatattaagtatttcctcatttgtgtaaatccttatgttgtagatgtcttttagtatatgtccaccattcttcttaaagttattggttgcgccaatccagttgaaaatgccaagactcttcctcctatagagaaccgtgttggagttggaattgcttctttcatgctggttctcttttttcaaatcattctgacctccagaaaagaattgccaacctgtcttttcccccctagttcaagagttttcctgagctctcggagacgtgcagcgacatcattcatttctggacgtttatcaatgtcctcttttatgcaatcttttgctattttccaaataccctcaagaattttcatgttgctctcctttgcaatgtccacatcaaacaactcctttgcacccttccgtttttgaggagcttgaataaatcttctagtgacatttttctccatgtttgttggctttgtttttgtaatgagttcaataagaacaactccaaagctatacacatcactttttggtgtgaggcgcgcccctcccatgcaaatgttggatccatgtagccgatactccctcgcacattcacagttagatttgtgttatctgttgacagaatccttgatattccaaaatcagaatttgtgttatctgttgacagaatccttgatattccaaaatcagatatttttgcatgaaagttctcatccacaagaatattggacagcttaaaatcataatgaacaatgggattgtacatggagtgcatgcaccctaatgcttccgcacattgtataacaatgctcaatcttgtgcccaaagagattggagtatcaccacaataaagaagatcactcaagtttccattagcagcatactcaaatacaatcattggagcattgttgtctttacaacacccaaccagccttactacattcttatggttgacttgagtatgaacaattacctctttagcaaactcatctagtttatctactctgataaatttcttcacagctacgaaacggttatccccaataacccctttataaacctctccataagcaccctttccaagcttagtgctgtaattgtttgttattcttttgatatcatcttctgtgaagtaagttatgttgtgattgttgtccggtatccattttaccttgtcaacatctgggatataatctctaagaatgttttctgggaggtctattttgtctcccattgtatgttgatactgaacacaaaagagctctggctaggaatctgaaattccaataatatgatcttcttttctcttctttttttctaaaaggaacaatatgatctgacagactggaaacacacaaaagcaatttgttaaaatctacgtaaacctgtgaacatgatttagatcacagataatgttaaaacagtggcttcatcatgcatgttttggggagagtggatgaattttcctaaatttatcactaagctacaggttctcaaggttttgaagcaatagcttctgtcctgatgagtggccccattcgcagcttctgtcctgaattctgattttctgaaaatgatatagggaaatactttcataatacttatgtagacatgcaacaataatccttttggcatccagtttgcaggatgtaaaatgggatcctgttggctttgaatccttaatcctttgatactgaaagttgcagtcagactataggtagtttcttgtgttcattattctggttggacctaacctatgcatgatatttgtggaagtaggacagcctagtatttttctaaaaacttatcagtccgcatgtactaatccatgcgtaaacagatcctctgcagtatgtagtattgccctctaacttttagttgataacaggtaggccccatgaccagcaggcccacatgtcagtgatcccatgccaaagggcaatactgtagaggagactcatccaatccatgatgtattttattcttgtgaaaaaaaggtaatacaagttaagaaaccattagatctagagcagctccagaattaggcagctcgagagagggaaagaaagagtaaagatacgtgaagatcaatcgaggtgcagcttggcttgggcttgtgatgagatttgatttcaagctactctgccgtccaacgtgatggctatggctgctttgcaacctagcttaaatagcttgtactaccaactaattcctctaaaaaaaagaggtcattttcagccctcgtgccgctcagccctgggacggcacgggcggcgaccaccgagcgccaccgccaaccacttctcctcctcccctccgcctcgccgctgcccaagatggtggcggcagggctccttgcctcctctctcgggcatggcggctcggggcgctgccaagatggagggaggatcccaagtggtggtcgtcggcgaccagcttcgacgacggtggggacagatctgggcctctcatggccggatccggcgtcccaactagtgtgtaggcggaggtggtcgttgtgcgcatggagaaggccggcgacgcacggggaggaggtcgacgacgtgtcgggaaggccgcggcgatggtggccctcggcccgctgatggggatggccggttctggcgccccttggccagatccgccgcctggatgacgatggtgagctgccaatgcgaggtgggggccagcgtagcctcgcgcggcgcgggaatggctacgggaggtcagccaaggagggagtcgggcgcgcgtgacaaaggcgggggcctggtgctacgacggagggggcgggtgcgccattggcagttgcaggaggccctcgtcggtgtggagacaatggcagccacctgctgcgcccaccggcggttgtggtggcgacggtggcagcggtgcaacggcgtgtgggcgctcacggtgacgttggcttgccgtgcttcgatagtcagatccatggccgccttggccagatctggtcggtgcagcagaggtggcggcaggttggcagcacggccgactcgcgaggctgcctaagttgtgggtggtgggctaggcttggtggctaaagggacgatgtggcggttcggcaacgtacgttgtgcaggtgggttgtgtgtttttggatgacgcttgcgaaagccttggctggcctttggttggcttgacgacggcggcgccattaggcatcgttcccctccttggaggcgtcattatgtcgtctccctcactaccaagaaccttttccatgcaaggatggtcgttcatggaccccccatgtcgaagctctatgagcccagctatttggtgaggccttcatctcctgggtgccgctcttggatgtggcaagcgtccaactttctccgttttcttctaggtgaagtcggagctgatttattagggtgcgatgaagcttggcaatgataacacgttgcagttttcgagggaggttggtgttagctgtgcacaagtagtagtgctcaagtggcttgggctgatgttcaaagtggacagtcggtgtcttgctcgttttctgcgatgcctttgtcaacgatgatgtgatagctgtggagtcgaagctactgtgtcgctaggtgacaagctcggcaacgataacacttgcctcgcgaagtcgaagcctttgtgtcgctttcaataagctctttatcgatggttgttttgggctccgccattttttcttttttcgcggtgttggtagcttaggttagagtgttgtggttttcatccagttttccataattaactgcgcattgtaagttgcgcaaggtttagtctcgttttctacttaaaatgagacaccttcttctttatataaaacatcggaaatggcctcatcgttcgaaaaaaaaactaactcctctcgcatggttaattatgcagacacttgcagttccaggaagatgagacgacgctgcaatttgtgcactacaacacaaaattaataggagtatatgtatctatcgtgcaggaaaacagatggacaagagagtgggcttgactaattaacttcttctccacatactatacgcggcaacttgattaattaacttgacgtacgtccaatgattattagatcatatattccaccagtgtacgcgttcaaggctcacacgtgctcgtatatttcttttaatttgcttcaggattaaatcttgaacgagtcattgcgcaccatgcatcttagaacgggatgcacaaatttagatgatgctgctcagggctggtactatgattttgagggccctagacaaactcaatgatccctctaagctatatataaaattttatgatatatatatatctatctctatctcttctctaatacttaaaaaattttatgatatgatatatatatatatatatatatatatatatatatatatatctcttctctaatacttaaaaaataagaggtacttccatcgtccgttaataagtatttggttcggacaaaaaagtcatgtccgatttcagaaaaaaaattacgtgaaaactaaatccgttacatgaaaacaaaatcccgtcggtttccagggaaaaaaaaacaaaattgctgttgggccatacctacagaatgcctattgggccatacaatcagtttgagatttcctgtagcccaaactaatatgttttagcccaaagccatatttactaatatgtttcagcccaaagccatattttagcccaataggacttggccactattacaaaaaatgaaatgaagatgtttccgttggaattttggtacgtcattcatattttagttggttttctaattttcatgttatccgtatgtgagttagttttctaatccatcaaatccttgtcattcgtaattgtacgtctggcatcatcatcacgtcagtcgtatgttagttgcagtctgtttcacacatgcaagtccctttttcatacgacaattgcgtgcgacatgtgtgtgccttttttttatccgagatgcacgtgctcgagttcctttttcatgtgccccttgccgcgcgccgtgattggacctgtgacggctcgcgcgatttgtttcctctgcggtgcagccattgggcccacagttgcataaaattgtatcaaattctctatactgcacattttttacgcatcaacatgatctctgtttcccattttatatatacgtaataagtagccagtgtaaccagtttgtctcacttgggaaaccgaaaactcttgaagtgactaaaactcttcaagtgcactagaaattgatgtatgtacctaaaaaaatataaaaagattgaaagttttgtttctcatgcgcataatcggcttattaggctagaaaatcagttttttttaatctctaacaaaatcccattccctctcgctctagcatatgtcacctcccttgctaagttgctgtagaataaccacactatctctccttccacattgccatcttactaggttgtttgatgatcatgcctctctatctatatactcaactttttcgtattttcttcctgttgcaacgcacgagcactttatgtatatatatatatatatatatatatatatgtatatgtatatacgtacatgtatacatacatatatatacatatatacctacatatatacatacgtacatacatacgtatacacacacacacacacacacacacacacacacacacacacacacacacacacacatatatatatatatatatatatatatatatatatatatatatatatatatatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcccaatccataattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcatataaaccatgtagcaacagggccatgccaaaaaaaaaaggtcagctcgatctttagtcccggttggcaagccgggtaacaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctagcctaaaaatttatcctaaaagagtgtaattaaatttgtctgtaaaatagtttagttatagagtggttcattaggcctctttaatattagattattttttttcgtttttagctattgtaagtcattgaacagatgtagggagtactttgacaccagaagtttttttttaggtatttttgtttaatttggtgagtgtgcgtgtatgcatcctccgacctcaaccacacttcagtcatatttcacgcagaattatgagcccagattggcttattatggcctcgatcgaagaaaagaaaagctcaaataaaattttaattacaattgcgtgctcctacgtgaacctcgtgatactgtagtaatataatccaatatagtatttgctgtgtttcattttatttcttcagaccgatggtcccgttatgccggccagccaatgcttatactgtattcttcatttcctcctttaagagttgtccacatgaccgaatggactgtcctgtgatcgaacaagacgacatcaacctcaggttcatccgcattggatttgaagtttgtatgttatgtattaaaggtttaaaattttatattttatttaaaatagaaacaaaatttttaatctaaatgtttcaaagatttagattatggatttgtagagatggaaatatttagtttaaaagaaatttcgaaaacggagttgtgccaatcagagtacttaaaacaataagttcactttaggtctctcaatttgtcgttgaatccgaacttcgtccctaaaccgaaatatcccatcccggcatcttccaacgaacaataccatgtaaattttggtctctcagcagtttaattgccgattttggttgacgtggcgagtgggacccatgtgggtcctacatgttagtggccaattcttctccctcttctccatcttctcttgaggacatgaaggaggggaggttgacggcttcgccgacggagcggtactgatcagactcggtggaagaggcactggacgagctctcggggagatgcctcctcactgacccagccatgccgggccaccccatcgtttacgcctccaagagcctcatcttgctcacagggtactcacctagggaggtgcttggccgcaacacgagactattctagggtgcgaacacccaccatgttgtcgtgcccagggtatgggaggccatgcagggtgcacacatcagaggaagacaagcatgattgtagtgtcgagcataaacagccagtagcacatgcccggagacgggcgttgagccagccccacccttgcagtaccggcgccatgccgcacgcgtgtgccagcacaggcggcctctgggtagcaacaccaatatgtgaccccgtcagcgccgcagaccgggtccaggcggaagcgtcgcacggggcacagcggggccttgttccccctgtctgacacggggtatgtagcctagtgattggagacctcggcctccgagcccgtgcggatgaggccagggtttgggtgaaaggagtgagagggccgcgaggaagaggacaagccgccgaagcggggcggtgggggtgtagaagggtggcatggtgacgaagacagtgtcgccgacgactgattgtcgccaacgaaaggcttggaggggatcatgatgccggcctttgtagtggtgggtgaaggaaaggggagggtgcgacgatggttaggtttggaagttaacaacacagtggtggaacgggtcgacgtttagagaggaataagagttggccactggtatgtgaggcctacgtgggtcccacactccacatcagtcaaaaccgacaactatactaccgagaggccaaagttaacacggtattttgagttgggggttgtgctatattagttatttcggttcagggacgaatttcagactcggcgacaattaaatcgaaagacataaattgaacttattcccttattaaaaaaagaattgaagaagaggagctagggcctagggatatgggtcggctactgtgggcctaatgggccggtatttaaatacggatggcaatgatatgttgccttctcaaaatcaagtgaggccggccaattagtacttgctagcgacaggcctgctaaggtaagaggcccaaacttagtccaatccacgttctagcaaaggaataagttcaccagccattcctcaactttacaccgagtttatttgacatctcttatcctcgataccagaaatctctaccattaaactatacgaaaccgtgcaatttaggtcccatagcagtatagatgtccggtttcgctaacgtgtcatcctagttagaaaaaaaagtaaatgccactttggtccatgtatatttaccaaagtggcaacttgcaccagggcaaagtctaagttttcatatcacaccatctttttttaccatcctttacagattgcaccagggtttaccgtttaattgggcgaccaagctaatctttggcccaatccgcgtgaacaatagcgttttggctcgtgcggcggcgacgagtcacgcgcctcgacagtgatggggatcgacgacatgcatctctcgacgtcgatgacgcctccgcaagtccacatacatcgaccgaccgccccgccacaccatcgtgtaggattaaacatggtgggattcacgaagcagccaccgtcggtcgctgctgaagatcatcgacggcgacgagagccagttgtttgcttcgctgcagcagtatgcggcgccgctgatccgggtgagccccgagtgcagcgtcgtcgtcaaggatagcgagagccgagagctcgttgccgccaccgtctgaaggtagcagataaacaagcatgcatccatcaagtgggtagctaattaacaagataatgcctgtagactttagtgatggagctataccctatacctcgtaatagacacgccttgtgatcatcatcacgacgaggtccagcagcctgggcgtgtccgacggtgcagcatatcatgtctggcaccgtccgcagcagcggcggcaagaggggtctcctccggcgccatgggcggataagctactgacctccggcgccggatgctagcttggccctccaacagcgatgctgtactgcaggccggggggagcactctcgctatacgcgaaggcgttgtcgatgtcgagcgagccctcacgtcattgctgtcgctgctctccatcactaccgaaaacgaatctaaatgtatctatatgcatgggacatttatcatggccatatccgggcgcgatatatactgcgggttgatgtcatatattcgtggtgcgtagcaggcgaaaagatctgtccgatatacaagaatctatttaatctatgacaaaaaaaattcgtcatagatccctgaaaattcgtcacataaatttgtccgtgacgattctacttatcgtcatccattgagagtcacagattaaatctgccgacgttttctctgaaatcgtcacggatcagcacaatctatgatgtttttttaaccgtcataaacacttttgggctcatgtagtccagccccggcccaacctttgtgacaaaattaaacgtcacagatagttgagacatggcggccaacatggcagatgacgtggtcgttgacacatgtgtgatgacatgtcactgatgacgtggcaggtaacgtcaacaaatatttttaaacggcccattatttttttgacggcccattaatttttttgacagcccattaattttccagtgtaaaatttggtatctcagtacctccacgttagaaggtaccaaaatttacactaaaaatattagtacctcctggtacctgtaaaagaccttacaaacttcaaatctaccatggattttggatttgaagctgtgctaaatggaaccataatttcttaatgaggttgaagatgaagattaagtgttttatgcaaaacgatgttgtaataacgtatggttaattgagttttaattattccaaacttgaaaatagattaatctgatattttagaacaacttttatatagaaagttttcacacgaaacataccgtttagcagtttgaaaagcgtgtcacgagtatccaaaattcaatccaacttttgttggagaaaagaacatggcctaagggcaagatattgcaaagcacatgggacagatgaatcaaccagggtgatcacataattaataagcatataaaataccccaatttatcgatcaatatatcttgataaaaggtcataaaaaacacaccccatcaagaacttttcactaattccagtgaatattactactatgtaaacccttaattagccttaggccttagccattaccaagatgggtttacttaattgcctcacaacccctcaaaatgatagaaaataaattcaagaaaaaatacacactttttttttcaccatttcttccatccaaagaaaaaaaagtcttggagaaagaaatggaaaaatagagagacaccagaaattaaaaacatgaataatagtaaaaaccaccaccgccggcaaatctcgcatgcataaatatcggtgcgaatgaggcggcggcggcggcggcggtcaacgccggcgtggacgtccttccctcgccgacggcgttctacacggcgcaggaggcggcggcctttgcggcggcggccctgacgagggagaaggtgggcagcggcaggctgctgggcggcggcgccagcgcgtgcaggaggtcctccacgaacccccgcgtcacctcccgctccaggtcgtcgagcgcctccgccaccgccgccggcggcgggagcggcgccggcctctccagcgggctcctccgctgcggcgcccttgcctgcccctcccccgacctcggcgtcctcggcttcttaatcctcctcctcacaaccgtggctgacggcggcagaggcggcagcatgcgaggcagnagacgcgtcgccgtcgccgnaccnggcnccnccnccgccgccgcgtagtaggtgtaaggcaggtgtagtgggagagagagcgaggagtacagcgacgccgcctcgtaagtcgtgtactgaaacggaggaggagatggagcagcaaaagtgaagctgccctggatgcttctacgaggcggtggcggcggcgccacggcgagccgccggccgaagtagtcgtcgaagccgccgccggtgacttggccgatgaggaggacgttctccatcgatggatggatcgatctgaagccaagaaatcaagaggcaaagctagttgtggaaactctgcatcaagaacgtgttgatatgatcacttgatgatgaacagagcaaaaacacttgcaaaaaagaagaaaaaattgcaggagaggagatcaaaggatgtggattgtttgatcaaaataaaaggtgattattagtgatggaaatttctcaaactttgatctgatggaaaggcgctagagaggaagagagaagagtagggtaattaaaaaggcagaggggaatttaattagtagctaattaattaagaagctgctaattaacccgcctctcacaggcctccggggcaagggcaagggctcgggctcggaggaggtgatgcctttgctgcctatttatgtagagatcttagaggagggtggtacagttgactttccaagtcgacatcttgcttaattttatgctaatttattggtattagcaagtgctttgcacatgtgattctctaatcccaagttgttattcttttcttctgcacccgctgtactagcctaattattttttgacgcatcaatggcataggttcattaggaattcttctcttcaaaactaattatttaaagatattttttcgataaacacactacaaatgcggacactaaaaagttctgctcttcaaaattaattatattgatgaactaaaactgcagaacggtttttttttacgcaaattaacagatatattgtttctaaggaaacagctggagtctcttaaactcgagatggtttgattacacatatatttaggtgaaaagaaagccatgatatgatagacatcatgattaatatcatgcaaacaaattcacttgtaaatttatattaatatctttattttcaaataattgttaattttgcatatggccagctcactttgaccacaaattacttccatatgattatattataatgaattaaaattgtttggctagatttgtttacgacaccacatacttcaatagtacgacatattctaagcacatgaagtttttttttttgggaaaatattaaagttttaacttgaatagcgaatattgattatttgagatcggagatgatattattttacaagataaaaaataggaaaataaaatctaatccaaatgcacaaatttgagtaatcaaatgaagaaaaacattcatgggtctccatgcagaaacaacttgtcccaacttgcagcagttgcacatatacatattctccattttttccgatcaaaaaaccaataagagcaccgaccaagtacggcctgtcatcacgtcaccctctggacccgaccgcccatgaccaccatccaacccccaatcatatgatcgcacgacagcgacgccgccactgacagtgggacccacataacccgatggccccacatggaattgacacgggtggctcaaccacgccgcgatctctcgtgtggctgccgcgatttcccgggcgtggcgggaatctctctctctctcgctgcgggcatgtgcgaggcgaccaaccgccaaagcgatggtggccgtcggatcggggatcgaggcacatctggccgtccgttgctgcgtctggcactgctccccacatgctgcccgtattcgtctacttgtccttttcttttagattttgtcgagctgctgtctaggtcaccacccggtcattgtacatgtacatcaatatcttaactagccagattaataataattgtgcgtttttgctatatattcttaaataaaatagttttacagaattacggtatttaagaaagtacctggatatatactcaggtaccctaaaatttgtcttttaagtaacacaccgtggtgattttgccacaataaaacgcttttttattcaattgagactcactatgttgtccaaccgttattaccaaacactttttatatttaaactttgaccacttagattttttaaaagattataaatacttaaaaagcttccatttcaatcaccatagtctaactatggtcgaagtttaaaaatgcttgtcaacaacgtttttgccggggttacgactatatcacagctaaccagaatagtccaacaagcataaagataggagcggctgcagccctcgtctgccgaacaggcccaatatttctgaacatgtggaattataatttgtaggttttatatttaaaaaaattactcttaggtttttagattattgaacatgcttgctatatttatccttttttctaaaacagtattcctgatgtaattaacactagtgcacacgcgcatatatgcatccagtgcattttttttaaccagtgagatgcgcagtggaccggatcgatccgtacgtaggattggcgaagacggaaaaggatgaaatataattctccctccgtttcaaaatgtttgacaccgttgacattttaggacatgtttaaccgttcgtcttattcaaaaacttttgtgaaatatgtaaaattatatgcctacataaaaatatatttaacaatgaatcaaatgataggaaaagaattaataactacttaaattttttgaataaaacgaacggtcaaacatgtactaaaaagtcaacggcgtcagacatttcgaaacggaggtagtagtaatttgttcatcattagtggtggtgagcacgtgtactgcacatgaagattcggcaagcaccgaccatgtccaaattaaccgaaagaagaacgatcgatctatacatgcatgcatatataataaaagaaaagaaaagaagaaaacgaaggaagaagaatctcacgcgctcttagcttagctaacgatggtcgatgcgccggcccgatcgtacggcgcccgtacttcatctcacaaaatgtcaatcgcacgatcggagcaggttaatcgaactcgttcaggatttaggccccgtatgattgaaatttttatctcggtttctcttagtactactaaatggtgtcgtgcgaaaacttataagttactttaaaatacgaaataaatatactttttaagtttgtactacctctggctctgtcccatagtaattgtatttctaggatttgaatttgttttaaaataattatcacaatagagtactaatggtcctattaatcacttattgtccaactttctttctcttttacccttaactatcattccacttttaactttacatcatttaataaggagcattataatctttcttctcaaccttaatatatgctaaacaacctacaaatacaatttatatgggatggaggtagtaataattaaaactcaattaatgatacgctaatgatttttttttcgtgccttaacttcattaccatctttattagaaatgaacacgggatggttgacattaatgaagattaagattaagtaagggcacacaaaacaagaaaatcattatatcaatattaattatttttaattattacaaacttaaaaatgtattgatattttagagcaagttttatactataaaaagttttcgcactaacacacgttctaaaagtttgaaaattaactatgctaatgaaaactgaggtagaatcggtatcctaatcagtaataaataaataggcctagtagccggccacttgctaaattgtttatacaatattatgagtatatattattgataagtgtagtggtggaatcctgacctagcatacaagggttatatatcctattctaacggtgaaaataactgtgcgagtttacagttggcgtgtagagacaacaattatttttaaactttttaattaactaagctatgtaatttttttaatatataggtatgtttctaagatgtggtttgcctattcttattttaatttgttagatatatatggagccattaggcctgccaccactgtaccgaggcctgtcgcagccggtggcatggttgagggctggaggctagctagggcggtcagatcccgatggcacgagctcatggcagtggtggtagcaataccgttgcactgactggggtggtgtttgtgtaggggtctacggcgctgtcactggctaggagagagtgttggccgggtggagcagatggacatgagaccgtgcagtgctggggaggagatggggatcggtggtctctctaaggacatggaggtgatgttaggagaatgcagctaggatgggacttatacacatcaaccgttgatttttattatatcacctatttttcaccacaagttcaaaagaagaccatctacaaaaatagctaaataggagctctcttataggaaactgtatgtaaaaatcatgtttttcataggaggtcacctaagaaaagcacataaaaaataaccttattttcacatgcatttcacatgcagttctcttatacaacaattagtcagaatcaaatttctcgagtgttttaaaagcataggaccaccttgtaagtattattagtggaatttcttaacccatcctgtaaaattaaaacaagggtgtctacaaaaattactttttactactaatatatttttatctctattagctagtgatattttattgtcactactgcaaaaattgacaacgacgaccttccaaacgaaccgccaagttgagccaaactcacccgtggcttgcagctccctcttagtcgctctctcgctatctgcccttatgtgttgccctcaatctcgccacctccatcatctctctctcgagcttaattagggttactagatcaatctaggcctctcatatagtacgacagcacagtcggtgccggcttctagctccgtgcggctataactaatttggactacgactagcaacataatttgggtcaacggtcaaactaatgccttcatgcaccggccgtggcctgcttacggtttatacatacgtgattttagtcagtcgatcattcgaaagcagattctggaaaatcgtctagtcaaaaagctagctgcaagctagcctgcaaatcgcgttcacaattttggacatgaatttccgaaattttgggtctactaataatgggtcgtggaagcgactcgtgtaaagtatgtgtgttattttaattttttatttttctgaatttagcaaaaacttgctcaaattgtagtttatttgaatttgtagatattcggattttccatctcctgaattatttgtgcttacccatcaaaagtggtaggtacgtaatttaattaggcatgttggtggccaccgcccatttgaacacgtccacatatcggctcctatgtacacgtccggccttccagacttccagtgcaacggatggtacgctgataaaagctagctaaccggcacagctagcaagcacactagttcttgacaccgaatactatcaggtagtgtttgcttggtgggatgggatgggacgggacgggacgggacgaatctatttttagaggtgtttggtttagaggtgagtgggatgggttggtccctagagaggaatattcctctcaaatccgggaccaaagccatccggaaaaatctggcggacgaactcgtctcacctaggatgagtgcacggcgtgaggcgccgcttcgccccgctcgcttgctcgcgtcgtgctctgctcctctgcccatcgtgcttgctcgcttgacgacgacggcgtgctcaagcgacggccacggcggatccggtggtggggaaggcggcagcggcgaatccggaggcgagctcgggcgacggctgcgaatccagtggtggggagggcagtggcggtgaatccggaggcggggagggcgacggcggcgaatccagcggtggcggcggcgaatccaaaggtggggagggcggggatggctcggtggcagcggcgaatccggaggcgggctcgggcgacggcgacagatccggtggtggggagggcggcggtggaggggaaggcggcggcgatggcgacggcgggcgagggtgagtgctgcggccaccacccacgtccacatcgtcggtgtctctaatgtcagcgccacttctccttccgcctgcgccactggtcgccgctccttcttacgctcacgccgccggttgccgctcatccttctgccgctccgctccttttttttgctgggagtaacgtggtgctaacgtcactccctacaacgaatttacttctaatgttgtaataacttacttccattttgtgctaagttattcttatgatttatgtaaattaattttatactttattgaatttacattcataaatgtatttacttaaaaatcttctctacactctgcttgtgaattttctctacatagttgtcaggattatggataccacatacctaatagtagttgactaaatcttggcaggatccactacataccatgtcttatacagaaactgacctcaagggagttccggataaggaaagacaaccagagttctacatggaaacgacaaggactacttggactgtatccatattggtttccctagttctacttagacaaggggacacctatgggtataaatacaagccccctaggaggacagggggacaaccatgacgagacgatcaacacccaccatgggacagagaaccaccatgaaagacacccatgacaattaacatatgcccaccagaagccacaacatacaagccaacatacgccaagacaagccgccggatatcgacatcagagatacgcctggatcgaccctatccggtaccttcagaggccggccgtagggatctagcattgaatctgattccatcgggtgcgagctcgaggaggaaggctaccctgttgtcgactatgagtcagatcatcagaccgctatgtcgacaacagttagataggctaccctacatattgtactagtgtgattatggtgaataaaaagcaacatcggctccagccaacaggatgtagggctattacctgatagctcaggggtccgaacctgtataaaaatcctcgtctccatctcttttaccttagtctcgcgtataccctagcaccgatgatccccatactgtccaaataccgtagtcgagacatcaaacgtcgacagtggcgcgccaggtagggggattttggtgcttcaggatttcgacgagatgggttcaaaagatggattctccgacaacaagctactcgacgaattcagctgagggagagatccaacctaaccagatcagaaccatcatcatcatcgacaacttggtctattgagatcatccaagcctcaagccccgcggcgtaccaaaagatgtcagattgcatgatatcaaacgagtacgcaacaaggtaattggtagattggttttttaaattgatctactaatttcgtaaatacatctggcatgtatctacaaaggtacgcaatattttatctgcaatttatcatacctattcagatcatacagtattgtcagatctataatttattatgtatacccagagcatgttctttatacaataatatctgttgcgcgggtgtccccgatgttaaattgactacgatctaacactgggggctcgctctgtcttcttctgtataaatcatgcttgtttacggtttacataatgccctgacatttacatctgctcgttatgtcctgataatactagaagatccatgcagttttttgagtacatactcgatattatctgctatatgtcttgccttctagaaaatatttttcaggaacaattgagcactcgagtaggttgtggtcgagtacgctctattatcaagaacattcttgacaaatgcggagttatcgcacccaacctaccaacgaagaccggcgacctatctcatagcatcggccatggctggactactcgagaaaaggttgttaacggataattcctcgcgaacgccgtcggcttgatcacccgacatgattgcgaacggacatccggatatgctaccagttgggtgtgtgagtcatgctggccacatgagacacacatgtaataaaccaactctagcacctccattggtattcgagagataattctacatgctcgcttgtcctcgaaccagtacgtagcaatctctcgcaccgcagcttccattggtgttcgagagataattctactcgtccgctggtcctcgaactagtacgtagcaatctcttgcaccgcaacctcagatggtcgaggtacgactatagcaataacgcagcggtccttgcaccacgacttcaaatgatcgagagacacctactcactggttctcaaccagtcaatcgtagcgatctctcgtacaattacttctagtggtcgagttagcgtttctcccactatctccatttcaagtggtcgagttacgactactgcctggtgctcgaccagcgatgtagtgtttctcccactacttccactttaagtggtcgagttacgactactgcctggtccttgaccagcggtgtagcgattctcctactacctctacttcaacaaagttgatatcaggtatacaatatcgccaagtgttttacccagaaatcccttaccacgacgacacctagtgttgaaacctatcctactgtccctttacgccatcttgacaaggccttcgaggaacctaagagaactttggctggggacgcccagagccgataaggccttgtcggatcctgtagagacaaaagaccatgtaagatctggtcgtgtaagagttctcactgtgcgtattaaccaggccatgtaatcggaaattgagttttccaacttcacggctgggggctaggattagtgcttgttcaaccaaggcaggtcaagggtccaagagccttatcctccgagaacgattctccgacgacaaggctgggggctagggagagtgtatgactctacaaactgactgatcggagtcggtaagagagaagacgctcatatacaaaacattggtctgtaaatttaattcatttacagttttccatacatattataacatgtcaccctttgagcattcgctcgggggctatttctatttgatattcttttctgagtattgatttcaggaaaattctattcgacattgacgaagactccatgtctctatggttctacacctagatcgactaaggcgagtacgacaaatgttgacaaagctccgtcgcacactctacgccttctcgatcgctcgagaacggttgctggatttcgacaaggaatacgaaatgaagagatggtgtacccgccgagataaaatttcttgacttcaatccaaattctcgattacagcaagacgtgagatttagtcgtacgctctatactttctcggtcgacatcagagattgacttagacaaaccctttcggtgcccgcacgaggctgataaaggaagtctaacgttatctctagactcaccgagaatggtcacgtgagctcaataacagttcctccgaagtctgcggttgagaatatgaactcgttcatttgcattgaagtcgggggctactgtcagggttatagataccacatacctaatagtagttgactaaatctcggcaggatcgaccacataccatgtcttatacggaaactgacctcgagggagttccggataaggaaagacaaccagaattctacatggaaacgacaaggactactcggattgtatctatattggtttccctagttctacttagacaaggggacacctatgggtataaatacaagcccctctaggaggacagggggacaaccatgatgagacgatcaacacgatcaacacccaccatgggacaaagaaccaccatagaagacacccatgacaatcaatatacgcccactagaagccacaacatacaagccaaaatacgccaagacaagccaccggatatcgacatcagagatacgcctggatcgaccctatccggtaccttcagaggccggccgtagggatctaacactgtctctgattcagtcgggcgcgagctcgaggaggaaggctaccctgttgtcgactacgagtcagatcgtcagaccgctatgtcgacaacagttagataggctaccccacatattgtactgatgtgattatggtgaataaaaagcaacatcggctccggccaacaggatgtagggctattacctgatagctcaagggcccgaacctgtataagaatcctcgtctctatctcttttacctcagtctcgcgtataccctagtatcgacgatccccatactgtccaaataccgtagtcgagacatcaaacgtcgacaatagttttttttatttcaacttagtcataacgtaattatttctactgttatagagagttagttctagtgcatagctaagttacttcttcaattttaataagttacttttaaattaataaaaatgtttgaatatattcaacatagatcttgttttgtcatatattttacgtagaatacaatgatacaaataaatcttgaaaataatatacaatttaaaagatataagtcattaaagagattaaaaaaaagacatgcatcataggctaaaggggtttaaacattccatatgcatatcttgtttattagttcctacttaattagtatacccttgttccctcaatagatagatggagtgatgagagctagaatatatagcatacaaaattgtgtacaaataaataattattgcgagctgaaaaagggaaaaataaaggaaaaaaagctagctagatgatcgatcgagagccggccagtaggtaggtggctagctatagaaatcggaggtaacgtttgatgacttcatcgaccatgagcttgtaggccctctccgtggggtggtagctgtcgaagaacacgtactgcggtgggtcgttgcacagcgggctcgcgaagttgcagagcacgctggctgccaacccgatgtatccacagcacgcatccttcccgttcttgaacccttcatttttcattagtgaattttatagtatgaaatagaaggaataaatggtaacaaaaataacaaataaaacttaaattagtatacatatacttgcagttaagtttgttatttttttacaactaatacgtagaagttaaatttgaacttccatgtttgtggagtgatatactacatattaatttatcttgtaaatttttttaaaaaaatttaaaaaatttattcataactatttgattgacatgtaataaacaggtggacgtccactcgggtaattaaaaatcgtctccaaagtttgagtgctatccgtgtggatgcaaaaagtgcatcatgatgttagaatagattatggatcgttcgtcgtacctagggcttggtatcggtgcatgacgtcggctaggatgttgtagaggtcgacgaggacgatcttgacgccggcgagcttcgcgttgagccggccgatctcctgcccgagcttgcggttgtacagcagcgccacctggttgcggggggtggcgcactgccgccgcacgccgccggcgatgatccgctgcgccgggacgcacccgacgggcggcgcgccgacgacgacgagcaggcgcgccccgcgggcgacgagcccgcggacggcggcgaccgcccgcgccgccatgaagtcggcgtactccggctccgtcatgccgtcggagacggtgaagtgctggatgacgtcgttggtgccccagcagaggaggtagagcgcccggtcggggacggcggcgccggcgaggcgggccttgtactcgtcgaacagctgcagctgccgctccaccgtgagcggcgtcatcatggtccggcaggtggcgttgtcgtagccgctccccgccgacgcgaagctcacgccggtcttcagctcctccgtgctcaggctcttgttcaggtacggcggcaccatctccttcacccccagcgctgacgctgctcgccattgttggatccatacatgcatgcaaatgatcgaattaacatgtatagaatttatttggcacatggttcggggtgtgtcctctggagcacatccttccacgatagccagttgtaggtatcgatgaaaaactttataacattttctttctatcttaataacatttggataaccttcttctgtcatcccggcaaagaaagtgacaacaatatcatctagacgaattacatgtactataaaattgatattttaaaactattttgaggacgagatcttaccatatatactctctgttttcaagagttgagtcgaaatatcccaagaaatatcagtggtcaaagtttaacgcattttttaaggggaagtttaaaccaattgactgcacgcatttaaaaaatcatccattttgtaacagggacatgtaaagccgtaaaaatatgaattaagataaaaaaatattatggataaaacttttatatctatgttatacacggtttaaaaataaatacttcaaaataaaatacatgaaaaacccaaatcaacactaaaattaaatacttacatttaaattttcgcaacgcaaagagcctccgagttgttactgtccctaggacatcgcagctaagctctcgcgtcgccctccccacgggcgacacgagaggagacgctgccgccgtcttcttcctcctcccctcctccatctttgcctcgccgccgcttgagcgggcgccggcaaagccgcacgcccgcggggatggcggcggcggggcttcgcccattaagcactcgggtggcccgggagctggcacggcggcgatggtggcaaacgtccggatccgcgcccgcccggccggatccggcggggacgcagttggcggcggggcggagtggtggcggcggcatctggcggtgtgtggtggcggcggacagggctggcggcggtggaaacccgctcagatccacgccgttttggccggatcttgcggggctgacgccgagcgacggcgggcggcggggaagcgggcgtgctggtggcggggaagaggcggtggcggggaagaggcggtggcggcgacggttgcgcgggcggcgcagctggccgcgggtgaggccgggcgcgggcggcgcggccgggcgcgtcgg

SEQ ID NO: 22394 - DNA, 23487 bp, Oryza sativa
gcacggggcgacgccgacggcgtggagttcatggcgacggtggcagcagcagcttggtcgtcggcgacagcacggtggctggtcgatggcattgccggctgtcggctgcggtggctttggggttctcatggcagaggcagcggcgcggagctcgttgtgacagttgcggtagcggctggacgacggtgatggggctgcggctagccggcggcgaggtggccgtcggcacagtggctgcagtggtggtgggaggtggcatggtggcctcggtgggctagccgagggcgtggcagacggctgcatttcgccagcgtgggagagtacggtggagaggtcggagaccggcttggcgcagagaggcgcagccaatggcagcggaggccggctcggcgcgagaggcgcggccgatggagggaggacagattggcgtaaaaggtgcgtctggtgaaggaggtcggtttggcgcgagaggcgcggccggcggtggaggaggcgaccctggtgcgaggaggagctgctggtgggtgtggcgcagtcttcggcgcacgaaggttgcccggcagggggcgccggtgcgggggtcccacatgtcggcagaggatgagtggtggtggagcatcggtgcgtcagccgtgaattcgcaggtggtgaacggcgggtgaaaacccagcccggctttggctgggccgacaacgatggttaattccccctcctgagggcgttgtcgtgttgtctcacccctcaagggcggttgccgggtgaaagcccagtcttggttcctttgagccccgacggacggcggcggcggttttccgtcactcctctttttggagacgtcgtttttggcacccccttgcgtagggcgatctcgtctgtgttcctttgttggtctagcggcggccggtccggtgctagcctcctcctggtcgtgtgtgttggcgttgtcggtttgtggggggatgtatattttttcctttttcctgattatgacccttcagggttgtaatcttgtaattttttcctgatttatcaatagaacttcgcaccgtcttgtgcgagtcgttaaaaaaaaatcgcaacggcttttataagttaaaagaaaaacgatgaaaagatagatctagaaattagtaaattcaaaaggaataaatgacaaacagttacgaacgaaccgaggaggtcgatgctgatcttgccgtcggagaacctgccggtggccttgccgccggggaagtctcggccgtagggagggaagttggagcggacgatggtcgggaggtagttgttgttgcccgtgtccacgatcgagtcgccgaacgccagcaccgccggcaccttcgccgccgacgtccccggagccggcggcgctcccagaatggcctccaccgccaccgctccggcgagtacgagcacgagcaggtaggagattatcacggtggccatggctggtaatgacagtactgatgaactgatcagaaatattcagatcgtgggttttacagcttaatgatgagtgatctgatcacaactctcagtgagtggagaggctttgtccaggtgagtagaggtagttgcatgcaaacgcaagagacccggccaatctgcacatttctgtgtcttttcgttttagagtatttgagttactatctccgttccatgttacttgtcgttttgatttttttcttgttttatcattcgttttatttaaaaagttagtgtaaatgtaaaagaggataagttatacttaaagtatatttgataataaaacaagttatagacaaaataaataataattcaatttttttgttaataagaaaaaatcaaacattagaaaaaaattcaaaggggcaaataatatgaaccgaggttaggcatcgctcaccaacccataaatagccataaaattcataagtacagatctaggctagacatgagacaaccaatcgttgtttaatcttccaatttcactattatgcaccccttcgtcctgagcacttgaccgtttatttttgttacttttcgcttgacactcatccccttccttgtgtaagggtgtgtttagttcacgtcaaaattaaaagtttcattaaaattgaaacgatgtgatggaattatgtgtgtagaaaatttttttatgtgacggaaatgtaggatcgaatcacaataactaagccaaccagagggggtgaatggttggtatacccaaaaaccgaaaacttttagcggaaataaaagttaccctcgaaatcgacggatcgcagttgtcctgccggtctgaccacctggttgccatcggtctgaccgagattagatctccggtctaaccgccgagatcagctgccgctcgctgtcgcggccaccggtctgaccgcctcgccaccaccggtatatcgccagttagaccgccgaaacccgatgaaacataaatcgaagaactcttaaagtggatgacgactttattgattttctctgtgtttacaaagtgcaccaacagcactccttacaaaaatttcgactaaactcaaaaccctaactcaaaactctactcaattgctctcaaaagcgataccgggaagcctcacgctccctctctatttatatccgaggtagtcagcctaaagccacgaaccaaactcatactagaagtcctaaacaccttaggaaaccctttagtacaaaaaaacaaactttacataaccaatcgtaccaaatttagactccttgcaaattcgactccgcatcccatacgcacacaatacctccatcgtatgccatatggaatcttcaccaaccacgtacatcaactctagcctaagtatcccgcatgatctctgaccaccatggacgtcgtcttatccccaagccgactcctggtccatcaccgcaaatactctcccgaggcatcaagtcacctacacatgaaataaacaaagaaataatattccgagactaagctatctccaacttgactcattagtagcaaataatagtattacatacgtatagtatccatctagaagccataatcatgaaacaatcatggatatccaaacaaacaacccgaaaccgaaaccgacacagagtcggccggtcagaccgcgggcaaaccgacacagagtcggccggtcagaccgcgggctggtcggtctgaccgcgcgcataccgccggtctgaccggtataccctgcccggtctgaccggtcctgacaaacaacagtccctgtcaatcacctataaattccaatcatctccaaaactacttcgtgaataaattccaaataacaaaaccaataatctctaatgccaatttttcatcacagaataacaatcaaaaacacctttgattttacatgaaaagttagaggtttgaagaaaaagtttggaactaaattcggcctaagtgattttgccggttgctagagccagtttgtgtgccgacatggtgtcatgcgtgggtccatgggcacaccggcggactgctgtcggtttgccctgtgatgtgatgtgatagatgtctacttgacgccttagggtgagttcgctggttctgttcccatccagcacgtagtgaacacgaaaaacggagcaattcattagcgcgtaattaattaagtattggttaatttttttcaaaaatagattagtttgatttttgaagcaactttcgtatagaaattttttgtaaaaaacataccgtttagcagtttgaaaaacgtgcgcgcagaaaacaaaggagaggggttgcgaaaaggggcatccgaacacacccagccagcattcagcaatgcatactccttgcgttcaaagaaaaatcaacttctggaatttgaattttgttcacgaaaaaccaaattctaccatcccacatatcttcagcacataaaagtataaaatgagaaattttaccccttaaataccatttacctacatatcacgtaccattactacttttcgaataatgtgatacattttgggtatttttactccccactaattttacattggcatgttagaatggatcttttttgggacggattttacattgggatgttaggatggatcttttttgggacggagggagtaggtgacttaaaaaattatactccattttgtttttttggttcttcgaggcctaaatatattgattgattgattattacaacatatttggtatggtatgcgtcgattatctttgtcgttcacccagctactattattttatagctacgttcgccactgttggaagctaactaatgtgaagactcaccaaggcacgcacaaattatcgcatgaatcaagataatatttgcaacatcaggggagcaacaagaatattttcctttatttcatttgctggaagcacttattattctcttattaccagttaccgacagcaacatcatcctcagataaatccaggcaactatccaaattaagcctttccctcacagcaaaagagagaagaataaaaggccaaaacaaccgcagttcagaatttcagcaagaatgtgcgtatctccatcggtccaagctcaacaacaagggcgtggctgtcaactgggccacccttcaatggtgcaggatcagttttgctctccccggttactctccaattgagcttcttcatctctgacttcttttggtttgcagataggctagtctcagtcaaatctttgatctgtacaatggatttgagcaaacataattaaattaatgttaggtctcatctctttatgcttataattattttacagaaacaatttctgttaatgcagaaaaacaagggctgtgtgagtgtgacacatcacttactatcctctttccaaacagctttctcaattcaacctttgccattactgaatattgtgtgtcctcttgagcctgcaagtccaccaatataataatgagtatcatggagaaatatagaaagaaatttcatatgaactaaatgtatacctgaaaaagatgcgccaatcgaaggagtgtggtgccatcatcaagactctgaaatgttgagagatgattttaaatgaatttatcaccaatataatgctagaatttaagaggcaagaaggaatttttgtgataacctgcaaggtgatgattgcaacattatcaggaagactatagtttccttctaccgtacttgcttttgcaatattgttggatttccaactgcgttcgtcctgtcagagaaatataggccgagtttagttccaaacttttttttcaaacttccaacttttccatcacatcaaaactttcctgcacacacaaactttcaacttttccgtcacatcgtttcaatttcaaccaaactttcaattttaacgtgaactaaacacaccctatagctgctaattgtagaatctgtaacatgattttttaaaagaactgatacaaaaatggtataaatgtacctcatgtgcaaaagcaacaaggaacggtgaataaacttgttggctatatgttcggcgccaatgagctccatgtcctttcttattgacattgatatagtaagttgccctggcctgtaaaagtttctaccagtcagttgcaagatctatagagaatgtgatatcaagttgtatatcatgaataaaagagagagaaattgttttaaatgaatgtcgtataccactagcccatcgcacttttgatccacacatactacttcattaagtggttccccaactcctctgccatcgtctgcagaaagacgcctgacacaaattattcatggttagatgtataatgtgcgagggagctaggaatataatttttcattccacgaaattatcgctaaatttcaagatgttgtaaattagaaacctacgcagttaaacaatatagtgaacgaacctgggtaggttccaaaaatgatttttcaaaacttgggttgtcacatgaaaggattatttaggatgaaagggtggtgaaaggaaatagattggattataaaagtaacatgaatgaccctggaccttgacggcgcgacggagtaagatcacatcccgagaaggcagagccggtggagactaagataaatcttaatcaaatacctaatgaccagggatatgatctctccttatataaatggaggactccttcacctaatccacctgactctatccaaatgagctacgtacttatcgtgaggtcgtgaggggtgaggatatcgttcccattgggcctaggactcctgtcccaatgcccatgacataggttggatagaaaaggccctttttcatttttgctttggccagctcctctaaattcaagctgtattttggtttaaaaataacagtaccacattaagatataaaagacaacacaattagattggtgtcaacaggtaacagaaggaatatgatatcgagaccctaatggaaaatggtctggtgctagattcagtcatccagaactagatcaggatactccagccaatacctgtggagcataacttcaatctgaccatcttgaatactcgaagctccaacagcatgatccacaaggacagatagttcatatttcccatctgctacatatattccttgattgacctgcagagttaatgcataagaattagcaacaacagtaaacaatgttaatattgttcagaagcatagaagaaactgattgatacatgcaactcaatctatactactcaactggaatatatttcctcagatgggcatcatgctatttaaggaaaacagagagctaaaaggaaaaatgatactctattgatcttcaatgaaacctacccataacagtcaacatttgtaattttttttcttttgaaatagcattaagcacatatcgatccagtttgcacagctagcatagcttcaaaaagtgtcatccacaggcatagggataaaaacactgcattaatatgcatcaatttgcgatggtacctcattatgtgaaggttcaaaaaaaggctgtagttaaagagttatggtggtatctagaaaacctaagatgaatccactatgaaaattttaatattgtacataccgggtagtaatttcctgcaacaggttgagacaaattaaggtcccaatcatccctgtggtttctcacctgaaaatgaacgatgctttctgtgaactttggtataagagtacaaaaattttaaaacatccataccacatgttcaatatgactattaactgtttcccataaaaaaacaatttcgatataaattatgagaccactcgaaataaatatatggagtgcaaattatatagatattcaccctttcgaggaaatctcttccattagaatctgtataaaatattttgttggtggccatatttgttgtcagtctggtaacaacctcctttcctatgtcatcatcatcatcaacaggtattggtccaatctttcacataagagagaattgcagccaattagatgcatgttaaaatatggaatatcattgttcatcccaaacatttatttttgaggtggaagattttactaacagtatattcaacttcagcgtgctccttattcttgtagagtctcgtgacctaaaaagatcaagtgaaccacactatagttacaatcctgatggacgaacgtaaatttgagtcagtttttttttataacctgataaatccatgagctgaactgttggtggacttcgtcaacaagaggtccatggataactttcaatggcgcctaacaggaaataaaatacagaactgtatttataatatagataataaagaggtgcaattattttagtaaatgttttatttattatttatgtacttgagtgctctcttagtagcaaccggagagactacatgcgtaaaagcaacttgatagacaatacaagattatttgtttgattgtcccctgaaatactatactatgctattttagtttatatcttttgaagtgatttgatgttaggtgataatatgaaaacacaaaatattaggttccatgtacgccaccactgattcagcagtaattacttgctgttattcgaaattttaccctcatagaatctaggggaactaatgtcacaggacagtatatggatgataaataaaagaaaaccaaatgcaaatatgagatgggaaattctgttaccattcctgaaactatagtcggtgtagtcctatttggtctgaaaatatatgctccggatgcctgtaattaaccgtagataactgaaacggtcgaatatgtgaataatatgttttgcaattgagaaagttttagtttcacataaaacctgtgaatcttcagaatctcccgtgcttgaagcataccaaagaaagctctgttgaattggcaaatccacctgaaagaaactcactagttgtggtatcgcattggtagatgccatagacaatacaaacatataacaagtttatcactacaaacaaaatgaattcatatggcaaacttgatctattttataattatttcctaggaatggatctcgtagaataatttattatgccatcattttatttatcatgcaagttaagcaaaggagaaaccagtactagctaaatctaattttctaatgtaacattctgcatcaaaataattagacacgcatggataagaataataaattatatgcataatgcatttaaaaagatatatgttgctgcataaaattattgagaaatccccaaaaaatgggcaaatactacaagctcaaataggtttaaataataggcaaaatttgctacagaacactcaaaaaacgtgtaattggctgggagacactgcaaaaccatgatacggctgatggacactacaaaaattgtgtaattggctataggacactggaggcaatattttataatttccggctcaaaataggtgagaaacttttcgaaatagcgagattacccctggcgccgctcctctccagctcgctcgccctgtcacctagctagcgtcgtcgccaccttgctcgcggccgcctcctggtcgtgctccacgcgtgccctgagctcccacagcttctccttggtgcgcgccagcttggtacgcacgtcgttgagctccgatgcctgcgcctcctccaggcgatgattctcctcctgcagcgaggcgaccttcagctccagcagccgcgcctccacggcggtggcgggctgctcaagctcacgcgctgtggcatccggctcccagagctcatcgagctccgccagcaggagctgcagcagctgctcctgctccatgagcgacagccagagctccttcaacctctccacctcctcatcctcctcccgctctttctcctttgatcggtcatcgtcgcgcgtcatctcaccgccggtgcagccaccgtcagcatttcctctggccatgttggcagcggcgggaggcatcacgactctcgccacaatttttggctcgtcgtccccggctccaactaacgtgccgtgaataacgttctccaaactttatcctttcatgccaaagaagaggaagaattaagtgctccatcgcccatcgtcgccatcatcgtctttgtcggcgcctcttcttccgccaccaccaccgccgctgccgccgccgatgaccaacctaaggttagcatttggggatttcgagtgggagaagatggcgactgggtctggttctaccgtacccagtcgtgcatagatgttgcggcaccaggggcaatcccgccatttcaaaaaatttctcacctattttgacccggaaattataaaatattgtctccgatgtcctacagccaattacatattttttgtagtatccatcagccgtgttacgtttttatagtgtctcctaactaattacataatttttgagtgtcctgtagcaaattttacctaaataattttatataaatgaatgatgccaaaatcttgttgagatagatcaaatctatgcaggaattggtttacccaatggtcatcaaatcttatgttgtgtcacattttgatgtaacagccataaatttcattgtgggtgctacaaatattagaggaagattccttcaattttgtaaatagatcttctttttttcagaaataaatgaattttagactcactgcagagatagaattgaacattctcttgagttgtccagattttgatgaataggacatcttcagaggccctggtccaatttctattgtgtcattacttggagaaaccatggttgagacataccccattccattagatcctggataattcgaaggttaatgatgtaaatcaacagactaataacaacaaagttgaatacaacaggtatttgctggccgtgtacatccgacttttagtcttttagaggcgggttttacccattttcttaaaaaaaaaagataaaagaaggtattttgagcacccccactggaaaatgatacaatgtcccgccttatcaacaaaataattatgtttatctgaccaaaaagaataagcagcacttgcgacaggacaattcgataaacctaattatgtcaagattatgaagtttcacctgttccagtagattttgatatgaagtaggtgttccagccgagtggtggtacagaagcttgaaaaactagccaatactttgggggtttatcggacgtgattccaagataagcctttatgtataacttccttaaacgtgctgtcacgatatcaacttcaactagttgtgactccagagaagttccatcagaggtttttacaattaagttggcatcatttacctgcaaaatagttaaaataattatggaatacgggttagtcaaagaagctagatctagtaaaaagagcacatggtttatcggaaatttcgttctatgtgtttacaaagtatattgaagtattttgattaaattgaggtatatttttctccatatggatcattaagaactcttaatctataagttcttgtgtagaccatcagaaactactgaacagaacggttgagcagagctttgaaaaacttactggaactcttacaaagtcactacgttcccatccaagaggattataaacaactataacctgcataggatcatgtcaatatatgaaaaacttaactggcatttcttgtaatagaacagattactaatttgtacttactaaactctttgcggatgaaattccttcctcagttgaagggcagtagctaatattgagaagttggcactaaaaaagttgattgaacaagacaaatagtcacaccagggaaatatgttccaaaattgcatatggaaattttaaaatgttatttctgaaactgttgtgcaaaaacagtcttaacaattaatattaatgattggccaccttttacctttagttgtagaatcgtaatgctgatggaaaatctagaagaaactaatggtaaagagaaatgtgacaaagtactagaatcactaatatttattctttgtgaaaatgtaagcatcataaacaaaatcaagtacatatttatcttacctgactaaattttgttgctgtacatgttcctttggaacttgtgagacaacttagagcagtattaacacctttctcaacctgaaaagataggaatagatattttgctctattataaattatttgattaaataatagtacatcatgataaatcacggcaacaatttctgtagtaaatattatgaacctgagaaaccccaatcgcaaggcgtttcgaataatcatcagttgtgtgttgctttgccgttcctgagactgcatcatgatgttgggcaatccccagtggatcttccaagctagaagtaaacaatcctaaggaacttctacccaccaaaaattccaattgacgcgcagcctgcaggaaaacacatgtcctaaagttaagttattttagagcttctaaatgtctagtttaggattattatttttttaaataaaagtactattttaggcatcatcataattcctgtagttttcgacttgcattgcagaaatatcataccaggtaatatccactgatcattcgaatatatcgcttgaaagttggacggcttgtaaaatatccagtccagtaagcattttttgcatcagcatacctgcaatatgcaatagaatgagggcatgaaggataactcttcttactgatttgcgaagttcggtaacttacgggaaataatcatcgtatttgagtggccatgattcattcgacgcatgttttgcatctgtgtaaatagatggagtagagtacagtgcatgcacacggccatcctgcgttttcagcacactaagctttctttttcaagaagagaaaattacccagcggcttagttattaaaaccagatccagggcctagtcattctggttttgctaaacgaccatccatatgcttgaaccgtcgaaaaccgataaaacagctggtaaaccagggttcaatattttggttaaaaatgtgcgaacctgggaaccccaccccacccccacccccaccactatttctcaagaaaatttcatttcttttgaattcagtataattaattcaaattcgccgattcatattcttctgattaaattgcagaaagttaaaaatgatcagaagagaacataaacggcacacagacagtctgatcgatagtctgaagttaaatttgtgaatcagcaataccttgttcacataattgataagcctgtccatgttccggaaccaagactcagcatactggtaattaaaatcgtcccccatagtccacattatgtggtttgtgcgcgtaacatttgcctgtcacataaaaaaaaaagaaggcagaatccaaatctgggtttctgttcaatgctgatttttaactgggaagaaataaaccaagaaatggaaatttacctgttttaaggctgcagcaacaaaatcattcacacgttctttaagattgtagtcaaacagcaacatgtcatcctatatcgaaatggttgaacaatcaattgaaatttgtgtatctggggataactgaaactgctgatctgcaaccatgcatatacctgtacaggtacaaaatcatcgaaaatttcgaagccgaagccatctggagggctataatggacaggaaatgcatttgtgaagatctgcagtttaatcagatgtttaaatgaacagtgataatagaatcaacaacttaacaacacatgataagttactaatgaatagatatgaaactatttgcaagaaaaaagaacaatagtaacctgagaagatgaaccaaatgttcttgagccgcgccatataacctctaggcctttgtctcctttacgctttgctctatcttggtaatcgattctcgcaaaatgcatagaatcgaaaccaagctagaattgcaatgtaaacaaatgtaaaatctccacactctagcaccgatattatgaggaaaaaagaattctatgacacagtgaacttcttgaacatccagcaaaatgatacatctggcaaaatctaaactttgatatgaagataacttaaaacaacaaaaggactttaggtacatttgcacaaatacacataaatagatttgcaaggctttcagaaaatggaatagtatgtaggagcatgagattatagcggtccaatagttctataaggactcgacatgcatggtgctcaaatgtgatgttaatattacctctgccccaagcaaataaccttgaactgcagaatgaccaaaaggatcaatttgccagccagctcttgggatcttgttaaactgtttcttgattacccgatgaccaagtgtggtctgatcaatcatgtcaatataatggacggcggcttcatcatgcatacaccacccaccatttctgaatttaaaatttccaaattttctcaaacttctaaagacaaaatccaatatagcaatgagattgaatcccatacatgaactctagctgaccagaatcaactagcttgtggactatggcctggatttttgggcttttctctgcccaccatctttggaagaaagcctggaaggaaaagacatatgtcagtctctacagttgatgtggtccaacaccaacaattcttggcaggtagtatacatataggacttttattcttattactccctccattccaaaatataaggatttctaggatgtttagcggagattaaggttatgaagagaagacttcagtaccctcaacaaatatgggatgggtgggggtgggagggtaggcgagagtaagacggaaagaaatttaaatgggatatgattgatgggacaactattgttgtgaataatgttaaaagtccttatattttgaataaaattcaaatcctaaaagttcttatattttggaaaggagggagtatcaatctatgagttagatccattaagacatttgagatttcattttcatttcttaacttcagtcatatttttatgaacaatttccctgtgatctattgagactccaggaacttacaggagggatgccacctattagtctgtccaacatgtcggtgacatagaaagttgttttgaattttggacttgctatgaaaatttcaaagcatgaaatttgactttccaaaaaagtttcaaggcctcttcagaatcgattcagttgaaagacaagaaatgatttcttttcctcatggaaacaagttcaataagaaacagtttcttctctgaatgtagcagtttgtactttgaaaatacaaaaaagtaatttaaaaattcatacttttttgacaaggaaatttaaaattcccgtttgatatgtcaccagtcaccacatgcacctacgaaacgattcgtcctccataaaagttatcattgtctcgccataaaaaaaaggaagtaggaagtcagcgatttactgatattttttaagccatgtgttttgaaatgtcaattttctacttctctgaattctcaaatccgaatactacctctgattggtacagacaatcatagagaggcaattgtaggatgaaagttcgattgagtgagacactgaattatgggcatgcttatccagaacaggagcgaggtctggtatggtccatgggccattgcttgtcctctccctatactaaaatataagcacttctgattttttttttcagaagatcaaaacgagggatgaaattaaatgggagaaagttttgattggttgagatgaaaaagtagatgaagaaattaaatgggagacgattatgattggttgagataaaagagtagatagagttgcagtattttgaaccgaattttgaatgttggaaattgctatattttttggatggagggaatatcctccaaaggataaagtaaagcagacaagagacacttccccacaggccacagctaagctagaatatggtatcattggaacatagtacagtacaaagtagggattgatgcacatgtactactaatttatcaagcacattaaaatatttgcttctgattgtcgtggcaaagttgatgcaaaacacgaagccactgacagaaacgcaggaacagaccataatcacggatgtagaaacagaatagcctctcaaaaaggaaaaaaaaaaagaggaaacgattatgaagtatatctggagtatgttttgctttcatagtgaaagaatattatgagtgtgacgagcatctttgtaaacaatatgtgaagaattcctcatgaagccccagcaaagctcaaccaccttagcttctttcctaaattccaagcacaagatggcaacacgaaagtagcaccttttttggggttgctttctcttatctgatttagtccttgtactcattctacacttgtcatgcaattttgcagcactgatttcccaaaagaaaaaaaaactcataaattttgggtttatttagagctgaggcgaggtgttgaaaaagcaaacccaggaatcagtaactagtgagacatcatcaaacgagaaaatttagttacacgtagtaaaaattcagataatttagttacacctagtaaaaaatcaggcaatctagttacccaaatcatttctagcagaggtagcagataattagttacccatggtaaaatcatttctaccagaggtagcagaggatgttggtgaaatcatttctaccagaggtagcagaggatgttggtgtttgtaacagaaaacaatatcacagagagaaattaatcgagaaggaagaagaaggcgaatcgggcggagcattggtacgagcacctcacctgctctgcgaagacgaacttgcgcgcggggtccaggatgagcgcgtccaccacggagtcgagcgtgttcatcacgcacgcgccctgcaaatccccccatccccaaaccccaaccacaattaagcagcgcaccacggagcagaacagagcacgccgggcggcggcggcggcgacgcggacgaacacctagccgcgctggtgtgaacgcggcgaggctcggcgaggggagggggaaattacgttacctggatggagttgttggtgccgacgaagtactggtcgatggtcttgagccacccgacgtcgtcgtgggagtgcggcaccaggtgcacgttcagcttcccggccaccgccccggcgctcgtgttgtaccccgagaacgccaccgccgcctccgccaacgcaagaaccgccaccaccaccaccagcgccgacgacgacgacgccatgtcgtgtcggaagtgatcgatgcgttagaaactaggaggaagcatcagaagatgggggtggtggtttccacgaggaggatgaggatgaggaggaggtcacgggacggaggccggtggccggaaggtccaaagcggagggcggcccggcggccggagaagagacaagatcggtggcaggatggatcaacagggactgcaggatatggtcctatgtgaattttcctttgaaccctcaaaaaaagggggaaattggttgtatgtatcaataataagagataagtttttgtttttcctattgatgaagtatggccttgtttagttttcaactttttcttcaaactttcaacttttccatcacatcaaaaactttcctacacacacaaactttcaacttttttacacaaactttcaattttagtcaaaacttccaattttagtgtggaactaaacacagcctatatattgtagcgttggcaattttgactgaagatgttaattaatgggtttggtaattttgaataacggttttatgagtactaggtgaatgcatttgctttattatgggtaaaagaaaacgtattataatatcatataaataaaatatgtttccccatgcgatgttgtaacctgtcttttttactgtatagggaatatccgcttgtatgtggctatccattttgatttaattatctttaatatgaagaagttcatgggactaatctgctaaattcacaacaagaacaggtgaggactaatttgtaaaatttacaattataatacattgtttgttttaaaggagtatagaaatggtgactaagcgtgaggagaagattaatgcggagaaaaagcagagctagtggtaaaatgatgacatcagttgatggaaaaataggagaagaaaagaaaatggattaagttagaaaaaatgttaaaagagtattgtatgcgaaatatggggcaaaattaccaagtctgttaactgtgtggaaaatccaagtacattcatcactgacttcaccgaattcctggaggagaagcaatgaacaattttctctgcttttcgccatagaattttcgcacaacgtacactttttgcacaacatttaatcattcgccttattcaaaaatttagtataaatacgtaaaagtatgagttaggattatattttatttgatgataaacaagtcacaataaaataaatgatattcgtataatttttttaatattataagactttcatattataagaatttctagtattgtccacatttatatagatgttaatgaatataaacatgtatgtatgtctagattcattaacatatatatgaatgtggacaatactagaaagtcttataatataaaacggaggaagtaaaacattatgcggaaaagtcaatggtggcatatatattttgaaatttgaaatgaagagggtataaagtcaagagcgttactctctttactggaagtactatatgtcttgagtatgtaatcgtggcgcattattgtatttcatctaacgtaattaatccgtatatatgatgactaaattaattgagtgtgtttccatgtgatgcgtgcactacacctcgtccctgatctaccctacgacgacgacgtcatttatgaacgcacacagtcatacgctgcgggcggaaataaacaagccagccggctcatgtttatcaattaagaagatcatgatccattcatcgacttgtacaaggcgacgatgcctcctccatttctaaaatatgattgatgtcttgacactataaataaatctggataagagacgactattctgattcggaagatgaaataaaaaaagaaaacagtgtagcagagagagacccggcctggtcgatcagtaactgcatcttcgggtgggaagtcgccgtagcgcttgtcggccacatctccgacgccgactgcgtccacatctacttcctccgttttatattataagactttctagcattatccatattcgtatatatgttaataaatctagacatatatgtgtacctagattcattaacatctactccctcctccaaaaaatataacaacttttagctcttaagattgtcctaaaatataacaacttctcaccaacattctcttcccaaccaatcacaatcctccaccatctcattcacttttcccacctatctccactattcattcaatcacaatcctccaccactcacttctacctactttttttaataaccgtgtccaactctaaaacttcttatattctgggacggagagaatatattaatatggacaatgctaaaagttcaatcgtccacaattattgcatgcatgcatggttgcatgttgctccgtccaggtggcatctatgcagtcatgcagagacccagctcagctagtttatccacactccttaactaattaagcactgatcagaatatggacacgacacgaataattggggaattgttctccaatctctttcctgttatttttgtacgagcaatacattcttataagtcgatttttttaagatagtggaagccgattccacaagatgatcggaattgggtcaatcaaatcaccttctcaatgtataaacaacatctttggttctttgctattgggcgcacgcctgagcgaatgcttcaccttcacgtgtttcaggtgtttctttttttcgaattttatttatttatttatttaaaatttaaataataaattaccgtttcgaagttccatagaaatgtactcctacctaaccgtaggacggagcatataaatcgccctatgctaaagtgagtaatatgacgtgacagactgagaattttgcaggagctccttttttttcttctgttggacgatttattgtcgagagagggccacatgcaaaaatttcctaataggttgtcctaacaaagggcaatttatcaagcagctccctggtcttattttgcaggcgacctcttcccgacaataaatcaccctatgagaaggcgagaaggggatgcctgcaaaattgccacgatgcgctcctcctatcatccatcacgtcatatttctcaccctacggtagaacaatttatatatgacccgccgtacgatagggcgggaagagtatatttctttaaaaaaccaaaatggtaatttattttttaaaatcttttaaaaaataaaaataaaaaattctttctttttcttctttttgtgcgttatcacacgctagaagctgcacagacaagacctttgtctccttcatctcttgttcgcatcccttgtaacggcaaaatcgggtataatacctcttctaactttaaaaatcggtgtaaattgacttctttcaatggttttaaaaacggttttttgatgacgtgacagaatgatttggtccaagtatactgacgtggcaacccagccatcaaaggaagtgaaaacagatatggatcccacgtgtaaatgacagagataaaaataaaaaatggtggctcacttgtcagccccacttctccttatcttcttcttcctctcacaggcaaagctggcacgcacggcgacggtgacaagcggcacggaggaaataagttttggaggtaaagaagaacaatagcttggatccaaatgcgaacgtttgctccaagaaggagctacactttgaaaaatgtttgcagcttaattgagacaaaactgaagcttcgattcttgtcaaaccaggttttgtttgaactaattaagaacacaactgaggtcaggcctgctgtatcacgctagctcatggtgatgatcagatcagcaggaggcaaaccgcaacggcggcgcgttacaggagcggttcgaacaggcgctcaactacgtacgtacatgtcgctgttcgaaaaagaagtagcgctgacaagtagaagccccatttttttattacacgatagatccacatgtattttcaatttctttcatgactggattgtcacgtcagtgtatttggattaagtcaacctatcacgttaacaaaaactgctatcagaaccaccaatgagattaatttgcatcaaattttgaagttggaaattgcattatacccgattcaggatgaccaacggcaatagctgaaagaggcaaaataggcttattccgtttttaatgtctgtgtaccgggcttttgaagacaaatgggccatgtgggctatatgacatgtagatgccatgtatattcttttcagtgtcaatataaagttagtatcaataatttgtgttggtagttgtacaaatttgaattgaaaatcttctaaagtctatattgaaaattttttatattgaaagttataaatgttgtgttggccacggtggcgatcgaccagcttagccggagggaaaaagtacacctaaggtacctcaacttgtcatcgagatacaaaattgtcccacaatagcaaaaccacataccgggcgtccctcaactaacaaagccatccgctttaggtccatcggtggttttgaccccggttttgtccgacgtggcggctaagtcagtgtgggaccaacgtgggccccacatgtcagacaatccacgtcagcctcctctctctttcccctattctctccattcctcctctctctcactcactcactcttctcttctcttctggggtggcggctagagcgacaaggcagcaagctggccggcggctgaggcggaggccgccgaggcgaggcgagagaggaggaggcggcgggtgacaaggcggcggcggcggctgcgacgtgggaaaaggcgagggttgcagccggtcacgaatggcgttgacggcgttgggcgcggaggcggaggtggggccggacgccgcaacccacggcggtgggcacagaggtggaggcgtgcgcctgccgcgaggtaggtgagctagctccaaccctgccgtgcagccgagccgagcaggcgactcgtcgtcgacctcccactcggggagatctaggcgaggctcccaacgatggaggcggcggtgcgcctgatccacaccccgcaggacgcgctcaagggcgccggggagtacatcaaccacgccttggggccggccgccgccgtgcacagcctcaagccgccgctcctcgcggcctccgccgtcgccgatgacctccccggatacctcaacgtgctgtcccgcttcgaggaggcgctccacttcctctccgacaactgcggcatcgcctcccagtggctcactgacatcgtagagtacctcgaggaccgtagcctcgccgccgccctcgccttttcacacctcacaactgccgccgccaccgcctactcctctcccgcctcgtccccgcggcctacaaatcgtgaaggaggaggatgtacatgcaggacaatagtcgtggaaggagcggccatcggtgcggggccagttggcgtcctcagcgaggtggcatcgcagctcctccttcctctcccgacgcttttcccccgtggcagtagccggacagtaggtcccagcggtagcagccaccaacatcgccgggaacagggtgtatgtcgtcaccatcacctgctcgagctaccaaccaaaccttagcaggatcggattgggtctctgagctcggcgtgcggctcgagagagatggaaggccggcgaactatgtagttcggagaggagacgggagtccaagtccgagaagacgcgacggcgcaggcagaacaagagatggatgtaggggagagcatgctgtggtcgatgaggaggccggcgaggaaggcgtcgacggaggagacggtggcggtggtgccggcgaaaagcgtggccgcgtcggccttcctctacggcgccgctttcggtggagcgatttggggaagggttggagataggagtggctaggagtagccagcaagcaccaccactctgtgccggccctcctcccctgtcggcatcaccttgatgctcggtggcagcgtcgccctagatgcggccgtcacctgccatgacaagtacgagcacgtccgggaggtgagcgcggccatggcgagcgagcgcgggccggggcaagggggcggaggcgacggctaggcagcggcacaagagaagagagagaggggaggggaagagagggtgctgacatggcatcctgacatgtgggcccttcgtgggtcccacgctgactcagccgccacgtaggataaaaccggggcaaaaaccacctaagcatctattgtgaccggttttgattagttaaaggacgtcggatatctggttttgtggttggggacgattttgtaactcgatgacaagttgagggaccttcggtgtactttttcctagccagagacaacatgtgacgcgggcgctctgttgggccaagccgtgacgcgtgaccacgagctgcggagctgtaacaccctgcaaatttgaccaaaaaaaatcaaaactccaaaaatatgggcctgcaaaaactttttgaataaattgcatcatgccgattttgttcgatgattttattggattttgattttggagttcatcaatcgcgaataaggaataattaattaggaataaaccctaaaattaaattggtaaaataaatgattaaaatataatttaaaataaagatttggtgaggttggaaataaataaaatattatcgcaaccatattaataacaattgaattctagtgcgactgaataaaaattagcctaattaaaaattcaaataaattatataaataaaatatgggtaatattaatctagggtggatccattggttggaataacacaaatattgagtaaacttcatttatgcaaaatttaggatttatagaatcaaatttacacaagaaataggctaacatggggattaaataggaaaagacactat

SEQ ID NO: 22395 - DNA, 22584 bp, Oryza sativa
  unsure (1)..(22584): unsure at all n locations
caagtttcgaaatttaacctctatgagtaattaatttgcggtaggaatttagatttatttaagaactaactaaatgtgttgaattcttagtaatttatttaggagacataaaatatcttaggttgagggatagtcctctttcgcgaataatatagttgatgtaaaaaaaattcgcccctcgcgctcgcttttcgatttggactttattggattttattcgaattctaatggaattcaaatcaattcttcgcacgtaattttagagtccaagggagttgcggatccgagcgagggtcaagacctgcaggactatgagcaaggcaagtcatcactattctttgaacatgttgatcccaattgcgaaattgttttgtttaaaaataaaattgcatgcaatgatgaacatcctacttgtgattatgccatgccttgattattgtttacccttaaatctttgtaaccatgattacgtatgagtccctagtcaactatgaccattgtttagaaatgctatgctagaatcatgcatactcatatttatcaaatgctttatgcttgggcaattacctttgggaaggtaattgagatgcggcatgtggagacatgagcgccacattgccatgatattgatgacatgatttgtgaaaggaaaataaagtgaaacaactgttttcgactggggcggacggaggatttgggtggtatccggaaaaggctagtaccgtccctggtcaattaaggaccgagccatgaagttaagcatgaaacgaccctcgtacaaccgcacttctcgtatgggtatagacctagcggagtagatagctgagcggaggcagtatccatgcataatggtttcttgatgtgtgaggctggggctctacggtggggcagccattggtaggaccgcgaggcgggtgtctacaatggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagtgggtactgccaatgcgaggttatcgaaaagctttgccgtgacgcgtctcatgtgttgggacgaggctcatgtgttgggcagtcgcggagtgtgggtaaagtgtacatccactgcagtgtgagtaaaccaaatctattcgaatagccgtgctcgcggttactgagcaccgggacgtgtattacacttggttagactctaaattcttaacttgtgtgggatgggatattgcatgatgatttttatgctgttggagccatttcctgggaggcgggaaggtggacgtcctcagaaaaccatgacgactcaatggcgggaagctatccttgggattacaatggatggtggacagaaccatcgttatttaaatgtgaacactggtactaaaatttgatcagtcaatgctaggtcttaggcttatgaaaagaattacaaaactgactttgcgcaaagaaccatagccatcctttgaatacccctatcatgtgcattgttgctatgatggcttgctgagtacggttggtactcactcttgcaatatataaacttaatcagaggccggagacgaagcttcagaggatccctatgcatactatgaggagggtgatgaagacgatggcgctcagtaggtcttagttacggtcgttgcctgtggcaatggcgtaccgttgtcttatctacttctgcttttggaatgtattccggaccgctcggtccgatgatctaagactatgcctgcgggcttatgatgtaataattcgcactagactttcgtgtatgtgcatttggtatttcagctatgaactcatgtgtaccagactacttgatctagggaaatggtactgtttacacgattgattcctgttataaaaacgggggtccacaggagttactgggctaggctcggacaagcaggctgtcctgaccactgatcagtccatctatatttacccgttgtactaccaaaggaattattagtaacgctaaatccccaaattcataaccagctgtagtaccaaactagaaaataggagtgccaattggcgcacctattaataaagcctatggtgatattgttattcatgttcgagatacataaagctatagtaccaaactagaaaataggagtgccttttggcgcgcctattaataaagcctgtggtgatattgttattcatgttcgagatacataaattgatcattttttttcttgagatttgaagactctatacaaacgaacggaagcaaagagactaaaaaggaaaatattagaatgaaattcacctccagaacacatagttatatagttatagtacccaccggaaaacatttagttagacacattccacaaagtcaagttagggtgagtagtgtaaaataagtcattaagtcatatgcaaatatatgtgaaattcatatacttaagagctagggagattaaatatatggggttatctacataaatagttttatttttattgattaattctaaaacatatatgaaatggaatatttgttatattcctatttgaaaaaaataatatgcaaatgtataattctaacaatatatgtaataaagtggcaacaaatcctaagtgatttttacagttggatcactcttccaaataaaaaaaagcttagggtctttaagtaaatacctctctatgcaagttttaagtggatcagcatatgagggggaggggggttacatccatttaatccaatctaatcgaaatgttctggatgctgagtttgtcagggttatggataccatatacctaatagtagttgactaaatctcggcaggacccaccacataccatgttttatacggaaacaaccttcgaatataggaggagttccgcataaggaaggatgaatagagttctacgtagaaacgacaaggactactcggattgtatccatatttgtttccctagttctacttcgataaggggacacctatgggtataaatacaaggccccctaggaggagaggggacacggaacaatagatcaggacacaagatcaatatacaagccaacatacgccaagacaagacgccggatatcgactttagagataagcatggctagtcccctacggtgtctacggatactgtcaggagagacatagcgctgtctttgatctcgccggatgcggattcaaggaggaaggctaccctgttgtcgactacgagtcagtacgacagaccgtcaagtcgataatagttagataggctaccccaaatattgtactggtgtgattatggtaaataagagcaacgtccggctttggccaacaggagtagggttattacctgacaattcaggggcccgaacctatataaaaattctcgtcctcatctcttttactacaatcttgcatatatcctagtactaacgatccccatactacgcaaataccggaatcgcgacatcaatcatcgacagagttgttaaggtactactttttctttaaaaaactgttaaggtactacttgcttctagaattatcacagaacttgtagttttctatttttcttgatcttctgtatttttttccttagacaaaatccaagatttatttgataagttaggggtgccacgtggcccaatcaaaagacggcataaccgccggctttagattagtacattagaagtagcaatattttgtttataaaaaaattagcaagattttaccttaataatatacgtctcaattggttgtctcttttgtacatgtcctttgattatttcttaagcaggattagggccagccctgggtctatgtagccaagatgagcgccgcgggcccatgattgtaggggcccatgatggtggggggcaatacctaatactagtagccgtagtacatgtctatggcctacctaaaagcggaaacgcccgagagatgagaggaggtgcagcatcgctgcatcgttgcctcagcaacttggcagacggcatcgcatcgcacaggcaggcgcacagcaccgtcgactcgtcgccggcatcgcatcgcacagcacacaagtcaccactcagctgcctggcgccagcccgccggccgccagccgacagccgcctgcccacctcccgcctggagcggtggagccctggacgcaatcagccaatcggcaacttggcaagagtgcaagaccagccatccaggtgtccagccgcctgctcatccgcttcctgtgacttgtgacttgtgaggtatatttttagtttaatttactaatttaatagttcatattcttgcactaagatgatttcttgtttttatgattaggtctgagatgttgcccaagaagcatttgttaggttctgagaaaaggaaaaagagaaaacatggtgatcaattggttgaaccgcaaaggggtgctttacataagttttttttgttggttcaagtaatgttaattttgcatcaagaaatgccccaagaagtatcttttcatgagaagcaatggatatgatgggttctattctttattaaggtaatgatattcgtactaaggtacaaatatatcgatattttggtcgactttatttctcgataattaccagatatgttaaatttaatatatggatgtatttgctttcgttctgcaagtaaattaaattagcgtgtgtgtgtatatatatatatatatatatatatatatatatatatatatatataaaccatgcatatatatgtttcaatacatatatatgcatacatatatatatgtatatatatatatattatattatattatatgtatatacatgcataatatatatgtatttatacatatatatgttatgcaaatgcatatgtatatagatatatatatgaccaaaatatatttacattatagaaaaatgtgtacacatgcatatagaaacatatgtagtcatgtattaattacaatctattatatgtcctagctagctacgatttcgacgtagtagtactcgctgctagctcagaagctaaggaccggtaaattgtgtttccgtcgtagtagaattcacccttgggatcaaggatttcttcgttgatgaatcccatgagttgttcttgaaccgccgcgataaattctttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgtacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgcagtagcagttaacataccaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacatactttctgtttcatccatacagtgagtgcaagccttgtaccccttgttggactgtccggataagttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggagggtgtagatacacatcgtaacgggccaagtgctatggccgctgctcatctctccaaaaggattcatgccatccgtactcaaaccaaaccgtatgtttcgtgcgtcctttccaaattctttaaattttctgtcaatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccaggaagaatgttcttgacgagtttcaataaatcgccaaatgccttgtcactaacccatttcttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaataattatagcttggaatgaaccccgactcaaacaagtggaaatgaatagtcctggatgcagaatactccttctgattcttacacttattgcatggacaacaaataaaacccctttgcctactagcttcggccactttcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaatattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatataggggtgggactttagtcagggttggtagcattaacgggggataaagatcaccgggatctttagtcgaggttggtgttatcgataggcattaaagctaagatcttcagccccggttggtgttaccaaccgggactaaagatccggggggggcctgacaggccctgacagcattcgaactgggactaaagatgatctttagtcccggttggtaacacaaaccgggactaaagatcaaatatgcccgttacccttttgaaccgggactaaagatcatatttagccccggtttttattgcatccgggactattgtggaaatcggccgaccgacgaaagatggtttctccaccagtgtgatattactcacttttcaacatttttactttgaacatatgtatgcactgatacggcatggcttgtttttcttaaaagtaatctatgtacgtaaaagtatgcaaccgtaactcttactgatcattttttcttgtcatatagattaagtgcttaaaacctattaatagttaaagggataagtccatgcttccccccataactttgcctatgtctaaaacacaacgaaaactacaaaaccgggtaaatgacgtaccctccatttatcaataccggacactttaccaaaccaaggcaggttttgcctacgtggcagcatagtcagcaaaaaaaaaataaaaacaatggaagcagctcatcagtacaagtcattgtcttcccctgctttctctctcaatgccagtgagacgccactgcccaatccacccacattgggcacccaccagtcgctgccgccgccgctagtgtaatgtccgcctttcccaggccgggctcgcttacatctggcagcttttataggttatagactgccctcacagactaacacaagtattttctgcacactttgtcctcactaagcttttataggttatagactgccctcacagaccaacacaagtcttttctgcacactttgtcctcagtagtgcgcacccgggaagaatttcccggtcggtcacacatcccaaattgctccaggccaaacacgcttaaccctggagttctttggagatcggctttcggaaaagaagttgcaacaagacctaggccgggatgttacagctaggctcctcaagccctcgagggacacctccactggtcgacctcctcctcccaagcccattgccgactgccaccgacaccttcatttgggagcttgctagcaacactggctcctcgagcttcaagcatcttgcttttacatgctgttggtattttttacgaccacagataaatccgcaagcccatggaataccgctgaagcacttcaccttcgggtgaccccaaaaggatatcgaactcagggaacatgtgtaatctatctaaggctaagactattcaaggacaacaactgacgataggcaggctaggctagagaggtctttctatgggttttaattatctaagctaagcaaaggtaattccctatttgttgcttcaggcaccgacccctgctggtctgctagcgtggttccggctatagctctatgatgtacccgaacatggaggattattaggacggaattcagggttgtcaccacctgccgcctacctctgacaaatccgtgggatacacaacaaacaaaggtaatctctactctagacaccacgcctaagttattaattactactctaatacttgcgtaggaactttcttctctatctggagtcctagtactagagcacttagtatgaatactaaacaatgaacccgcaaagatagaaatatatcttactcagacaaagtaattaaataacataagaaaggagcatgaatgcttactttatataagaagtttctctgaacccgaagcagagtgtactgacagctccggtactcctccagaattcctcctaggaagctacactcgttgaggtagaagtcggatgagtgccaaacttccagacactcctacatagctttctctcactccctaccttattataatgtacaaaagatacaatagagcctcttgtaattcagctcaaagttgtgtgtgttggaatgagagtgagctcctccttttataggctccaaatgacggttaggggtatggggaatgaccaaaacaccatgcaaccgcctctgggaaggaatccaagccatccacgtggaagcagatggcaggaagcggcaggaagggttcagccgaactggtgggttcggccgaacccaaaaacactcctcccggcctctccttcggccgagaggttgtttaatgggtctccaacaacctaggctaagttttggcccaattctaaatggtttttattgacttattgggcctctaatccgtgtaaacgcgtcctgaatgcgcggaggtgcattttgccacatgacggatgtgttttctcctcaaattacctgcatacacatatttcaccaacactagtggaaatgattagtaataatccctaccactaagtttgataccatgttttatttcattatatgcaggtattgacggtcagatattatgatttaaggaccgtcaacacatgctcaacaaagccaaggtcgacctctagcatttcaaaaagctcctccgccgagattcatgtcccaagcgtttctgtcttgttgagctcctccatcctaccatctcatcgagctcctccatcatcgccgcctggttgttgagctctagatccaatccttctcctcgtacagctccttcatcgccaccaccttgcgagcacagcatccacctccacctccaccaagcagctcttccatctccacatcgttggtggcaatatgagaaaatggtggctcttcatcctccatgcattggtgaggtcaaggtcgagctccgcctcctcaccacctctgatcagagcacctcctccatgcacaggccaactggcgagctcaagctccgcctcttccccccgcctctagctatagctcttccaccgcctccattgaactcatgctccccaacctcgccgccctggtcttggagatgggtcgcatgagcaggagaagtagtggtgttcacggaggcgcgacacagagtcctgacggcatctggcctctcccctttaaccgtggttgctgtttggatctctttatgagatgattctaacgggggcgagtcggcgatccttgggggagctcggcggcggtgctccatagtgaggtagcgactactctcgaggaggagctcggcagtgacactccacatggaggactcagtggcggtgctcctgtgtgttgccgtcgcgagaagggagaagaaagatcgatagagaatggaagaaagaggataagaccttgactgacagatgggccctagagttttttaaatattatcttttctgaatgaactgccatgttagttgccacgtaggccaaaattgcctgacctaaaacaagggtgttgggggggtgtaagttggacggttttgatagttcgagggtggtgaatactcggttttagagtttgagggaaaattttagacaaaggtatgacttgaggggtatcaattggacttatcgcatattgaaatttgaaacacaaatgtttagtggtgacgagtaaagaaggacggggaagtatgacttcgtattgcaacattaatattctctatatatcacctttgtacctttgtttataatatatgatgtcgttagttttggatctgacagtttacaatccgtcttctgaaaaaccaactatgtatatcacttgttctacttcaatattttaaacatgacttgtatttttttatatttgcaccaaaattttaaataagacggaaatatattatgttcaaaagtgaacaacgccgtaaactcaaaaataaagggcgtacaagtttatgtgttacgtaccgtggtgcaacttaatttaattattaatagtgcgtcatgaacgactaattaagaaaagatcaaaattaatcatatttttttcgtcagcgcagaactactgcacgttattgatttagtcaatcccttctttctattattgtccactaaacacctaaaacttaatatataatattagtatttattagtactcctaaaatttacatacaagcatgtcacatcaacccattaagcaaacaaaactcaacatgcaatcatacagtaattatatctacaactacaatttattttgttttaaaactaaacatacacatgctaaatcatttttataatatttctatccaaattattttatcacttttcgaatatctaacatatatttcgcagcacagcgttgggcattatcccgttaataaagatccaaaccaacactagtatatatagaactttctttccgtacctccgttagttagctgcctcgcagtttcggtcttttaattgcttgctcaccaagcagataacaagtcaagatcggacatatgcagtctctccaataatttgtcaattacttgctcccaagttctctctttcatcaaagtataattaataaaatatcttcatttcatttggtttcataacctgattcatgttgggtcaactccatttttaacccctttctcccttcttaatttatcggcattgctcttttccttagaaaaataactttataatttctcttcctctatactttgatcccttttattcgaattacatattacctgatatattacaaatgtgtttatcatatattataaattatttttttttcatattggtagggatacaccaaggtactattaatttttagtaagcatgtcttgttctcacccagagaacaaacgaatgtgtaaattattagatgttgatctagtccgaaagtgattgatcgatagtctcggtttattcaaatggtctcaatgtaaacacacggaaatttagcccacaaaaagatttaaagatacgtatattctaggacaagtacgcacgtacgtacgctgactgagcttatatacgtgtgtacgtacatggaaaattgttctaaactcttaagatatgtcctcccatcttttacatgccgttcgtctaaatagttgcaaaaaaaacttttaaaaaattacaagataattagtactccttccgtctcataaaaaatcaatctagtactggatatgacacatcttattgaatgtgtcacattaaatcttatatttacttttttagggacggagagaatatatagtaatatcactctgcatgtttaaatatgacttgtaacaaaaacaaatatatatgtggatatactcataggtttgttttttttcacaactcatagaaaggcatatttaaaactgtatatttctcatattaaaataatatgtttttaactatttagatggtatatgagagacggtgaaatatcgtcgagagttttagaatcctctcccgcgtgtacgccagaatagtaaatttacgtcgttgttgatggatggctacagctaattttttactattcaactacagctatcaacttttaattggtctccatgatttcctcctaattaaatacattcttctccaatgattcagctataaaaccttaccaaatccacaaagttaatcaccatatttaggtggataaatctcatcagatcgagctaagcttggaggcaagcacaaatggagctcacatggcttctactcctcgctactctcctcctctccaccactctcctcgtcttcctcttccatggcggtagcagcgccaccggcggcgagaagcgccgccgcctgccgccggggccggccaccgtgccggtgctcggcaacctgctgtgggcgaccaactccgggatggacatcatgcgcgccgtgcgccgcctccacgcgcgccatggcccgatgctcggcctccgcatgggctcccggctcgaggtcatcgtggcggaccggcggctcgcccacgccgcgctcgtcgagagcggcgccgccatggccgaccgcccggagttcgcgtcgcgcgcgctcctcggcctcgacaccgccaccatctccaactccagctacggcccgctctggcgcctcttccgccgcaacttcgtcgccgaggtcgcgcacccggctcgcctccggcagttcgcgccggcgagggcggcggtgctcgaagagctcacggacaagctgcgtcgccggcaggaggacgccggcgcgggcaccatcctggagacgttccagtacgcgatgttcttcctcctcgtggccatgtgcttcggcgagctgctcgacgagcgcgccgtgcgcgacatcgccgccgcgcagcgcgacctgctgctccactcctccaagaagctcagggtcttcgccttcctcccggccatcacgacgcgcctcttcgccggccggatgaaggccatgatcgccatgcgccagcggctgaaggggatgttcatgccgctgatcgacgcgcgcagggcgcgcaagaacctggtcgacgaccatggcgacgccacggcgccaccaccgtcggcggcgagcgccacgacgttgccgcactcgtacgtcgacacgctgctcaacctcaggatcaacgacaacggcggcgagcgcgcgctcaccgacgacgagatggtggcgctctgctccgagttcctcaacggcgggacggacaccacctcgacggcgctggagtggatcatggcggagctggtcaagaacccaaccatccaggacaagctccacggcgagatcaagggcgccatcacctccaactccggcaaggtgtcggaggaggacgtgcagaagatgccgtacctgaaggcggtggtcatggagggtctacggcgacacccgccggggcacttcgtgctcccgcacgcgccggcggaggacatggagctcggcgggtacacgatccccaagggcacactggtgaacttcacggtggccgacatgggcatggacggggcggcgtgggacaggccgagggagttcctgccggagaggttcatggccggcggcgacggcgagggggtggacatcaccgggacgagggagatcaggatgatgccgttcggcgccgggcggaggatctgcccggggctgggcgtggcgacgctgcacctggagtacttcgtggcgaacatggtggcggcgttcgagtggcgggcggcggagggggaggcggtggacgtcgacggcgagaagctcgagttcaccgtcgtcatggagaagcctctccgggcgcgcctcctgccaagagccgtcactgtttgactctgggtgagctttgacatttgggggggtttattagacatttgacactctctcgctaatgtagtttcatgctttgtaataatggtattattattagtttccttttgatgaataaaagaattccaatctattttgtcatagcacttgacttactataaaccatcatttgactcgttctatcccatgacaactttatgtattggtaaactctaatttgtgtgtgcgcttattagtcttgttgcgtgacgggtttcaatgtcgtctaatcagacgaggtgacgtgtagacataatgacttctattatacgatcattgcttattagttactctctccatcccaaaatataagaacctagcaccggacgtaacatttactactacaatggtaaatgtcatgtttgttcctaggttcttatattttgggacggagggagtactctctttatccataaatataagaaattttgattggatgtaatgcattttagaaccatgaatctagatagagggtttgtagaactagaatacgtcatatattcactcaaagtcacttatattttgggccttatattttgggacgaagggttagtttagtttgaaagattcttaacctatctagacgcctctgaaacattatggaaaattacaaaaccaacccttaagtcacttaaagtttgatattctatttcataagttattttgttataaatatccactcacctactcagtatttttgaaaaatcatcgcaatacgcacgtgcttaacttaatcaatatgttttcataaagtatattcttgatatatatttttttaaagatttcacaaatagaattgttgatgagagattaaatgttgtcacagtgagtttagctatatatgtgctcaaaaaagttcaatcaaacattttaatgcaagaaaagaaagaaaagagaagagatgagagaagaaaaagaaagaaagaagatatgtgggtccgataatttttttcttttcatttacatgtgggtcctatcatttttttattttatattttgctgactaggataccacgttagcgaaacgagagatccataccgtcatagaaccgaaattgcatggttttgtataatttaggagtgaagatttctggtattggagattagcgatgtcatacaaatttgacgtaaagttgaaggacggctggtgaacttattccttatcattactcctaaacctacctagttgcaaaggcccatccaccaacatgtcttctgcgcttgtcgatcgtgaacggattagttatccgtttccgctgacgtgaaaatttaaaatttgtcttttgctttgacttattaggtcaaccgttgggctcctagttgcgctcgtccagcatggctaggctacgttgtttggttgcatccccgacccaagactgacatccagttccagtcatcttccaaagcgccggtggccggtgcgagaaaggagctcagtagcaggcacggcaatgggaagatgatgtcctagttgctgtgttcttcccaatctccattccgttattgcttatgtttctactccctccgtctctaaatatttgatgccgttaactttttatttaaacatgtttgaccgtttatcttattcaaaaacttctgtgaaatatataaaactttatgtatatataaaagaatatttaacaataaattaaatgataggaaaagaattagtaattatttaaattttttgaatagaacgaacggtcaaacgtatttaaaaaagtcaatagcgtcaaatatttagcgacaaagtactagattttaggaacagctaagcatagttggatctgtagggattcgttcattatataacaactatttatgctttccgtaggagtatgggagtgccgtttacgaaaaaaaatatagaagtaacatttaaattttctattggacaagtttccagaaatttcaggattgagatagaaaataaagataatgctggctaattcatgtattgcagaacaagaaacagccgggtgtgcattatgaccattatactaactagcaaaatgcccgtgcttcgctacggataaattatttcttagactaagtattaattagaaattttaatgataattagaatggataaaaccaccattgcatattgatatactcatgttctcataatactcaagatggacgtggatgatccgacgatcaaatggtggtgaggactgtggtaggatgtatctcataattggactcatctattgatggtggacattggcaacgaagaaaaccagaacagcagaaatacgactgacaatattgttctgatagatagagaaagaaacgacaacggcgacctccggtctgatctgggttgctcatttttttccggtccaatctggtttttcttctaataatacacatggtttttgccgagttttttttggcccggtctgattttttaataatacacacaggtcgcttattttttttcgtctaatctggtttttgcccgtatgttgtaacgggtgaaggctattttaattatattattgttatgctagaaaaatgcacatgcttcgttacgggtaaaggaacagttaaatgctataaagtctagagttaacatgtatatagtaatgtttcaagatagataaattatttattaggctaatgataatcacgccggataaaaacacgctctctctctctctcaacccttatgtgataaactgtgatatcattgcactgggtaatgatgacttggtgaggtgaatgaaatttggcctcaatgatttatcgaagcaccttcatagttatcacaaatgtatatttgtgtttggataattaatccgctctacacgtgcagaatgtgaatgatgtccctaacacatggtcccgatgattgtagcattggagaaacggacgtccaagcaacgcacctttacgtataatataagtaaataatgaatttttggggagttcattaattattttaaactacattttttatgacacttttataatcttttttcataattgatgatcgctataacattgcattgattataatcacaatgcaacagtacagtgctatgttctaaccgacaaaacctgaacagtgccagccataccatgccgttcctttttctttttagaaaacctcttagcacatgattaattgagttttattataacaaaaattaagaaaaattatctagtattttatatcaacttgtatatagaaagttttaaaaacacgctaacaaaaatcgagatagaaggaacggagccatggtgtgaagtttcacgccatgcacatattcaattttcatgttttaaaaaaataccggttggttcacgtgtttatactaattttttaatataatataataatctttatttttcgaattaaaaaccggtatactataagattttagaatcactaaaaatctgttaaagaaagaggtgcagaacttttgatgtttcagccatcggatgtgcatggtccgtgctagtggttgagagaaagaaaaattacgcgcaaatatgatttgggacgagggagggaaagtagacttattctagggcctaggtcaacatatatttatattgatttttgtgaatataatttaattatttttaattttcgaattaaaaactgattcattataagataagatttcataatcaataaaaatctgttgaaaaaagagaaaaaaaatcgaaggcaaatataatttgatttgggggaggcaaagtagacttattttaagagaggcctatacacagtggaagtaataataggtgcaaaattgagaggaaagtgggacttgaacccaggtggccgaagtgaaaactttctcccttaaccaagttggcagactactacacatgagaggcaattacatgaaatatatatataccgtatcagacgcggttttggagtagataagaaaagcccgatccggctgttaaccggattaaatctggattttagcgaagcgcatggtaacgacggacggaatttttcacggaagccttgcgtattttttaattattaggtagaaattcacaaaatattcacaaatcaaaccaccatcacgccgaagaaaaccgccgtcggctcaacttcgaggatgtgaggggggcaaccagggaggaaagctgtcgccgccgctgcggccacaccggggagggggagggggagtagcagccgccgttggctccacatcgggaggggagggggcagccgctgccactacgccgggaggggaggagcagccgccatcacgccggggaggggagcagccgccgtcacgccggggaggggagcagccgccgccgcttaggatttgaggagacggagaggaggcgagagaggatggtggcgagagaggaggtgtagaaaaagaggtgccgccggccagggggaggcgccgtggggtgtggctgagggggtggggggaggggaggggagggggagcggtggagagggacggtgttgctggctgaggggaggcgcagtggagaaggagagaagaagatacgggcgggcggaggagagaaaaagaggaacaaaagcggagcggaagaagaagagataaggcgggcggaaagatcgagacgcgagcgcgcagctctctcgcattctcggctccgctcgggtccacgctctgatgggcgattttttttttcgtccgtgcgaaaaaaattggacaaaaaaaccggacgaaaaaaatcagacagaaaaaaccaggcgaaaaaaacgaatccgattccagtggtaaaaaagggtgcgaaaaaaataataaaaaagaatctgcccgattccaaaactggcctaaaaaacaatttgagcccggtttttttcgtctttttttctgagtgggtcatgattttatttggttgcggtttttttggcccggttttttacaccgctgtttctgatcagttttttcttggcgcgcacgaaaggattgaatcccaaatagagtaacctaatatttatctttaactattataaaaattgaggatgattccgtcctcaccttaattttcatccgtcatatgtgttagacacgtataaaaccaaattggacaaaaaaaaaaacaaccaactggcaacacaaccaaatgcccagatcgaacaaaaaaaaccatccactggtgatccgacaaaaactaccagatcagaccagaaaaaactcgacgacctggatcgtagcataaaaaccatctgtattattaaaaaaacagaccaactatatgtattactagcaaaatgcccgtgcttcgttacggataaattatttcttagactaagtattaattagaaattttaatgataattaggatggataaaaccaccattgcatattgatatactcatgttctcataatactcaagatgggcgtggatggtccaatgatcaaatggtggtgaggactgtggtaggatgtatctcataattggactcatctattgatggtggacattggcaacgaagaaaaccagaacagcagaaatgcgactaacaatattgttctgatagataagagaaagaaacgataagcaactaactagtgaatatgctccccactccactctaacctgaatcaaattccatcagacagtactgtcatttccagtattgagcaatgagcacttccaattccaatgcttgtttagctagctatatcgagaaagtctagttcccatgctctgttcagtttatgcagtgcagtgatatgtaaatcatttctaactaaatgtgtaaaacacaattcctgtgctaggtgtaagctgataggcacagtaagcatggtggtgttcagtgatccaatttgaactggaacaataaaaaccacctatttttttttcagaatctaaacaaatgaatctaggctatagctagtactagcagaaaccaagaatgatcacaatcctctctgtgccatgcacttgtatacctactgcatcattcgttccaaatgggctgttagatctgttgaccctagtacaagcagcgagtaccagcacccaaaccaactatatgtttgattaacctcttgggcaaccaaaggacatgcaaagcattatcacaaatgacacattataccaaagtgaagtgattcttcagttttccttcaccagatagacaacatcgaatcacatgttcacagcaaacacaaaaggacacaaagctagcacctgcataaggaataaactaatgcggctaggttactactgataggtacttaattcaattaagcatgaccgaaccattagtttggatcgatctccacttgtaaagagcccacataaaaggtttgttttggatttatcttcttcttatgccttggaccagaattagtagcaactaatctctccaatatttgaaccatattcttcaatatcaggcaacgcaccagcaaatggaaccttaggcttcttggacatatcacatgggggcaacagttctgcggcttctgccatcaataagcaaacaaaagccaattagccacacaaatatgcaaatggaaacgtgactagatgagcgatgaatcactggaatccatgccaaataccccaaaatactgcatttccttcaatattagaaaaacagtcatatgatccaccaaaggccaaatcccccagattgcacgtcataaaacatctaactcaaatgaagaacatgtgtgatcacattatgtcacttacaagaagttatatagtcattctaaagtatgtacatatctggaaataaaactgacctatcaaataatactactcaaatgtacatagacaatcggaaagtaaagcaactccgggacaaaagtacaacttcatgaagaagcataaagaaaatacacaacacagtcaatacatataaaagtatcgggtaaaaatactgcactggcttnnnnnnnnnnnnnnnnnnnnnnnnnnnnnnnnnnnnnnnnnnnn

SEQ ID NO: 22396 - DNA, 15676 bp, Oryza sativa
ggaacctcggcgactatttcgaagtacatcggagcgtcggacgaaccggaatctagcgacatacaaggcaaacattgcaaacaggctataagactactgaaacagagaacaaaaccatttttaatggattctacacatttttcttaatttactgagacttgaatgggcttaaacggagctcggttgaattagttatgaattttagaagattcactgtgtttattactataaaagaaaaaccttaaatcatttattgcgcaataaatcccagggctgacgtcagcacggagggggggaaagacggcgccgacatgcggggcccaccggtcagcggctcgggagagggaggaaggggcgccggcacgcggggcccaccggtcagcgactcaagggggagggcggttcaccgtggaccgggaccacgcgggtggtccactgccggtccacggaaccgacggtccagatcgccctcagggtcgatcggacgggcggcggtgacccggctcggctcaaggccgaccgaccagccgcggcgacggcgacggcacgcgcacacgcgaacgcgttaccggcgacggcagccggcggtggagacggcggcgcaaaggaggcgccgacgggcggtggtgctaaagcgacggctaacgggcggcggcgctaaagcggcggctaggagggagagggaggggaatagaagggagagggcgcctcaccgagggtggccggcgcggaggaagacgtcggcgaacggcgacggtgatccacgggaggacgaaggccaccggcggacgggatccggggtaccctaaagaaggagaagagagagattagagggagggagatgaaccacggcgtccggtattcatggccgaaagcggcggtagcggttgaactcaccggagcgcgaggggatgcgaattccggcgacgaaactcgacgggtaaccgtcgcccggggtgcagcttagcctcgcgaaccctacgtcgtctacggcgcggtgcggcggcgaccctatcggcagctagcggcggccggagtagcgaaaccggcgtcgccgggtggttgcacggcgcggcatcgatggggagctcgagggagtttggcgagaaggggaaaaagcgagaggtagcgatggggaagcttaaatagggtagggtagggccggacgtggccgggaaaggcgggttttcgccggccaccgtggggagtgggggaggagatagaggcgggattcgaaaaccgaatcccggccatctcgggcgcgggcgtgggcgggagagagaggggagtgggcgcgggagatgcggtgcacgcgcggacgtggctgacgtggcccggagaaggcggaggcgtggacgcggcggtggttgcgggcgcggcggcgccggctggaggaaggggacgggtctgataggtggggcccacctatcggcgtcccggggagagagggagcggcggcttggctgggcctcggcctgcggccggcccagcagggaggagggagagaaaaggagagaatgggccagcggcccattcgaaaaagggagagaaaaagaaaaagaaaaaggagaaaaggattttctggaattaaaatattgcttgctcaattttaactggttaaaattatttctagggctctgaaaattccactaaaaatcctgttagtgaatttcgacatgtagaactcaagaaaaattccacatgccagttccgattattattcgcattgatttaaaagggtttactcttgctttgcactggtattttcgtagggtcgcttataaattaaatttttggcttgggaggagaacttcggggtgtgacagtcgagaaccagacttatgtatgaatgggccaagaactcaggattgacacgacacactgggccaaatttcacaagtctacgaagaggaacaccggaggaggccaccagccaacttgtgggctggttgggccagcccagggttcggctaaaccaggggttcggccgaaccaatgccagcgccgatggatgcagggttttgagggaacagtggagattcactccctatggcggttggagggtattaccgacctttccaaccaccataaccgtcattacctgcctatttaaggagttcactctcttcacttcaacacacacctcaagcaagagctctctcatttctctcaagtttagtttagtagtatctagttggtggaataggaatagagtagaaatcaggagtccagaagccttcggaagagttcgggtatgactctagtagctttcctttcctcttttgaaagctttgtacttttattagaatactcttctatatacatttatggtattgaaatactttccgagtatataagtacgtactttacattatgttcatgttatactgaatatacggctagggtatctgcgagatgctttggtgcgggtataatgtttgcatatgcaattactctctgtcatgacgatgatattagagtagtatctgatattttagacgtggtgcctagattacgggatatcattatttggggttatatactgcggataagaggtgggccgctgacggtgacagcttagtacgggtattcctccgcgccggtatataattcaaagttaattccctggggaggttattcctccgtattgagccccggttgtatggttatgacgggctgttgtaaggaactcggcagtcaggggtggcttctcgaagtacaaggagggcatcggatagagggtattagctgtatatcggttaactagaatgtatgtatactatgtatattagaagtacaggaatagattttctttctcttttctttccacttagcttagataatatattatgagaatgagtagctaatgcttgtgtgtcactctacccttagattatcttaacccctacttagaatatgattatcacaagtaatatataaattattagtcaaggtctctctacatgatcttcccacaggataaaataaatacgatacccttggaatactctcgggtgaaatgctacaatggtatattcatgcgcttgcggatgaactctgtaaccataatataccagaagtatttctgcgctattgctgggaattatatttctagtaatgacgttaagaaatacgaacaatcacccatcctggaatacaatgttctttgtcacccagtttgtggaaggattgagagctgaaattagagcggctgttataatgcatcgacccgaagatttgggtactgctgtggatcttgcccgtttacaggaggaggtgttggaggcgatcaggagggaatctcgtcgtcctgagacaagttccagcagtcggactaccaatttttgttcggccacagtgtttccagtgggacaacctcgtaccattttggcagctggaactcgttctgataagcgcatgtctcgggtggaggacaaagtagctgctcttcatgctattctcaaggctaaggggctctgttacacttgcggtgagcgttggagcagagatcataaatatggtccaactgtgcaacttcatgtggtggaagagctattggaattccgggattcttcttctaaagagaggggtgatgaggagaaggattctgctgttattcctaactctgaatatgaaggtgaagtgtgtcagatttccaaagaagctatgcaaggcactgagacaagtggtactctcagacttcaagggttgattcaacacaatgaaattctaatgttagtcaactctggcagttcacacagctttatttcagagggattggccgataaatggactcagcagcgacatgttttgtcacctatcaaggtcaaagttgctgatgggggtattttggagtgtgttactgagttggaggattgtctttggtgtgtacaagggatatcctttcaatctaacttcaaggttttaccactcggcagctatgatgtaattttgggcatggattggttagagcaacatagcccaatgcaaatcaattggcgagcgaaaaccttgcagtttcagtataagcagcgtgcagtttgtcttaaaggtgtttcagctaatattgctcttttccctagtatcactggtaatcaagttaagggactagtccatcgtaatgcggtgttgcatgctgtggaattttgttcgttggtggaagaatcgtcatcttcttctctgcctacagaaattgctcagttacttgaggaattttctgctgtctttgacgaacttcagggtttaccaccagctggatatttgatcactctattcctctactgccaggagctcatccagttaaccttcgaccttaccgatataatcctgctcagaagaatgagattgagcatcaagtgtctgatatgttacagcagggagttatacagccgagttctagccctttttcttctccagtgttgctggttcttaagaaggatctcacttggcgtttttgcattgactatagacacttaaatgccattacagtaaagaatcgttaccctcttccaataatcgatgaactattggatgaattggctgcttcttgtttattcacaagtttggacttgcaagctggatatcaccagattaggatgcggcttgaagatgtgcacaagactgcactgaaaacccacaatggtcactatgagtttcgggtgatgtcatttgggcttactgctgcgccggccacttttcaagagctgatgaacacaattctatctcctctactgcggaaaggagtgttggtcttcattgatgatattctagtttacagtacatctttggatcagcatgtgtctttacttcggtaggtgtttcagctattggctcaacatcaactaaaagttaaacgttccaaatattcatttgcacagactagtcttacgtatttgggacatgtgatcagtttggctggtgtggctactgatacaaagaatattcaagcagtttaatcttggtctattccacagaatgttaaggaagttcgtggttttcttggtttggctgggtactaccgcaaatttgtgcgtcattttggaattatcagtcgacctctcaaagatttactgaagaaaaatgtggtgtttgtttggagttcagaacatcaggcggctttcgatgctctgaagttagcgcttactactgctcctgtattggcgttgccggatttcactaagcaatttgagattgaaacggatgcttctgataaaggggtgggagcagtattaatgcagtcaggatatcctttggctttcctcagtcgttctttggggccccagaacagaggtttgtcgacctatgaaaaagagtgccttgctattttactcgctgttgatcattggagatcatatttgcaatttggtgaatttgtcattcgtactgaccagcgcagtttgacacatctggatgatcaatgttggttactccctggcaacaacgtgctctcactaaatttttgggtcttcagtatcgcttggtctattaaaagggattagaaaaccgagctgctgatgctttatctcgttgctctcatggagaagtgttacagttgagtgctttgtcatcttgcattccgacttggttggaagaagtagagaatgggtatgctgctgacctggctacttctcaactcatttctcagatagtattatctccagagcagtttctagattatactctgacagatgggattcttcgcttcaaaggctgtatttggttgggttcgaattccactttgcagaccagagtgttgatagctttccactgctcagctattggaggtcattcagggattcaggtcacatacagtcgagtgcatcgtttgtttgcttggcccggcctcaaacgtgttgtccggatgtttgttaacacttgtgaggtatgcaaacaagctaagtctgaaagagtgaaatatcctggtttgttgcaaccgctaccggtccctgatcatgcttggtagacgatctccttggattttattgaggggttacctatatcagccggctttgattgtatttttgtggttgtggacaaattcagtcgttatgtgtcacatcctgattttcgttttaggatttataaattatttaataaattattattagaatttatattaaatgttcattaatttacaagtgaagttaaatgtgggaaataaaattcttaaatataaagcatggatggatttaatttttatgaaattctccatggttaattatactctctgaaatttctcggatttttcggagctcaattcctaattttaatcatacaaagaacattttagtaattacccacatattaaattaatcattaaattgcctgattataatcttgttaagtactttgagtgtccaagtattttcaggatttttcttgaaattatttgagcattggaagtatttttaacaattcaaagatcatttcagtgattattttaattagaaaaagttttaaatcttcccctaagccgtgggctgattccagcccatctccgtcctttgtgtgcacggctgtgcagcccatgtcggcccagccgagctcccccttctctttctttctttgctttgttttcagccagcccaagagggaaagtatactttccgtccctgtcactacagtatcgtcttcaacctctggcagcttacctgagaccgaattggctcggtttttcccctccaaatccgaccttttctcttgtgttttcctaaaattagttgaggggaaattatctcctccttatcatatttctttccctaaagtttcggagatcaattttgctcggataaaccgaatcgaattcgttttcgagtttatctctccacctaaccctcggatttttctggctcaaatcctttcgttttgagttcgatctctctcacccatgactatataaagcatcccctagtcgtcctcttccgtttgccccaagtcccgagctctaccgttgcccgtagcgcggccaccgcgtagccctagccgttgccgtcgttgtcatcgttccagccgcgccgcgctgtggttgtggtcgccgtcgccgcttagcgtcatcaccgtcgggttcacgcggaggaggagcacctcggccgcccctttgcagccgccgaagaccgtcggagagccgtcgtcgccgtcaagtcaagccgagccgccgttggagttcgtcgccggccttcgttcgtcgttgttctttacaccggtgagttcgcgtcgtcgtcgtcttcgcatgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagtttcggacgttccggaggagagcgtttacgttgaggaaggttcagaagcgtttgaggaagctcaaggcaagtcacacagatcccaaataaccctttaagcaggttgaaccagtttaaagctaatgttttatttcaacttatgcattattttcgaatgtcatcgagttgtgagcctttcccatttaattatggccaacaatgactttattttcctatgagtaataaattaattagcttgaaccttatatattggtttggtttagctaaatgctatatatataattgcttagccatgcttagaaacattagctcattaatgggctgaatcaccttacattattacttatggttatatttaatgttagctcacgatggttaatcgtgttatgataattaattgataattagagtctgattaaaggtgggttgtgagcacatggttttgatggtcgtgctcatgacaattaaggaccggttcacgagctactgttgtgaaacattaaccgtgccaatcacaagccagcgtgggcaacggctttatcttttgtatagcatgattcattgcggggtgccagactgagaagcggcgagaagtccgtgggggtcgctggggagtccatgcctctggttatagttatagagggggtgattatgatccaggaatggtgcactgtggtgagttgtgttgtgcagagagtattgtcacaacctctattcgggtactttctagtatcgcgacgcatggtagacatgatgttgaggctgtgtcttgtgggtacagtggtacacctctggccagagtaaaagtattcgaatagccgtgcccgctgttatgggcgggttgagcaatgtttttcgtgattactctcacacctctcacaaaaattattgatgctataactggtaataatttgcttagctcctggtttggagttagatctgtgcagccgggtttggttgtttagaagtgtgctgttcagtgttgattaaaattgatgattactctactgttttactattcttaaatatttgttaaatgctgcttttgcaaatgagtctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccctagttgagctgcctgtgggagtggagctgaaaccatcgctagatcgtttttccgctgctgtttttttttcttttgtaagaatataacgatattattatgatggatttgtatattaaattgcctcggttgattcctggacgaggattttatgcacaaataagttcggaagttactagtgaattctgggcgtgacattatgctcattttgtggcgttaacacatccatttactgcttttgatgtgggtttggcatatttgaacaacatgtacaagttacatggattgcctcagcatatcatttctggttggaacgtatctttacaagtgccttgtggacagaactttttcgcttggcagatacacaattgaaaatgagttccgcatatcatccgcaggctgacgggcagaccgaaagggtgaatcagtgtctggaaacttttttgtgatgttttattcatgcttgcccgaagaaatgatttcaatggcttgccctggcagaattttcgtataatacggcttatcactcagcacttgacacctctccgtttgaagttctttatggacatccacccagacattttggtggtttggatatttctgagtgtgtagtatctctaaagaacgatcactagtttacttcgtcagcatttgctgcgagctcaacaaggaatgaagtcacaagctgacaagaagcgttctgaccgtacctttcaagtcggtggttggatttttcacaaggctcaaccttatgcacaatcatctttggctgttcgttctaatcacaaattggcgttttgctactttgggccttttcaagtgctagctaaagtaggagtcgtggcctaccgtttgcagcttccattggattgcgctattcatccggtgttatgtctctcagcttcgtcaagcatcttaccccgctcaacctactgatgttcgtcttcctcctgctgttccacctgaagatattgttcctgtggaaattcttgaacgacgcgtggtcaaaagaggagatcatgcgacagaacaggtgaagattcgctgcaaggtcactcgtcggctgagtctacttgggaggatgctgcagctctccacctgcattttcctgaagcaccgccttgggggcaggctagttccgaaggagggaggaatgtcacggcagcgactactcatacgtctactgtggacaatccgacaacagagaacccggtgaagcattgagttcgacctgagcgtatcaagcgggccaatgtcagaatcgctgggccagaatggatcatgggctgatgtattcgcgcggctatataagcgcactaggtggaagggaaaagaggtcgaattaattgtattctgaactatctcctaaactgaatacttcttccccttccccaagtctgaatatctctctctctctctgtgttcttcccctgttcgactctgttctatcttcttcctctcaaactttccagaaatcaacagagttcgtaacagttagctccactcttttgtaatgatatgatttgaatttattttatgtaatttaaattcctgtatttacttcatgcaatttaaattccgcatgagttttgcctctcctattaatttctgtggagtgtgtttctactctctctctccaattcttcgatctcgtattcctagcgaggaacgtagaggcaaccttatatagccctcgagctatttgagagggagttcaatttgagaggttgaactcctcatctgagtagggttctttgtagctttttttaacctcctcctagatctagctttccacataactatgatcttaaggaaatgtttgatagaaattttaaacgagtattatgggggaagaattttgggacaattttgttcttgccccaactttgattgccaatattgattttgcccctgttttttagggttttcgtttttaccctaattttttaaatgaatcaaccgtttgcccctgttccgttaattcttgctaacggtgttaaatgtggagggtaaaaagacaagtaaaccattagatattttcccgtacttttgatataatcaaaatacaaatctattgatgccatactatagcagtaatttaatttgtcaaaaaattgtgaaagtttgccaaaatttgggtcaaatttgaaagtggtgtacaaaagtaccggaaaatatctaagggtatacttatcctttctaccccgcaatgaacaccgttagcaagaattaacagaatagaggtaaacggctgtttcgtttaaaaaaaaagtagggataaaaacgaaaacctaaaatataggggcaaaatcaatattgaaaatcgaagtagagacaagaacgaaattgccccaacaatttttgtacgctttattcatgcccacactagagcgggtagaggtcctaaaaaacagccgactttttctggacttacatagttacatatggatggatgtgcggtagccttctgagcggtggaagatatctcagagaattaacccaagcctttcgagagtaataggtttttttatctacaagccaaggtgcatctaagagatcagctctacctaaatctgaaataacaagtatgtgtacctttggttgaggatttatattgctcctccttattactgtctctatttctaaatcactactataaaaaaacatttttgcaaacgggccaaagcgatttttccaggtggccatccactccgcatgaacttcaaagcatgcgaaaatacacgatttttgtaggcggacatttgtccctcctgcaaaaatgattttagcaggcggcatctccatattcgtaggcactatagccacctgcttgcgaaaatgttttcggagaaaaaaaaagccaccacccacccgctgctgccctctccccctctggccatgccaccgctttcgccccctccgccagatctgtgagggagacaaagagggagtgggggagggagggtaggggaatcgcaccaccgtcgacttccatgacgacgaaaaagacgaccatgacgacgaggaagatgaccacacccgtcacctgatccgccgcacccgcacgtcgccatccaggaactgccaccccgcccgtcaccatctccagctgccgaggtagagtagagctgaggagaggagagggacgggagctacaccgcccctcccctccggccacgctgatcccctcccctcggttcgcgccaccaccgacgcccctccccttcggccgagccgccgctgacgccgctcctcgtcaccaataccaccacccacacctccccttcggccatgttgccgccattgcccctcctctccgcccgcgccgctgcaaacgcccctcccctctgcctgcgacaccgttgacgcccctcccgtccacccgagctgccaccgacgccgctcctcgttgccgataccccgactacccacaccgctcctcctcggagccaccgctgacgatgccgcccctgccctctgagccgtgcgtgagagagaagaaaggtcgagaggataaggataaggatggtggagagaaaagagtagtggatggtggaggaaaggataagatgggacgcaatattatttttggtgagctgcaggcacgattttcatagacggaggacaatctcagccccattgtcaatttcgtaggtggccatttacttccaagatgcctatccgcctagaaaaaatatatattatcgtctgaaaattggtttttctagtagtgaatatttgatattggttagttcaaaattgaaaatgtagggctgccacgataccctttgcaggaggactatgttcccgattatttcatttttcgtgatctacttttttgtttggagaaaaggtaatggaaacaaatctgatgtttatatacacagaagtgcttgtacaaaatcgaaagatacatcattaatacttaaactacagatctcataacaaagagaagaaaaacaaaaccaaaactacttgactaagcatcaaaactacattcgttctgtcctgctttcacaaaacaacactgaagtgatcttgatagattttccgaatggatccacatgtcctgacacatattaccttcgcccaccgacgctctctagcagaggcagagaagaagaggccctgccaataccatttgcgttccacgaatggatcctgcacaaacacctcatatcccgtggcacttaagcctccgatctaacatagttccttaaccattgtcaacacctccaaaaagcctttcgtccactcctcgccgtcctcacatgaacgctagctgtatctagccattagaccgaatccagtctccacggttgccgctagcaccgtcactgagcttattgttatcctaccaaagcccctccttgttgtcctaccagatctagcaatgatctggcagccagcacacctagggccctcgccgctgaccatcgtcaccgtcgtccacaccacaacgttgaaatgtacaggctgccacgttgaggaagccgcccctccaaccggagttgatgccgtcttccgccttcaattatctcgtgccacccctccagtcagaaccggtgccatagcccctgccaatgccgtctaaccaccgcctccatcgcagcctcaccaccctgccaaccaaagccgaacgcccgcctccaacgtcgttgtgcccccaccacttggagccaaggtaaagaatcaccactagcggctagcaaaggtgaatggcgagacaaaggggagagatgaccatccgtccaaccgcctgccaccataataaacaggtgctgccggccagcctatgtcggcgtgccaccaccaaactcaagcgtgtgtcatagtgaatgtggatctagaagagagagtgataaggacacggctatggtgcccggatttgtcccaatctttcacagtaaccaaaagatagcaaataatacagaccattgactagataaattgagcagcaattaattttcaaataaactagcagaaccaaatagccactccataaaatatagtgacaaaatagttgtgcaaatctcgcaaatatactccacccatgcggcaagggagtcacacgatcagagaacgaatacttctgtagaaatcaaagatgtgcccaagaaattgattcccgagcacactcctgttggttgattttgtggacttgtggcgataaaaattaggagatgggctaaaccaccggtttccttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcacccgatcgatcaaggcactggaaggggttcatgaggtatctcacaacagaagaaacaatgaagaagaaagaagaagagcaatggcttcatctcaggtcagttagatcaattaattttcgcataagcagaaggtgaccatgtttaggctaagactcaattatttaattggaataaattccaacattgtggtatcagagcctaatcttagccttcttgttaacagtgaaatttggtaagcccggagtagtcatcgacttagagtcagcatcggcttcgaagtcttgagattagccgatgagagttgtcaagtcatcagttgtcggattcttgctatattcggttaaggaaattgatctactagatgaagcttatctagaagagaccgagttcaaagagaatgtggcatggcaagttatctattaattaggaatagtttgttagtttccttttatctttaggaaagtgtgtttagtgtcctataaggattttatcttttccttttatctttaggaaagtttctttcttgtccgatgaggacttgtatcaacccatgggtataaatatgtacacctaggatctgtgtaatttatcgctacgatcaatacaatttgacgcatcgccaccctttttacttctacttttgtttttacgttccggcggaacttggcacccgatgcagggctgcatcgtcttcgatctctggcgaagggataagtccaatgttccgccggcccaggcaattgtatcgtctacatcggcgtagttcaaggctgcatcagtacattcgacctcttggattgctttggtttggatgatatacttgcctacctatttatcatatgtctatgttaatctagtcttagcatatcaatttagctctatcggctgcttctcgttttagggtttctgccggtatcggctaaatctcatatgtctctgttaatcttgtcagttgcaggatcaaactgactggcacgcccgcatctcatcaatctttgaacctgcacaggagctaagcagatctcccaggccggtgtgttcgattttttcatcaacacttctttatcccatcatccctaagtgaagccattatgccaattaaaccctaatttctattcggcatgcatgatgcgattttgagttaattagattagattaatccctttgccttggttgcataagcgaagccctgttatactgctgatctcggccaactgctgatctcggccaacagtagaagaagcaaaattattgaagagtttaattttgttgatttttatgagaagaagaggattgggataaacaagattgaaattcccaattcaaacactaagaattcctagaccgatgctaaggtttcggctagcactcagcaaacaagaaaggggataaactagattgaaattccccattatcaagcaaaagggaataaacaagattgaaatttcccgaaatccccaataagccggatccaattggcctaaaatccccaaatgaggaagcctaatttttgggggaagaaccctaagtcacaaatatccgaattaaatgcaaattcaagtcaaaatta

SEQ ID NO: 22397 - DNA, 13802 bp, Oryza sativa
  unsure (1)..(13802): unsure at all n locations
acttgtcgccacacgcgtgcgccgcctcgtgggaccgccgtcgcaacatcgccgcgaattcgctcgctcgctcgcgggacgccgaatcgggaatagaaggggataagaatgagctagggttaggtctcacacccattcccccctggcgagcgatttcttcagtgcgggcgaaatcttggccgtccgtttgatcagatggccgccctcgctcccgcatcgggccgtcgccgtcatgggccaagctgatctgggccacgtccgccaaagcgccgagcgcgcacataaatgggccggtccattttgggccagcttttcgataagagtgggcctttattttttatttattaagcccatgattttaattcctcagaatgtgttatatctttattagctaaattttagcccgattttagccttttttttatgggccggcttaggaagtgatgagccgtattattattttaagcccgccatttatgttttatgtatttccagaaatttatttatgacctttcttagccattaaaaattgctggaaaattatggtcaattatttgatcactcagaaaattatttctagttaaatggaaccaacaggaagtttagctagaaagaaattaatgatatgatattatatttgaccaatgttaatatgatttcatgtcaatatttattaagattattatttccttaagccacttaatttattcctagttgaatagaaatttaactagaaagtatttatgatttcatgtcaacatcattatgatggtcagtgccttagtaacttaattatttatagtcgaatggaaccaacgagaaattcgagtagaaagcattaagatctgaagttatatcaaacccacgtttttataattgcatgtcaaatatcacattttttattcttaagtattttctaccaaatggtgatataattaaggaataaattttaagattattcataattatttatgaccaatggtgttttgactatgaaattctaagtttattttgcatatgattgactaagccaaggtgaattaattatatgcaattggcaatgtttattatttaagatcagttgcaatacttggtaaatatttctagattaatggaaccaacagaatgtttatctagaaagaaaaaatatttcattaagatagtaatttccttaattattttttgcccaacggtgatgtaattaagggaagaaatctaagtattgtcaatcgttattttaattttctctgtcattttggccttaacggtgattagacttagaattttatttatgccattagtgcattaattcctttgtcacttctaccttatggtgatgtgatcaaggatctaatctatcagtaagcttaattcctttaccatttctgcccaacggtgatatggctaaggattttaattttaattctatggcatcactaatggcgtcatttcctatatcatttctaccgtatggtgatttgatttgggattttaaattatttacattatcacttctaacctttggtgatgtgacttaagacattaatgtttattccctaatcagttctgcccaacggtgatttgatttttggattataagtaatttcatttaatgattctttcgccttgtctcttcccaacggtgagacaaagcgaaataaagattaagctatcgttattgtgtaagtgattgtaataatgtacatcatttgcacaagcaaccacaataatagtgccacttaatattttagcaataaataatgttgtttatcagttaaagtctatggaattattattatttttcctcattgacttaactgagcctaaggcctacttgagtatgacttggcattgacaaaggattccttatggctcccgtagctaatgtcactaatttttttttctaaactcaagaggcatctttagcctgggagtaggccaatataatgttatgtttcgcatatcactcataaacattaagattatcatccctgttggtgttaggggagaattttgagcatgactttgcaaaactgtatctagcaaacgttgagatgaacttttagaagtttgtgaaaactaatgcttagtacaattttagtgcctatgcacatttgccgccataatttaaaaggtagcacaagaaataaatcataaggcgtgcaaacttagtgggatggacatcgaacatttcatatgcgccacttgtccatttcatattatttttctcccattagactacggtcattttcagttatgtaatactaagacaaagtggaccataattgacttggttcatcattccacaaatcaataaaaaatatagaagattaagaggcaaaataagtaagatcctattaatcttgtcatttgatggcaaagatgaagctttactaaggggttgtagcaactctaaatttaataataataaagctcactttcctcgcaaggggaaataaaattgcctctatgtcctatgtatgctactcttgaaattttcttgtgtaagttctttgcaagtaatagggacatgcttaatgtcctgattcaacaaactagttaaataagaagattaaaggcattattttgggttgaatcattatgagacgttgtcgaaattatggccttatttttcggccacatttctaggggagaatatacgtctcattaaggtcgagacacttcacccttagaaatttttgacatctatcattacttagatgataattcgctaagtaaagctaaagtaaaatcaagtgattcaagttcataaggtattatgcttccattacataaataataagagaagattattctacctcatttatgactcatagctccattatgtggatgctagaattttgtatctcttaatttgtgacttgcacaattaaatatacataacatagcttgagggttttgttatggaaagaaaagtcacatatagggtgcagacttaagaaatccatttgtggacttaatcaagcattgatgatgatttaaattccgctgcatcattagtgaactaagcttaaataagaatcaggagaataactattctataatgatggaagtaagacgccattgggagtgtgtcattgtcgcttatgtcacataactaggggagtttggaacgtctcatgagatagagatattcttttccttagattttaatggcgttgtttagctttaagttaaaatttcactaagtcaagaaattagccaacaaatgatcatttaaggctaggtttacccataagcgacctccgatttcctttaagaaatttaagaccctaatgctaaaatcaaatgaagttatgagatcggattatggtggtaaatactaaataaagtttgttcacctgataagacattaaaaataagcgttcattccaatggttttcggaccatgtaagaataaattgagatggatgaccaaaataagacattaaagtgttcatctaaatggttttcgaaccatataagaataattgagattgatgaacaaaataaagaatttagtagaagtttctgaatgagtcaaaatattcggccatttaagtgggttaataagattaagcttgactctaatggaaatttcgaacaattcaagtgaggtggacaggtgcatgaaaattaaaggtggaaatttcattcaccggtactccatactaatgatattttattgttaagcaatgcatattgctgttagaaactaaggaaatttttccatgaattattttggtctgaaggagcactgggcttatatcagtaagtcatacattgacataaagaaataatttgagagaattcagttaaagttagtcaagttgaaattaaattataaagataatcatttatgattcagctgacagaagcttgagattagctcaaatctggatgcctacagatttggcaaacatttttactgggaatcttggcagtatttaattaaatccagagtagaccactggtattaagaatgttcacaaggcaatcttatgtaacatgctcatgtttctaaagtccaatgatctcagaagtttagagacatttggacacttattttgtgagatgtgtggatatttataaagattattcagattaagctatgtccacacataggggagcaatgaccatgtaaaagctccaaaaatagtctcttactgcatagtcgatgatgcagttagattttaaagcatgttatgattaatcatatatataagaatatttcccagaactaagagtggtaaatagcgctcataaaccactcaaaaggtgtaaaccactcaattatactgtgttatatgttgtgcactaattgaacacagttttctattttagtagcaacatgttgtgtgttttctgctaatacattgatatagttgtgaaacatatgtcctaggatcgaattattattaatctaagcttttgcttatggatgcatactctaaaggctcataaagttaagattaattaagatatgttctagccagtacatgtgtaaataagagcctcactaagatcctggatgagggggacttaatttttcaatcaacacccactaagttaagcttgagtttatttgagttctatagtgagatataggtcttgttgtctcggtgacgcataatgttgttgaagacacattgccttggggagctattttatttaatagactcataagtaagtctcgaaatcaaggggagaatgttggttgattttgtcgacttgtatcgataaagattaggagaggggctaaaccaccggtttccttatcctaacaagaaacaaactacgagataaatctgttttgtgtgatcaaaatagactcgaattttagattgagatagacccccgagccccaccagtgtcacctataaaaggaaagagaaggagggaggcaggtgacgacttatctctctctaacctcaaaccctaaattaatcgcccgatcgatcaaggcactggaaggggctcgtgaggtatctcacaatagaagaaacaatgaagaagaaagaagaagagcaatggcttcatctcagatcagttagattaattaattttcgcataagcagaaggtgatcatgtttaggctaagactcaattatttaattggaataaattccaacaactcctccaaaccagcacttggccggtggcttcaatagatcatggtcgatggattcaccattaaccagctcagcagggatgataaccctagatgcgaaaacttcgacaaaagatcaacctctccaaaaagttgtcttcggcttggtgaagtgtcacgcccggaatttctatccaaaattccaaactcttacatgtgtgtgaaccctcgtccaggaatcagccgaggcacacaataacaaattgataatagagtacaattattactctaattaataagcgaataaaatgtcattacagaggtagatagttcctatcaatcaataaaaatctaagcagcggaagaataagataaacggcgcagacgactccactccacaggcagcttgaccaaggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataagcaacatttaatgaacatttcagaatttaataaaacagttaagtaataattaaccaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacgggaaacgacgacgatgacgtcagcgggaccaccggcggcggctcgggcgcgcaaggttgccggcgaacgacggcgcgacgacgcgaacggaggacaccaacacgtagagggcgacgcggcgaactcaccggtgaccaaagcaacggcggaagatcaacggatggtgacagcgtcgaggaagaagcggcggcgaccttcggcttgacgacggcgacggtgttccagcggcccacagtgacgacggaggggcagacgaggtcggcgacggcttggcgatcacgacggtggctttcccgagcggaaacgacaaccggagcgacggcgacgcacggggttggagctgcggcggcgacggcgnngcgcgaagcctacacggggctagggcgctacgggcgggcgacggacgaagacgagggtggcgacgggtagcggcgggcttgggggtccttttataggggttggaaggcggcggcgaaggcccacggcgaccggcgacgagaaggaaagtttagggttcagaggagagagacgaatccgattcgagatcgaatccacggatttccaaacgaaattagccgacgattccaaaagagaaaagatagaggggatcccggggatcatttcccctctattaatttcaccggaaacggaaaggggcggctggatttggaaggagacgacgcggcgcggcgctagggttcggccgggcgatggcgcgaggaagacaacggccctgacaggtgggccccacctgtcagcgggcagacgcgcgcgcgcgagctcggctgcgggccggattgggccaggagagagagaaggttccaaaagagaactttaaaaccttttccaatttaaattattcatgaaatgcaattccatttattaaaaatacttccttagctcaaataaatcccagaaaaatctaggaattatagaattaagcaaagtatttaatgaaattttatctggccccattttatattgaaatttattaattaaaactagatcttctcttctaggcttttaaaataaattctaataattccaatttagacaacaatttaaatatttgggatttttagtgtgtgacatgaagtgactggaatagatatactggattgggacaccaccatttttaatttctggcctttctggtatatcctccttcttcctctcgtgccctgtagaaccaattataagtcccttgcattcaaccctatggttccgattcacttgaataggatttgttccaactaactaggctctaaaaaaaatatcttatatattagaaggcatcttggtcccatcactctatccacctcgaagcaaagccgtcctcggctttcatgtaattttggaaacctcttgttgagattataaacacataatgatttaatttattccataaataaatcataatattgcagatgcaaactagcatgaacgtatcattggatctacacatgtacactaggcagtaaaacataaacagatcaaatatacgtaccatattgaacacgtaccgaggttgccgaaaaatcggttgctcagcaggaattactcgtggttgtgggcgttgacgaaggcgtgcaacacgcgagcgaagaggaagacgagccgtcgtggacgaacagggagcagtcgtgcgaagcgctttcaaaaacattattgccgcctctcccggtgcagaaagtcgaaggcagaggttctggagaactgctctcccgatcgccggtgcacgccggcgagcaggatggagtagtatacgagcgacggcgcagcacagagtaggaggcaaaccctggatgatttcgcgtgtgttgcgtggaagcggcggctcggtttatatagagaaaggttgctttatcagggcgcccgcatgatctctactccgcgtcgcttaatcagggtgcccgcacgatctccactccgcgtaactgaaccagatacactccgcgtaaccgaaccagataagtcgcgcataacttatccagatgccacgccgtttttcacgcaatggatttttcggtatgtttccaaaacaaacaaatctgaatttcccacagcaaaacaaaactgcaaaaggaggctgcatctgcgacaattcgacacgtacgtcgtgcacgcgcatcgccggcctagcccggcgagcaagcgcgcgtctgtccccctcttctctccacctcacatgcttcaagtggctaggagggcatcctcccttttaaggaggtctccctctcttagaataactccccatgcatgtcatcctatgaggtggtcttttgtgattttccaaagaattaatctttaagtgggctaagacccatctattaattccaacacctctttctttttcttcatagcaacaaacacatcagcctcaatagcactcctcgtcatcagtttcagcacatgttgcaccgccttgtgcacaaaagaataattattggactgaccaccatgtgtagcatcaagatcaaactgccatagtctacccaacaataaatgacatgcactcaatggcgcgacgtcagagtccactttatccacatactttccgatagaaaattttactctcaccttgtgagtaattttcagtataccactctgattcatccattgaatataacatggtgttggaagcctccggattggcaaagcaccaaatctaaactaacaacatttgtaaaacttccaccatcaattttaatttgcataccttctcacgaataatacattgcgactgaaaaatattggagcgttgtcccttcacaccattaacagtatagcttctacttcttgagccatcatggataaaccgtttttactcacctgtaactattggcttatagttaggatatgcgtaggttacgatagcataaatcaaaattttctaccgtgtaaaccaggaaccacatgcaagtataagatcatagatcgttaccactcgacgcgctgcatagcggaagaaagcgctaagaaggcaaagccaccctcgcgatgtagcgcgtgccgatatagaggaagtgctcgattgcaccggctcgaccttctcctcctcgtgcgttctcctcgtcgtgctcccacgccgatcagcaccgcaaagcagcagcgcctctaccggtattcacacgtacaaggacggaacaccatgcatagatgtgctagcacccgcgcgcggctagggttttgctcgggagggaagtgacggctagggtttctcgcatgatgcaataactccgccggtcacacccctcataaatatataggatccacgactcaggcctccaaggcctataggactcctattcagatccctatctgaactaaggtcatattggatctccatccaatccccttattctggcccattaagcgtgccaccttgtaggttcatgtacactcggctgtaacccgaaaactcattttcggtccacgtgtcaacagcggcccctagcagaacttattgaccaaccggacatacataaagatcatatcggctgaacctctagtatatacttgtataaacccctttgcctcacgatatcgattaagctcgaggctagatatgtgccatcctataatagctcaatcattcactcgaacttgtgatagattataaaacctgtgattgactcctcaatcacctttagcatgggcatgcactttcataatctataatatcgaggggcccaaatatctctccataggaggggcaaatcccatattcttgattaattattcatatcccactacatgtttcattgcatacccgaaaactgttttataactacccaattacgaagtagtgtttagcagtccctaagcaagctactacacatcatagcaatccaaaattaagctaaggctaatctacaccgcacactttactctggagtcctggactcttttgtagttccccgactccctctccctaatggcagttgcagcttgcagtgccatatccatgtccccctcctatattccgtgctcacctcaacattctcctgggagttatctcctagctcagcaggtggccgccctgctctctctctcccttcctctccagtgggtatgtcctctctatttccttagatttgtggattgggcgtcagccgctggactggtgccgcaggacctcttattgcaaagataactcgtccaaattgcatgttgtagaggaccggaggatggagccactaaaatcgtgtgttgcagaggattaaaaggtgttgctgacgaggtgtacatatatatgtatgcaagccggtgcatatatatatatatatatatatatatatatatatatatatatatatatatatatatatatatatatatatatatatgtaatcttgccttaaattttgctttgagattaatttgaaatattgccttgtgtacacaatgatggaactaatcttcgtttattcatgacaaatacatgctctacacgtgcctaatcttgcatgccatatgtgattagattttgctttgacattaattttgaatcttgcctcccatacacaattatatggaactaatcttcgttagttcacgtttcagaattagttcacggttggaactaacccatacactgcacatgcgggccctagggaattctcaactctctcgttgcaccacgtggcgagcgttttgagggagacatgtggcagactgagagcgtttttagaaagtttaatggaattttagtatataatagatagatagataatagataatagataatagatagatagatagatagataatgtgttatctatttcaaggaacaatgttagataattatgtaaacatagtatgtgatacaatcatctatacgattgcctctaggacatatcacctatagtaacattagtggatgagtcaccaagaggatcatcagagaaagctgtagttaccaatcctggtgcagaagaaactttagcactgctagcattcatgcattccctttgcactagaggttgatttgacatgccgattaggagaagaaaagtttttactatggaccactttaaacttcccataattattcatagcagcaattcttttgttgttcaagtttgaatactgatctctagctgcaaaaacacatacctctttatttttctttctactaacatctttgcaggacttaacgataatttgcttcgtggcaatagaaagattttcagcaaacataaacctcttcccatcaagttgggtcgcacaaccatgtgcattcagtaactcatctctgataatagatgcactccacgaagaacgtatagcctgcttcttggaagccttaaaatcttcacctacaatagccaacttctcaattggtgaatcatgttgttgacgcagcagcactttcatccccttccacgtcgctgtagatttgttcttcctgtagatttgaccaccactgcaaaacacgaaaagaaaatcgccgctctgcaaaatccaacatctgggagtctttgtagcatcttaattagcggcataaacatagatttcctgctagatcgaggaatagtagctagatcgaggagtctttgtgcatagcaccttcccaatcatagtagctagatcgaggaatagtagctagattgaaaagaaatcctccaacgcacatcttcacaatcatagtagctagatcgagcagtctttgtgcataatagcggcataaacatagatttcttcccgagccaatattcatccatcattgaaaaacagtagaaaaatttctaaatgaagaatgatcaacccaaagctttgatatcaatgtttttttgagcacgatcaggatgctattcacttcttgttcactcaggtctccgccgagtgatatgattttggcggggtcagagtcatctatctgcaaccagacaaccttgccgtggggacgggtttcagcgtcggcctggttctttcttgccgttcgacttctaaggtatgaactcccctgtcgaaggaggccacctatagatggccataaggcccgaggcccgaaggcccggcccatggcacggctttttggcccggcccaagcaccgcacggcttgacttgggtcgggcccgtgccagcctggcccgaccgccgggccgtgtctgggcctcccctccggcacgctgggctggcccggcacggtcaggccggcctggcatgatgggccggcaggccaggcatgccacacaaagtatagggactaaaaataaacatataaatgtcactgtccaaagaatagggaccttaaatagacttattttagctattgatatcacaacccaaagaaaagggaggtaaaatagactttttttagctatatatatgtcacagcccaataggagggaggaaaattagacttattctgaggaaaagcactatgggccatcgtgccttcgggccggcccggcacggccccaggcgtgttgggccgtgcctaggccgtgagtgcggcacgtgggctggcacggcatggcccggtgcgtcggtcgggccgtgtcggctcgacaagccttggcccaggcacgaccgggcctgggccgtgccgtgccgggtggcccacatggcgatctataaggccaccatggtagccgaaggatgggaacccttgacaactaccacaccggctgggctaggcatcttgagcttga

SEQ ID NO: 22398 - DNA, 1751 bp, Oryza sativa
aagatatgccgaacttcaataccaaccatctctgcaccaaccgatcctggtgtgggaaaaggactccttcagcatccttcggtctgaaggatatctgttgcgtcaagtatcttgggaccccttcgcctgccgaaacaatactatgcactgctcgaagttgcatctttttttgtcgtttcgacacttgcgagggggggataagatcttgtgatgacctagatcactcttcactgtgcatcttggcgctgttcagcctgaggtgcttggttgaggaccgcttcgcgcgttgcctcttcagccctggcttgctgctgcctgagctcttgagtgttgccttgctgccgaatgttccggcattgctcggttgtgtgcgaagagtgtccatgaacggcgtagtataggtctttcctgatctttttgcgaaaaggttgttgctggccgcccgcttgctgagcgtcgaactccttgcgaagggcttgcacttcttctcctgccatcactgctttgccagctcgatcagttctaaatttttccatgtcatcggggcatggttcggccttaaaggctgcccttgattcaccggaggggttgagtgaatcagaacgggtgccgaactagtaacttgggcttgaatttgagcttgtgcgtgagcttgcgcggtggccgtctcggctgcggctgttttgtcatattcggcttgtatctcttgccgccgcttggtatctttttcgcctcatgcataaccatcgattatgcgaaagaggtgttcgagcatccttggttccttgcgggcgatcttcctagtgagttcgcccttaagtaggccggtcgaagtagcgttgatgacagaggcttctgttatgtcttgcacttggcaccgtgcttgcgagaagcggcgcacgtattcccttgtcgattctcctggcctctggctaatgccgagaagaccttattgtgttttcggctcctcataagtgcctcgaaagttaagaacaaagacattgcgcaattgctcccatgagtaaatgctactagtaggcaaattaatataccaagatcgagcaatgccatcaagagcgaggtgaattaccttcgcctttgtattctcgtcaccatgggcagcttcgattgtggactcatagatggagaggaactccttcggatccgtttctcccgaataccttgggacatgagggaacttgaactggggtgggatgggatgattcttgatcccccaactcaacggcaaacccttttcgccatccgacttgatcatgacgccttgctgagaaggccagcttagctgcgggtacgggggcgcaaatgaggttgagcagcagctgttgattgatgccccgtgccaaacaccattggctggttttgttggtcagtcggagcagcttgcatcaccatagctgggtcgaacacgacttggttccaaacttgatttggtagtgggaccgctccgtagccagagggcacggcttgtgcgaaggtcatgggtgcttggaccgcggtgcttgggtcgaattgcggcagttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctaca

SEQ ID NO: 22399 - DNA, 3258 bp, Oryza sativa
aagaatttgaggaaattggaagacatacccatagtctgcgagtatccagaagtgttccccgaagaccttactaccatgccacccaagagagagattgaattccgaattgacttggcaccgggaaccgctccaatttacaaaagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcacttaacgaggtcacaatcaagaacaaatatcccttgccgcgaatcgatgatttgtttgatcaactgaaaggagctaaagtgttttctaagatagacctgcgatcaggctaccaccagttgaggattcgggaagaggatattccaaagacggccttcaccacccggtacgggctatatgagtgcacggttatgtctttcggacttaccaacgcacctgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatatgccaagttcagcaagtgtgacttctggttgacggaagtcaaatttttgggccatgtcattacagctcagggtgtggcagttgacccatcgaacgtagagtcagttaccaaatggaccccaccgaagaccgtgtcgtagattcgaagttttcttggacttgcaggttattaccgccgattcatcgaaaacttctccaggatcgcccgacccatgactcaattgcttaagaaagatgagaagtttaaatggacagctgagtgcggtaagagttttgaggagctcaaaaagaagttagtatccgcaccagttttgattctgcccgaccagatgaaagacttccaagtctattgcgatgcatcccgccacggacttggatgtgtcctaatgcaggagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagcattcactaccacccgggtgaagccaacgtggtggcagatgcattaagcaggaaaagttactgcactgccctatgcatcgagggcatgtgtgaggaattgcggcaggagtttgagcatctcaacgtaggaattgttgaacacaggttcgtagccgctttggaggcacggcctacgctcgtggatcaagttagagccgctcaagtgaatgatgccgaaatagcagagctaaaaaagaacatgagagtcggaaaggctcggaatttccttgaggatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggttggtcagcatgaggagagaaatagctgaattcgtcgcactctacgatgtttgccaacgagtgaaggcagggcaccaaagaccagcaggtctactccaacctcttcaaatcccggaatggaaatgggaggagattggaatggactttataacaggactgccccggacatcgtcgggtcatgattccatctgggtagtcgtggatcgacttactaaggttgctcacttcataccagtacataccacgtatacgggcaaaaggttggtggagctttacctttcgagaatcatgtgtctacatggagtacccaaaaagattgtatctgatcgagggagtcagttcacctcaaaattctggcagaagctgcaggaagaattggggacccatttaaattttagcacggcctatcacccgcaaactgatggtcagaccgagcgagtcaatcaaatcctggaagatatgttgagagcttgcgctctcgattttggtggagcttgggacaaaaacttgccatatgcggaattctcgtacaacaacagctaccaagccagtctacagatggcaccgtttgaagctttatacggccggaagtgccgcacacctctcttctgggatcagacaggcgagcgtcaactgttcgggacagaggtattaacggaagcggaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccatgcttcgtgggaccctacaaaatcttggaacgaaggggagaagttgcttatcagttagaacttccatccaatatgatcggcatccatgacgtgttccacgtgtcccaattaaagaagtgcttaagggtacttgaagaacaggctgattcggaacacattgatatccaggaggatctaacatatgtggagaagccggttcgtatacttgataccagcgaaagaagaaccagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtataaggggggtaggtttgtcacaccccgaagttctcctcctaagccaaaaatttaatttataagcgaccctaagaaaataccagtgcaaagcaagagtaaacccttttaaatcaatgcgaataataatcggaattggcatgtggaatttttcttgagttctacatgtcgaaattcgctaacaggatttttagtggaatttttcagagccctagaaataattttaaccagttaaaattgagcaagcaatattttaattccaggaaatccttttctcctttttctttttctttttccctccctttttcgaatggggcg

SEQ ID NO: 22400 - DNA, 18754 bp, Oryza sativa
tctaccatgtctctttgtcagcttggggttataacatgactagagattggactagggattgcttagccatgcttagttcaactagtgcacaatggggaaaaccttattaatgtttagactgttggttctaatggtattgttggattagtgccaccgctttgtgttggtgtgggtgcatggttttgctggtcgcatccatggcagttaaggaccggttcgcgggatgccctggaagaacttatcgtacttatcacaagccagcgtgggcaacggctgggcttgtagtgtagctttcctctagccgacgcatctaggcaagggtgggcgtggtggagttcggatgggccctgcgacggcctatgcggcttccggattcacctaggcacgagaggggaccgcttgcgaggagtgggggtgaaacctgaggtgtggtgtgcttggttagaggggggttatgcgaagggtcctgtcacggcctctttctggtatgtcgtggtggcatgtcggcgcacgggaacgtgtcgtggggctgtgtcttgtgggtacagttgtacacctttgatcagagtaaaactattcgaattgccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaatattaattaattattacaaccgtttaaatctttcaacttctgtttataaatgctcattttatgcaaatgaaccactctagctctcctttgataattccctgcatcatacccctattccggtatgacttgctaagtacaatgggtagtactcagtcttgctctatttttcccaaccccagagcacgagtacgtgtcagatgaaggtttctccgaggagtaggcttcgtccgtgccgtcgaggatgcctatggagtggtgttcccgctgcagatctagtcaaggctttgctcctgttgtcttttgtttttctgctgcatttatgtaagtcttttatggtgtttgtaagacgtggatctgaatgtcaatattgtcgtttgtgtaccccggccggtcctggacggagaatttaatgcacattctgcttagaattctattcgggaatttctgggcgcgacatcgacatcgtttgattgatttatcgtttgagttgatgtcgattctcctccactttattgtcattctctgcaataggttagtatacctaatactagtggaatattattattctaacagatatatgcattgcaagcatcactagttctcctctattttggtaatattgacggtcaaaactaattgataacgaccgtcaacagtgatgtgcatggaagctgtgtactaactcactaaatttttcagcatagctaagcacatacccagtttggcgtagcctattaaactgtcgaattagagtttgaaacccctcacgcccgaacttagcacaaactgcctcacagaattcaccccaacttatcaaatctacgtgagcattagtagattgcaaccaagtcaaatctccacctatgaactgcaaggcggctactcccacccacacatctgatctaataccactcacttggaagtaagtctcacatttcaatttccatgctctaggattctctctatcaaattgaggacagtccactcacggattcacaccaccataaggaaatcccccaaaattccgccccactgaatccccaaaatcacgtccatttcgagaagcaaattgaggagtaaatgtacccttgcccgggagagacaatggagaggtattctccccaatcgcctttccccggagtgaaattcccgcgcggtggcctaacggcccgtgacccatgtcaccatgacttggacaagtctcctcctccttcggcagcggacgagatcctggcgatgtgggaagcagcggcggccgctccgctggcttgatagcactggcttgctgttttgagagctgattcacttgatgacgcaagtccccaatatcctctcgcaactccaccaccgccttgtctatggttggcttccaccccgctagctccaccaccatgggcttgatttcctccaacaaccccaccgaagcttgagctacgcacgagaatgatagcgtggtttctccaagtaatccaggatcgattgctctgatacctattgttacgaactctgttgatttctggaaagtttcagaggaagaagatagaacagagtcgaacaggcgaagaacacacacacagagagagagagagagagatattcagacttggggaaggggaagaagtattcagtttaggagatagttcagaatacaattcattcgacctcttttcccttccacctactgcgcttatatagccgcgcgaatacatcagcccatgatccattccggcctagcgattctgacattggcccacttgatacgcttaggtcgaactcgatgcttcaccaggttctcctctattgtcggattgtctacagtagacgtatgagtagtcgctgccgtgagactaacacactaaaaaatacatcttcacattggatttgaatttaaaatcacacacgaaagctatgaaggctctctcacaccaaggtgtataggcgactcaaagggagacctctcaccaagcatccaccccttattattgtccaatgtggctgaaatcccctaactaagacaatgtcacaaatgctcttagggcaaaacactagctcagataaaatctgggccatccgttgttcctccacttcaaaggaaaagcctcatatcactgacatgtagctagccacaacatgtccgccacaacaagtccaccttttccacggatgatccgcgccgctactacccacgcatgccttgggatcaatctcgacatcgcgcgccccaattaccgattgccacggctccgcctttctcctgcatgcgcgtgggccctccagccagtgggagatgccgcgtgcgccagtcggaaggagccacatcgcctgcgctctcccgagacaaaagccgccgggtggccggtacggccccacgcctcacgattggaggccacgtccactccgagtggaccccatgcccgcgccacgttctcttcacgtgccgtcctgggtgggctcacctgccaactagaggaagatcccaactagttggtgccatgcgtcccgtgctcttccgcttgagcctgcgtgcatacggtgttgggccgtgctaggccaatccggtggtgggagaggaggttgtcttgggctccagtgcttggcccgcctccctctttctctgtgttttcccttttcttgttcttcatcaattttcttggcacacttgacattgtgtagtctgttgtgaagtccttccaccacattatttatccagcatgcaccgtcttgtactcaactttgttacccgacatccttggccgttttggacttcgactcctccctgagtttagtctcgatatgccattaattgaccaaggttgaccgccaatgatcgtgacgtccgtacaaccctgtcacatagtatcccaaccacacaagactaatactcctccttgagcatagacctagttatgccattggccaaggttgacttgcattacctatagacatgtaaacgaccgttgtttgtgtatagataacgcaacctgacccacgttagtccacgtacacatttcctgtacttccagcacttgccaattttccatcacaatgaatcaaaaccacacgtggtttcacagtttctcatgtgtggtgataagagctccaatgacttcgttcccatcacctttgtgcttgattgcttgcttgtagactttttcctttccacggcaaggttttccttcggctgcaggcagtcaaaacaatggtgggtcgacgaacggtgtaaaacttgaaaccatatgcatgactaagacctaactatacacgacgcgttggacaaaaaatgaaggatgtaaaactgaacaaaacaatgctaatcctgaaattaaagattattgatagctgtcactatagttttagagctgttttccaattatttttgtctttgataagtcggatttatcaaagcatggatttaaatttgcaaggccttctgaccgaattgctaaaaaaactgtcacaaattttttgggcaaaaaactataatgtataactatagtatctttatagtgtaactacaatgtataagtgcactctaaaggcattgtaatatcaatataagttagatataaagttgtatattttattttaatatatattatatagttatagtataggtataatggaagtataattgtagatttgaaagctttttccataaaatacttgcggcagtttttagatagtcccttaaattgattgtggagggtaaaacacatgctctatatatcgttatcaatagtgacgggtctggttaaccagcgcgtgcaattagttgaccggtattttgcacgtgcatatactctacatattatacgaatatataggaggtcgtgtacgtctttaacaagccacgcagtgttaaaaaagaaaaaacaaagccacgcagtgttgtttcagcagagagagagagagagagagagagatgcgttcttccagaggtgtcattcgccattccgtgtggtgtctggtgtttgtatggtcatggcgggttgcagcagctcaggatcaacaagcaccaaaaactgatccagtcgaaggtaagcaagccagcaatcatgtacggtgtgtattgacgcaccacgtatgtctatcttctttcgttttttgacatttacatatttaagatgtgaaatttaataaattatcatctatagtcgatgacatgtgagcactcatatatcaataacctaaaagtgacgaatagttaaatgtctcttggttttcctccatgcgtatagttagattgcaggagtagtaatttgtggttgtgctcgatatatgatgtccctcgcactactacagaacacctgttagagcacctgttagagcatccccagtagatactctctcccgtcctccttacatgaaatagcgtatggtgggagaaaatccacctctgtagcggatacgccgtttgggcatccaaagatagctcatgcgctatcccgaagagagaaacgccggatatggtctttctctctcctcacgcaattccacaactgctgctcccaccctcatcagatcgagctatggaggggtgaaggaatgaatgtagagaagagagagaggatgcgctagtggccaccttagtcggccggtcttgagcgtcgccccatgatcatatgagccggccactcccgacatcggtcacatgcgcctgccctgcacccaccgtcggccaaagcgccacgcgcccacatatccgactctgccctcccccctccttctatagactcctctaagtaggcagacgcccgtggcatctcccctgccgtcctcactgctcctgcgcttgtgacttctccccccgccacccgtgccgaccctccgcacgcctgctcgcgccgctcctccgcccatgccgccaagccacttctctccccatcgcgcgccctgttactcccacccattgaactacccgtcggtggtcagccctcctcgtatgtccttcccatcctctcaggctctcagcattggatatagaagagagagaaaggtgaggaagtttttttagaggttgaattatcaaatttctcaacagttcttctcatacattgtctatttttgatttttgggagtgttgaaaggtagttgaaagatattagtaaaatataggtttttggtacatggagaatgtaatatgaatgatctattggaatcaaaaggaaaatggagtaggaaacatttttgaatggccatccaaatgggaatatggaggatgaaatttggataagctggggatgctattagggaatgatacatgtataggtgccggtttctattgagaaagagttagaggaatttgatttcattaatgacctagctatcatccatatgattattagtggtgagttaattagtaaacatcatccatgaatgcagcggtggccctgaacacgatcatgaggagatggggcaaggaggcatcatcggagtggaatgttagcggtgatctctgcagcggtttcgccgctgacaaaaacgactgggattactatcccaacatcaacccattcatcaaatgcgattgcactttcagcaacaacacactatgccgcattacaaaactgtacgcacactctctttgggcaacacctaatagctcaagcacatttttttataggtattacttgtctgttgttatgaaggagggtaaataagttggacgtggttggtcaaataccttcagagctacagaatctcacccgtctagagaacttgtatggtatctaagtctttttcttcttaactagtcctgctactaaagttacgttatagatcaagtttttcacagactaaaaattcaatcacacaaattctctttgtgaacagcagggtacatttcagtcagccatgcaacatcctttttatgttggctaattgttctacttttttatgttgttttcagggacttgaactataattacttgactggtttcattccatcattcatcggaaaattcacttcgatgaaatacttgtaggagttacatgttctatatcatgtttcatccattgatcgttattgtttcttaactattcttaattatttaaagggcattgggtttcaatccactatctggaccacttccaaaggaacttggaaacctcaccaatcttatttcattgtaagaaatattttctcatatgcggattaatcttcagctgctccttctgttccaaattactcatcatttttccgttgtcctatgtaaaatatcaagaagttgtttttttaaccaattgagtatgaattatatattgtcacaatatttctcatgatgaatctaaaaatatatatataaatctaactatgttaaactatactcatttgtaaaacttgatagccaagagtacatatatttgacttgcaacaaaacttgaatagtaggtaatacgaaagaaaatggagtatataaactactacataaaacatcataggtgtcagttttccaaccggtaccaggaagacagcactgattacccggggtcaaaggtgccggttcgaaaaccagctccttttaggcgcacacgagcaaaaaatatcagctcgatacattgagccgtcaagccgatcccaactaaaacccatatctaaaaattgcctcaaatccatgaactatagtcaataatccctagaaaaacaacacaactagatcaaataatacacatctagatcacatctacattagcaatagctcacatctatatcaacaaatcacaaagagggagggaggggaagagacggatctactggctgccgacgccatcgcacctcctccacaccggctgtcgttgccgcgccgcacctccagcctgctagatccccacagccgaggggccagcaccaccacaccaccagatccagcacaggccgcctccgtcccactgccatgcccccccccccccccgctcccgtgctgcccccgtgatggatggaggagaggagaaggaagaagtggagaggaagatagaaggaagaagaagagaggaggaagaagagaagaggaagaagagagtggactggtgggtggtggtgtggtgggttcaagcacaccggttcttctcggctcgttttactgaaaaaccatcacctataatatattttaggtgtcggtttttaattaactgacatctatattatacgtgtcggtttttctcaaaaacaagcaactatagtcccttaaaggtgttagttttttatgttttcagcctggggaggtgggaaaaacactatagttaccggttttagctagtctggcacctatagtgttgatcgtcacctataatatattttacgtgtcgttttttaattaactgacacctatattatacgtgtcggtttttctcaagaacaagtacctatagtcccttaaaggtgttagttttttatgtttttagtcctaaggaggtgggaaaaacactatagctaccggttttagctggtatggcacctatagtgttgacctgatgtgcatttttttgtagtaagtgatatttggactccatgaactaatataatagtacaacaaatggcaatcgcataagttcgagcaataaagtaataaaaaaatcataactactactcagtactaaatattatgtaataggcacgtcaatgtaacttccctgttcatgtgttgtttcaactttcaaatgatcaactaaagttgatcgaacagcaaaaacatgaacatattgtcatgatgaatattgcgggtcaaatggcacatcgggaaaaactatgccccttcctgctattagttgatgataataatttcttatcttgaaatattttattttcatttaggggcattagcttaaacaatttcacaggtggccttcctgaagaactaggcaacttgaccaaacttaagcaattgtaagatactccattgatttctaacttcatatttctatttctataagaattaaaatttggaatggccagatctattgttgaacatgacaataacaaactttcaataacaggtacattgatagttctggattcagtggtccgttcccttcaacgttctcaaaacttcagaacctgcagatcctgtatagtcaaaagcatagcctcagctgttatattcgtcatgctttcatgataaatgacattttggtgtgcttgcagtctagcatcagacaatggattcacagggaaaatacctgattatttaggtagcatgactaatttggaagaaatgtaagattattaatattaacttattaacatatctcatatgttctatcctatttttgagagagatgaatttgtgcaagataaattattctgtatatcatgttctttccattcagacttataaacaatagatttgctccgctccaacaaaaagtatctcgagataccggtacctcacagtaccaaatcgtttttgattttttgatctaacaatgctcatcctacctagctaaatctaacgatcataaacgacttattaccatgaggtaccggtacctcgatgtactttttgttagaccgaactaaatttctataaacaattgcattttcacatttcagtcctcgctagatagaaatgaataaagctgcatcacagtaacttgtccaggtggcatatacatacgtagtgattttattaagactggtcacatatagaacttttatatctttttcttattttaaaatgtgcaatgccctttttctaaaattatgagattgtagtgctttccaaggaaattcatttgaaggaccaatcccagaaagtttgtctaatctgaccaaattaacaaccttgtaagtatactctttaggtgacattgtatactcttgaaggttgataatgtcaaggctgataactaatttatgaaaaatataaatgagcaggcggattggagatattgtaaatgggatctctccattggctcttatcagtaatctgacttctctgaacaccctgtatgtgatgatttcagctataaagcttacagtatattgtctagttgcaagttaccacggttggatttcattgttacagaatattgaggaactgcaagatatatagtgatctcggagcagtagatttttctatgtttgaaaagttaagcttgctgtaagttttcaattacaggccatggtgccaattgatgatattattaatcattaactcaagttctgtaccatatgttcaagtaatatggttgtcatgtggtacagggacctaagttttaacaatatcacagggaaagtttctcaatccatcctgaatttgggaaatctacagttcttgtaagaaattctttttacattaatttgttgatagaagctcctattaagcagatgaacatgttcgatcatcttgaattgtgcccaattcaggtttcttgggaacaataaccttgcaggaaggttgcctgatggtataagctcttccttaaaagcgatgtatgtcaaatacaatcgacatggcattatagcacaatttactttcataatggaatatattaactcctgtataatctaattctgtaatgtttacagagatttttcgtacaatcaactcactgggagcattccttcttgggctagccaaaacaatttacagttgtaagtgtaatattatgatatctgtgttgctgagaaaaaaatagatattctaatattctgttttgtgaaaggaatttggtggcaaacaactttttactcggtagcaccagtaacaggtacatactaattgtgacatttagttctaattttgctagtgcactatacgaatttagttctaattcttataattttgctattgcactataagaatgcttgctgacaacttaaattttcaatccaaatttgcacagtagactaccttgggggctaaactgcctccaacaagacactccttgtttccgtggatctccaaaatgtacatttctcaatcttcattgaaccaaagacaataatatgagctaaggaattttaatgattgttacaattttgtgatcgtagattattcttttgcggttgactgtggtagtaatacatcaacgagaggatcagataataccatttatgaagcagatcctgcaaatcttggagctgcaacatattatgttactggtcaaacaagatggggtgtcagcagtgtaggacactacttccgggccacagatgcaaagaacattatatatagttcccaaaattttaacaatgtagttgattcaaagttgtttgaaactggaagggtgtcgccatcatctctgaggtattacggccttggacttgaaaatggaaattacacagttctgcttcgatttgcagaaattgcttttccggactcacagacttggctaagcttagggagaagagtttttgacatatatattcaggtaccaatcaagtgcattttatataatgtttttctacttaatcttatcattctttatctgaaactattattgacatttacatagggtgctttgaaagaaaaggattttgatataaggaagacggcaggtggaaagtcttttagcgttgttaataggagtttcatggtaactgtgtctaaaaattttctcgagatccatctattctgggctggtaagggcgggggaatctatgggccaatgatctcagcattgagtgtcactccaagtaagcgaaacattatatatagtatcaggaagtgctacaccagctgccaagaaataatattattcctttgtagattttactcctactgtgcgaaatggcataccaaaaagcgaaagtaaagtaggtataattgccggaatatctattggtgcaatagttttagtattagcagcattatttggagtgtttacgctgttaaagaagcggagggcattggcatatcaaaaagaaggtattatttgttagtacataattcaaacatcaaaattgtcaaatgaataatcttctcatctgtcctaaaaataacatgcagaactgtactatttggttggacaacctgatgttttcaattatgctgagctcaagctagccaccgacaatttcagttctcaaaatatcctaggggaaggtggattcgggccggtgtataaggttcttgtttcccataattaatcatgtacaattggatataaattaatgtgatttggcttttgagtgttgcattttagcaatattttgtccatgctcaaaatatacatgtaacaaatttggcagggtaagctacatgataaaagagttatagctgtgaagcaactttctcagtcatctcatcagggggcaagcgagtttgtgacagaggttgcaacaatttcggccgtgcaacatcggaatcttgtgagattgcatggatgttgtattgacagtaaaacacccttgttggtttatgaataccttgaaaatggaagcttggatcaagcaatctttggtgagttcacatctgcaaaatagcatgcacacctgcagcactaataaaactatatttgtttaattcacaaataaatatttttgtttcatgaataatagttgaggattttgcctttttctgcattttgttataatttgcattcatgatattaatagagctatttcttcttgtaaaggtgacagtagcttaaacctagactgggtaacacgcttcgaaatcattttaggcatagcaagtggtctaacttatcttcatgaggagtcaagtgtgcgcattgtgcacagggacatcaaagccagcaatgtcttacttgacactgacctcaccccaaagatctctgattttggacttgccaaactctatgatgagaagcaaactcatgtgagcactagaattgcaggcacattgtaagaacattttaccactgatcttcttatgattgtaacatcaatatgaatcctactattaacttgtcttatatttttaaggggctatctagctccagagtatgcaatgagaggccatttgtcagaaaaggctgatgtttttgcatttggagtggttatgctggagactgtcgctgggcgaccgaacacgaacaattccctggaggaaaacaagatctatctccttgaatgggtaagctggtttacaaacaacccatataagaaaacatcaattcattgtgtattttcattcgtttactgaaactatgttcaacaaaaggcatggggcatgtatgacaaggatcaggcgctcgaaattgttgacccaactatcaaggattttgataaggatgaagcttttagagtcatcaatgttgcacttctctgcactcagggctcaccgcaccagcgaccaccaatgtcgagggtcgtggcaatgttgactagagatgtcgatgtgcctaaagtggtcacgaagccaagctacatcactgagtggcagctcaggggtggtggcaacaacggtaacacctccaatagctatgcaggatccagctaccagcccgaagttcagtagggaaaagatatcaccaaagtttgtctccattgaaggtgaatttatagtagaaattatccgggctatcgacattgggttcaaatgacaatattgtagatcccttttttaacataattttgtgtccgcgtgagttagagcaaatattggaattacttatcctgaactctttcatggtaataataatttgcttctaataatttgtaaatagtgaataaccgtggtgtatttactacttaaaagaagctagtggataacccttaatatgtaatggccagtgcaacgcttaggtaaaattttgtcctaatatttatgcgcactgttatggtatagttatacaatgcagtaggtgtattgtccactttttaacgggttaagctttgtattcaaatctatggggacccccggttttaaacaccggtaatcccatgtgtcatatagtactattccctggataagtaagtagtacacacatagcacaatataatatcacaactgacatcgtttacaggtatttctacattaataatacatgggtatcccaaacgggtcccaaaatagaccaagcatgctcacatacattacaaaatgccaagtaaaataaatgaaacagcggaagcaaagcggcggcggtccatcgaactccacaggcaacgtctcgtgaacctatggtccctaatccatcgtcttcgacacgtacttgacagcagcgttggatgaatataaccgactccaactcctttctaaaagatttaattaagcaagggtgagtacatacatacccagcaaaccaccacttcaaaatgaatctaatgcacaccggggttcaaggatggcttggtttatttgcataaagctagtttttacaattcatttcacaaacctatgacctagcagttttaactcgaaaacaacgttaacgttgaagttgtaattatccagggttcatccacctctccaagcctcgctcggttcagtttaccctcacattcattttatagcaactctatcataccaaccttcccacgggttgggcaaggttctcatgtctcacaatttctacactaagcaatattaaaatctatgagtctagtcaagggtagtataggtcccggcactcattaaccgcgattacggctattcgaatagattggtttactcacactgtattagatgtacgctttttatcccgcactccgcggcttgcacaatacatgagcctagtcccaacacatgagacttgtcacggcccgacttttcagtcgctcttgcatttggcactcgctccaaggactatgagcccccatgcacccctacagtccaacctacctactgccggatggtgaggggagtcctggcgctccagggattaggagatatttactacatatatacttatagagtgtattttaggttttacgtgtgcttttacctttccgacaccggactcatccacatcgtactcatacagaacctaccatgactggagtgtcgccccacaagagcttcctagtccgtcggtctgcccatacataagaaatgcaatcgtactcggttcatttcccgtataacttcctgactcggtccttaactgtcgaaggtcagcgactaaccgtttccaaaaccactcatattttactcatgccgccctagtcgaaatagttttgttttattaagttttggttttcgcaaacggtttgtgtgtggtaggtggcgctcatgtctccacccgcaaatcataaatcactcacattgagtgatctcacatccatatccatataatctaagtttggagtgtacaaacgtctacaatagcaatactaagcaatgtcaataattgactgcgtataaataaatagacttaggctacaatggatataaaaaagtgtataacggtaacaatatcaagggtaggcgatattcaagtataggtacgcaatttataaatagcatgcaattttatttgcaagcaacacatttataaatataggctcaatatgttcaaggaagggagcgtagtgacttgccatgctataggtccctaatgccttcgagagatctgtatcagttagatgattagaatacccacaatcgaagaataaccagaatattcacgctcgataaacggcccaagaagccacacataatcctaaggaaataaaataaagcaacattcaatacaaactatgtgtgccattaaatatatctcgattttagagagattgtggaaattgaacggagtcaaatgtagttatggttcacaagataaacggagtatcctttcctctcctccttcgatgcagctgaatatttactaaaagttatatttcgctattgcattccagtagttcttgtccagagcatgctgaaagcctttggttgcaatttcagatccattcggcaatttgccctgaaaatacttaaattgtcagtgagttcacaattattatttgctacaaactgttccattctacaataagagagcaaattaaattaatctctaaactgaaaatacaggttacacctttctgctcacaatcaaacttcggactatattagtaccttataaacggcgctaaaatcaccttgtcccgcttatatttacttgtaaggtatctatggcaaaactcctggaaggctggaaggaaagcattaggtgagtttttccagttccaaatggaaaagatctagaaattgaatagatatttgaagataatatgtatatctcttatgtttttccacctctttttataattgcaatgcacaggtaatgacttcttctcatgcacaggtaatgcctatattgaaccatattgtagaaaagagcttcttatcagtattcatatctcactgaaacctccctatacaaaatgaactctaggctagttttttactctgtcaggttaattttgtaagaaagattgcggagcattagtgctttgagatccttgatatttttacagtagtatcagtgatattttttttacacaaaaaagtattgtcacaacaaagttttgtcaggtttgaaagtgaaacctggagcctctcatttctggcaaggaattatggatgtgaaagaagtgttttataaattctgtactaatgtagtaggcaatggaaggaatactttgttttgggaagataattggataggaggtaaacctttggctgaacagttccgtgatttgtacaatattactttgacaaaaaagattactgtggcagatgtgaaacaggtggggattgactctattaaattcagaagagatgtcctggggaataaactgctgaaaattaagcaatcctggagtgatttggttctggaagatggaaccagagatacacttcggtggaatttgaccaaagatgggaaattcactgttaaatcctttcacacagctctgaagatgcaacaggtgattttcccgcataaaaagatatggggcttgaaagtgcctttgaaaatcaaaatttttatttggatgtttacaaaaaacaagattctcacaaaggacaatcttttcaagaggggctggagaaaagggaaggctaattgtcaattctgtgaccaaacagaaactttacaacctcttttttattgccctttagctagactgttatggaatattgtgaaatgtgcccttaatataaattctgtgttgaatagacaagatctgtttggatcttggatgaacaagattgataaatttacgaaaaaacttgtggtagtgggtcttgcggcaataatatggacaatctggaaatttcgtaataaagcttgttttgagaaaaaactcccagctgatcctactgatctggtgtttatggcttgctctttggtggactcgtgggcaactttgcagaagcaggagggaagtcgaagaaatcttcaactgggggccaggttgctaaaacaagtggtaaatgaagtctacaactcgaagctcggctggagaggaggtgttcgaaggattaggtcataactcaggagaggaaatgtttactgagtattttgtgtggatggaatgagcaaagatagctctgtaatagacaatctagctatggtctttgtttttttcttttgcataagggtcggatgtcctccctcagatgttttagtttttatttttctgttttctgtttagtactctggtagtctgacttgatctcatttctagtaaaagaaatgggggcttcatgccctagctcaaaaaaaaaaatcagtaattaactcttcagggatcaaaataataaagatttttgaaaactgcgaaatacaaaattgcaagtttgatctgaaactgcggtgaataatccattttgcattaacattagtgcagtacatgttatcatagctatgtagtggaatttggtacttctagaagatcttaaactggatgacaattacaacatcaacaatgtatagtctggataaaaaaatggattcaattatgcagttcagcatattcaactctacaactaaaattcactgaaagtatccccttacctttctatatgaacagaaatcaactgcaagggtgagaatagaatgcaggcttgcgctggagcatggcaatgaagataatttgtcgctcagcattgctgtgcgagtgcacagaggaagatatagtggtagacatgggaggggaaagtgaaccgcggtgggcccaggggaacttcaacccagcggcatggctgaagaggagaggaggatgtgcccatgaatggtatcaatttcatagggctcgcagcatcgctgaacatttggtgattgggagcgcactgatgttcgcgggggagaccagacgctgtcagcctggccagatttttttttaatcccccgtggggtgtctttgtattaaagaagaagagaattgacccagtttataaggaaaaccggacccgaaaaccatacagctgcacggttaattatgggaaaccggctgaaacccactgcacagagaagagaaagggacctagctacacaactaacaaaaacggcggagcctaaccacaggatgttgctgccaatctaacacaaaagcaacacaacagcttcgacttcacagaagaggtgttatcattgccgagctaaccacccaagcgatccagcagcgccggcttcacaactgcagcgataatgaagcgaaagttgccaaagcgaaaagcatctccgacatcttacaatggacatcagccaagccaccaaagagccacttcattcacacggctagcaccaactccctggaagagactgcaacatgtcatcgttgccaagcgtcgctgcatccatcagcgagcagctccgacttcataagcagaaacagccgaagagcgtgttgcccaccgcaagaacaaagcgacccaagaaggcgaagggcctcgccaaaccccaagatatgaaagcttttaaacccaaaagaccatcaacagtcgtcgattcataggaacttctctgaagcgacgcccccaaggaggacatgacgtgtaacactgctgccgctcgtccgaaagccggaacaaggttttcacctagagatttgtgggggatataaaagaaacgcccagacaatgcctccaagaaggaaaacggcacccacgggcgtcgt

SEQ ID NO: 22401 - DNA, 3319 bp, Oryza sativa
aaagatgggctcatggccaccctcgaagcgccatcaagacaagccccattcctgcttcacgccagcacaaaccgtcgtcctgccaactccacatcctcacatcaccgcccacgaaccatgaaatccgccaccggcccctgtcgagcagggggctcgctgccagagtgcaaccccaccggagcccgcctagcgacgccgtgcagccgccgaactcgccgcaacgtgcccgagccgcgggcagccagatctgcctgcggcagtcgcccccctccggcctcatccctccggtcgcatccctcgcgccaccgccgtccggtgggcgagcatcaatgatgcaagaggggaggataggcgccactgccgccgatgagttggtcagccaccaccggtcgtgccgcgcccccgccggtgctaaggccacgatgaccttcgtcctcgcgctgccgacacctctttcgcgtgaccgacgcctccttcttcctcgcgcacagtagcgcaacgccgccactgtggcagcctccaccgttgtcggcctcacctcctcgctcgtgacgcaccgtgctccgtcgttgctggctgcaccgcctagccgtagccgcgccagccagtgccgccgtcgccgcacaagttctaagcatgcctccgtcatccgctgaggccgcgggcttccaccgcgctcctccggcgtcggccaccttcgcctgccggccacagccgttgcatcgcccgcctcaaccagctgtcgtcgcagtggacagtcgctggctagatccgcgctccggagggccagatccaccaccggtgtgctcggatccgttgcggctgacgccccgttgactgtcaccctgtcgcccgccacggccgctgacttccgaccggcacgcaccactctgcctcccacgaggctggccggatttggtgccattgagtttgttgcggctggatctgatgagggatgcagcgtggcctggacagggaggcagcgatgacggagacatggacagtggaggagccaaagaggcaagtgtggtggtgaggggatgcgactctactgctgcggcggtgcggcgatgggagaggacggcgaagtaggccatgcgagaggagtcatggaggaaccatggatgggagaggaagggtggatgaaccaaaaaggttcaattctagacatattgtggggtggaagaatctaggttttattgaagtttcatgaaggatcttcatggtcttttgccatttgagccatccgacggttcatattggctggtgataacatcggacggctcaagttttcttgatgacgtggatacataattttgcgagaagacacccctttcacttatttagattatattgttggattcgttacaactacataacaacatttaagaaggctctattccgacaatttttttttactttttaaatgttgcacatatctttagtgaaatatgcaatgttccaacaagtatctattgatgtttcactatttcatttgcaatgttgcacgttatctttttatatgtctcagcaattacaattcgatgtttcaaaatcaaatatttgcaaatgtattgtattgtatgaattttttagtgtttcactagttgggacataatatttcatgtaataacaattattgttgcagtcaaaactttttatatgttgcatctctataaaacatctgcacaagtgatgaagcaatttttttttgtaaatgctgcaacaaaagtttgatttttctagaacacacatatatacttttataaaaatatatttatgtgagatcttgttataaagatttaagtatgacaaataaaatggtataattaaattatagattggatatatattttagaagaaaactttgtttagagtttgattaaaaatggagagagaaagtaatgatgaatcagtgcaccttggtaaccagccttgctcctctatgcgtgtgacacatagtaaaaaaacaagaccggtggttgacccgttctgatcgtcggttcaccggtcgaaccgccgggtcagacacaactagccttgctcctcactacatgcatgctacagacgtggccctgcatgcgacaaatgcgtagcagcatacaatttgtagctttctccccacatccatgctgggtgccgacccgttactgatgtacatagttgtaacggttgaactcttttgaacaatcagtgatgtgaaaagaaaatcccaccggtttatcgacctagacgtgccggtccttccactctcggtcctcactcattgtcagtgcctccaccaggccaccgcttgatgtgtcatgcccacagccaacattgtgaaagaggcgctgtgaagagcacatggccagatctgttgctgtcatcatgccggccttgtgtcccgtcatcaaagctaagtggaggatcgatctataccaactatagagaggtgaatggttaaaatacccaaaaaccaaaacttttagcagaattaaaagttaccatcaaatcgatgtaaatcggcctgaccgtagatcttgcaccgctccactactgtagaactgatatggattaaagatcatttgtagtcccggttataaagtgcaaccggaccatataatatttacttccgattggtaacacctattgaaattaaagatgatatttagtcctagatcactttatgttaaggggctgtcaggggccatggcatctttagtcaaccggggctaaaaatcatgactttagatctttagttctttagttcggttggtagcaccaaccggggctaaagataaaaacatttataacattcttcttcctcttccaacccgagcaattgctgcaaagatttgtaggaggaagggaggtgctgccaaaattttttgtgtaagtgttttggtgataatatacaaatcagagggatctagaaggttagcaactctcgaatgatgtatgcttagcatattacatttatggaaaaattcgctactatacattaaaaaacgtgtatttagctggtggacatcgcaaaaacacgaatttggtgtcgggcatcacaaaaaatggtaattagctgatggacactcgcagccatatcttattatttccgggggaattggaaagagaaaatgatgtgagagtacgattttgcccctgcgcggcttcaatccatcaccgccatcgccgaaactggtcgtcgactacgccgccgctactacttcctcatgcctgtagtaccccaaggcgctcctattccagtcgccgcggttgccgagaccgaaaacgcgatgtagtcgaatcgtctccacctccccttcaaggacagcgcccg

SEQ ID NO: 22402 - DNA, 3030 bp, Oryza sativa
cttttggccatctatactccccgacgacgatgacgacgacgacggtggacggcgcccgcaccgccgtgttgtccccgtgctagcgccgctgccgcatcaggcctctacgctgctcatcctcgatgacaccgacctcctccccaacgatgacgatgacggcgaggaccggacggcacccacatcgtcgtgctgtcccgtgctgtcgccgcatctgggcgctgctaagggcacccatcgtcgtgctggcacccgcatcgtcgtgctgtcgccatgctcagtgttctcgctgccaagggcgtccaggagctcatgctgctcagcgtgctggcgtcgctcctttccttaccagagagcaagttaccaagggcaaatttatctttaaagagtgtttctctctccaattcctccaaaaataataaaataacgcaacgagtgtccatcagctaatttccagttttttttttgcccaacaacaaattcgcgttcttgcgatgtctaccagctaattacatgctatttggatgtcctatagcaaattttgcctacatttatagctatgttttttatatattattgtgtctaaaaaggttgatggaaaatgatgagagagaaaatttgtttagggaaaattaggctacttttaaaatataaacatgtggataaaatgttgtaaaagagataacaaaggaaaaatgtagaaaattaagataaaagaatagaaaactaagttaatttaataaaatagttagaaaaagtacaatgtattaaagatatgcttagaactttaaaaatagttaaaacatgaataatatgtgggagtattgtataattattgtacgattatttatatataattattgtatgattatttaattagtttgactttcgtggattttatttttacgatttttgtgcatttcaggtaagtggatcggcaatgtgtgtacactgtggaccgatggtcgaaagagtttatagaaggcgtgtattattttttgagtgtggccaatattaacaagcataagggttttatgtgttgtccacgcaaaaagtgaaaaaaccagaaggagtattctacatcaagaacatttcatgcccacttgtttcagtcggggttcatgcctagctataattgttggacctcacatggaaagctaggggttgcaatggaataaggtgaactagaagaagagaacatttcggactgtgcgcctcaataaggtggatttcaaaaaaatacaaagggcgaggcgaacggggcttttgaagataacgatagtgtggatgatcttggtcatatgttgcacaatgtaaaggaggactgtgaaagtgaaaaggtggtccagaaattggagcgtatgttagcagaccacaaaacgtcattatgtcctggttatgaacaggggcacaaaacgttgggcaccacgctagaattcttgcaatgaaaagtcaaaaatggtgtgagttacaaggcatttggcgagttattgaaactcgtaaagaacattattccggagggaaacagattgccctaaataacattcgaagctaagaggtagtctgccctctaggactggaagtacagaagatacacgcatgtccaaatgattgtatcctctatctccgtgaggaatacgagaacctagaagaatgcctggtttgtaaagcactacgatacaagattagaggagatgatccagccttcgaagaagagagttcctcctaaggtgatgtggtatttccctataataccacggctcaggcgcttgttcaagaacaaagcgcatgccagaatgatgcgcgggcacgcagaagaacgtcaacaagacgggatgctgagagacaccccgttgatgggttgcagtgatgaaacatcgaatgaacatttcaatacttcggagaggatgaacgaaacgtaaggttaggtttaagtactaatggcatgtatctatttggagagatgagcagcggccatagcgcttggcctgttaccatgtgtatctacaacctcccccttggctatgcatgaagcagaagtacatcatgatgccgattattatttaatgccaagagcaacctggtaacgacattgatgtgtacctaagaccattggatgaacatctgaaactgccggggaagaaagaaggtgtttgttagcattaacgattggcctgcacctagcaacttatccgaacagtcaaacaaggggtataaggcttgcacccactgtatggataaaactgaaaatacgtatatgaaacattgtaggcaggttgtgtacatgggccatcatcgattccttatttcaagccacccattccggaagaaaggcaagcatttcgaacagaatgaagaccgccgtactaagcctaaacatcgcaacggaaaagtcttgtttactctggtgaaagatctagaagccatgtatgaaatgtctatatatggctcttatgaagagatgtaacaatgaatagaattaatcaaatatgttgatttctagcttggaggattcctccaaagttagatgactgcaaccatctgttataatacttacatgtatggctaatgttgggtttttctatgttttctataaattttatattattcttttttttattttagatactaaccccaggcatatctactgaggctaatgttttgatatctctgatcttgtttattttcttccacttcttgtgttgctccatccaaaatactcatcccaggcgtatctattgtggcatgtaattttagacattgcaaatatgcatatttctctaccgaatatggctttagatgactccagttagagcatgcccaacagctaccgaatactgctaccaatctcagattttttaattcctatggaaaaaagtagttccagcatttcccctatatgccaaaaaattggaaaccccatctccatatatctcgctctccacaagttgggtgtcctcctcattccctatccctggatatgagggcaagtgcgagggaacgtcggtaggattgaaaaaatagatttattcg

SEQ ID NO: 22403 - DNA, 828 bp, Oryza sativa
cgctgatttcaagtaatacatgcaaattaacattgatgtccatttgtcagacacagtaatctccatcatttctgtatgatctgatattggagcaaatccgcaggtttgataattttcagtaatctcaaccatacatcttttctaatctaataaatcatgtttatctatactaattactatctcaactactggtagaagaatagttttctgtgctagcaatagaactcataaatgaatgtttgagatcacttctacttatgataatactggcagtacaaggagagaccaacataaagttactctttctcgtaattgtgcgagaaaaaaggctgatcatttggtttaacaaaattctttcaagggcaattctagttgggatgtattctgtacaatcctgtgaaaggtagctgacattacaaccgcagccttttcattcacaacaaaattgaaatttgtaaaatcaaaggtgtttttgattattattctgtgataaacaattggcatcagagattattggttttgatatttggaatttatttgtgatcgaagtggttttggagatgattagatttcacaggtgattgacagggacttgttgtttgtcgggaccggtcagaccgggccgatgctgccggtcagaccagagctatgtgagcggttagaccggccagcccacggtctgacctgccgacgctgtgtcagtttcggtttcgggttgtttatttggatatccgtgattgtttcatatttatggcttctagatggatattatgcgtatgtaatacagttgtttgctactaatgagttaagttaggggggctgcaggaa

SEQ ID NO: 22404 - DNA, 8340 bp, Oryza sativa
  unsure (1)..(8340): unsure at all n locations
atgagtttggttcgtggctttaggctgcctacctcatgtataaatagagacgtagcgtgagggttctcggtatcgcttttgacagcaattgagttgctagtttagtgagggtttcgagtttagtcgagatttttgtaagtagtgctgttgatgtactttgtaaacacagaaagaagcaataaagttgtcatccactttaagagttttttgatttgtgttttatcgggttcggcggtctaaccggccacacaccggcggtcagatcggcggcagacctgcggtcagacaggcaacggcgaatggagttggtgattggtctcggcggttcgaccggtgttacaacctcggtcagaccgacgtgtttcaggcggtcaaaccggcgcatctacttcggtcagaccgcgatccgtcgaatttgagggtaacattttattccgcaaaaatattgggtttttgggcataccaaccattcaccctcccctctggttggcttagttcttgtgatacgatcctacaaaatttaaacccaaaacaattctatttaagcccatcaattattcatatgtagtttgggctgtgcaggtgcaaattacaaatgtaccaacaacttgaatttcacttatatgaaacaaataaataactcatctcgagatgtccggtgtgaagccttcacaagaattatagttaataatcattgctttgcacggaattttgcaagatgcaacaacaaaatttgtattttagttcactggtgtgttgctgacaacagagggtgccaactagcacagaccagtggcggatctaaaaaatcgattagttgatgtcataacgtgtctattggtattatagtatgttaattatgcttagctcaaattcttataacatataggtaaacagtttcgttataagttttgccgaaaatcatcggtgtcgcctaacaccggcccttctactgtagatctgcccatggcacaggcaaaatcttcaattccattgaatgtagagcgatcgacatgaggccattaagggcagatgaagttggtaagttaatttgagaggttgcacaaccaaattcgtgaaagctaaactggtcaggaaatcaaatatatagcggtgaatgtgcttggacttgaacaggcttgtccaaatgatggcaagcatggtaaaaaaacaatttggaactgagggaattatggtagatgaagaaccaagaattgcaataccttatttcccaactactctcattcgtatcactttcaaagaaaatggaaaacacaaaacagaaaatagcatgagttatggaggtctactaccaacaagatgttgtagcatgtacaattggaaactaatcttgtatgaggaatatatagcaacgtgcagtaggagggtgaatcaagacagtaatgattaaaccatagaggccggagaataaatcaagacagtataggactgtacagggacacagaaatattgtgaagattcaatcaatgttttcatattttgtttgagttattatcaccaatagtctgtggataatctgtggatatcaacaagtggtcggtgggatcacttattaatgtgaccttagagcgtcatacttaaaattgcatataatgactgacgaagcaattcaatagaggctatggagcaagatatttaaataaaagttgggctttggcccatattgtcgagccaagctgaagctccaattatgtgacttataattagatcactttcaattgccgcacttgtgagtatggacagaattttgagcgttgatgaattcctggaagtgatgaccacttgtttcctaccaagactggatccacaattttgaggcaaaattcacttcactacaaacatgaacttattcttcatttgttttctccaccataccggaaacaatggacaagtagcttaataagcacaaacataacaaaatttatagcataacatattcctccatttcaagcagcaggcaccttgtttacatggtcgcttgaactttgcctgatgtggctatacgattgagctgttgaagatggcaatggtgtactcgccctcaggcagaggctctgagcgtccttaattatattgatgaatagattacttgattacaaacggctctgaccatctcttaaatagacaagccataaagtaactgtcagcaaaaacccctagctcagctctcgatcagtggctaacctacaatctccgaatattttccagacgtgaacagtaactgaagaactgaaacgaaaaacagagtttttggtggtgcgaactgactgcagcttttctgggtttttttctttccttttattcacctccatgagggagtctgttacatgcgcaaccttgccggatcaacgactgaccgtgccaactgaccgtgccatcccacgatccgatcccagctcgatctcatctactctgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacattttcccccctaatcttggtgtgctggttccaaacccatcttcttgcgaacctccaaaaatcgaactcttccaacaggctttctcaaaatatctgcaagttgatcttcggaccgaacatactccacagcaatttgcttcttttccacacactccctaataaaatgatatcgggtgtcaatgtgtttacttcgttcatggagcaccggattcttgcatagattaattgctgacttattatcaaccttcattacagtttggctaggttcttctccaatcagttcagccaacaatctagtaagccaaatgccttgacaagcagccgtagtagctgcaatatactcagcttcacacgatgacagagccactaccttttgtttttgagattgccagctgatcaagcttttccccaacatgtataacactccagtagtgctctttctatcatccaaatccccagccatatcactgtcactgaacccaatcaaactgagtccttcagttccttttcttgcaaaccaacaaccagtatcctgaaatgtacctcagtacatgcttaactgctgcccagtgttcaatggtaggtttttccatgaacctactcacataaccaacagaataagcaagatcaggcctagtattcaccaaatacctaaggcttcccacagtgcttttgtacatagtaggatcaacagcctttccatcactctcctttctgagctttaacctagcatccatgggactttgagtcgagttgcagccttccattcctgtcttttcaaggatttttgctgcataagcagtctgtgacagaaacactccagtttccttttggacaactttcatccccagatagtaactcagcagtcctagatcactcatgcaaaatttctttttcatctccaagttgaatactttaatctcacttggttgagccccactgataatcagatcattcacgtacactcctacaatcaacttggagcaccatttcccctcacatacactgcactttcagtttcagattttaggaaattcagagagattaaagtgttgtgcaatttagcatttcaggctcgtggagcctgctttagcccatacaatgattttttgagcttcagtacctggccttcttttcccttctgaacaaaaccaagtggctgcacaacataaacttcttcctcttaactcaccatttaggaaagctgatttgacatccatgtgatgaatctgctagccttcacttgccgccaatgcaatcaagagcctcacagtttccattctagccacaggagcgaaaacttcctcaaaatcaattccttgctgctgcacatatcctttggcaactaacctcgccttgtgcttcactactgcaccagttggatctttcttcaacttgtagacccatttaagcccaatggctttgtgtcctgctggcaaatcagctagagaccatgtctggttttcttcaattgatcttaattcctcctccattgcctttctccagcattcatgctgctctgcttcaacaaaacttgctggttcttcggtggcaagcaaacactgatcactgtagtcgaaatccaaaacaggctcagttgtggatagaatatcttgcacacggcgatacctgacaggaccttcttctgttcctggcgtaactgagcttggcggcgtgcaaaattccaccctaactgctgctccagatggcgagggcgaaacaatagtcgacgccggcgatgcgcctccttgaacagtcgttccagcttgtccaccttgattagcaacaacgggttccatgggacacaaagaaatccaccgtgaattcctcctctccaattccctccgcctcaggatcatgccatgcccaggtggccgcctcatcgaacacaacatcacgcgacacacaaacacgtcgcgccaccggatcatacatccggtatgcttttgaaccctgttcataaccaataaaaaccattctcgtacctcggtcgtcgagcttcctcaagtttggcctcactgatttgacatgaccaacacaaccaaacaccctcaggtgttcgaccgatggacaccgtccatgccaggcttcatagggggtcactccgtctagcgcctttgttggtgaccggttcaagacatataccgccgccgtaacagcctcccccccaaaaacgcgccggcatccggctgatttgagcatgcagcgcgccgccgccatgaccgtctggttccgtcgttccacgactccattctgctgtggggaatagggagcagtgagctctcgcctcattccacgatcagcacagtagtctgtaaactcaacggaggtaaattcctccccgcggtccgtccttagagcctgcagctttcgcccagactcaagctcaacgccggcttgaaactgtttgatcgccgccaccgcctcgtgcttgccggagagaagtcggacccacatgtaccgactcatgtcgtccactaggagcaaaaaatactttctcccgcccggtgtcgccggcgagattgtcccgcacagatctccatgtaccagttcgagcgcctcctgcgccctgaacgtggcctcctcaggaaatggaggatgacgttgcttgccggctagacagccatcacacagctgatccatgtgatcaatgtgtggtaaccggcaaaccatgttcgcctgtgccagcctctgtagcgcctggaaattcaagtgcccaaaacgagcatgccaccgccaagccgtctcgccgccactcgccgccaaacaaacagggcttgcaatgttcagttttagcacatacagatagctattatcacggtataccttggtgagcagcaagccttcgggatcacggagcgtgaacacaccgccccatatgagtgcatcgtagccgcgcgcgtcgagtcgcccgacgctcacgatgttcttgcgcagcttcggaatgaagtacaccgcgtcaagtgaccggtgatatccgttcttgcacttaagcaccatgcttctgcgcccctggatgtctatcaccgagccatcgccgaatttgacagtgccgacgactccagtgtcgagctcggcgaaggctgagcgcgcccccgtcatgtgatttgtggccccggtatctaggaaccattatcctgtgttctcttgttcatgcccatcatcatcatccaggaccacctttctttcggtgaggtgcacttcttgcaccctaggtgttcgaccaaacgctgcttcgccggcgagcgatagcccggtcacatgtgccatgagcagagttggctcctcctctgtctgcatcaagtttgcctcgccgcggcgttgacgtcgcggttttcgacattgcctagcaaaatggccatattcttcacagttaaagcacttcacctttgagatgtcacggccgccgctctccccggaagctgcctcttttccctttggtgtaccagcaggtttgccttggcgattcggtgcgccagagctgctgcgaccctttccaccaccaccagatgcatcctactccttctgcttgctccgtgcctgccattgttcctccgtgagatacaacttgcttcttgcttctttttcttcgtcatcgctgtagctgtcgatcgtcgacagccgcccgacgagttcctcaagagccatcgttttcacgtcaagaagctgctcgagggagatcgctactggcttatacttcttggggacaacacacagcagcttcttgttgatgtgttcgtcctccatgactccacccatgtcacgaatgtccgcgacgattgcagtgagccgaatcgcaaattcctcaggcgtctccccatccttgaagcgcatcgcctcgaactgacggcgaaatccctgctcattcgcctcacgcacgcggtcgacacggatcctcatggtttaaatggcatcacacgccgccttcgccgtgtcgtgcttcgccagcccgcgcaacatctcgcgcggcacggcntctgagtatcccgagagagctgcccgatcttcacgaaactccacgtagccgggatcaatcgccttcccaagcccctgctcctcaaggttgacgcgcatcaggagcgcccaatccgaatagttcgtccttgacagcactggaaggcgggtggtgtgccctgcatctctcccctgaggcacaagnnnnnnnnnnnnnnnnnnnnnnnnnnnccccccactgctgccacttgcgccgccgcggccgctgccacttccaccgctgccaccgccaccacggcgtccaggcggtgtgtatgacatcgtcgccggatcgtgacggtaccgctctgataccaaatgtcagcaaaaacccctagctcagctctcgatcaatggctaacctacaatctctgaatattttccagacgtgaacagtaactgaagaactgaaacgaaaaacagagtttttggtggtgcgaactgactgcagcttttctgggtttttttccttgtattcacctccacgatggagtctgttacatgtgcgaccttgccggatcaacgactgaccgtgccatcccacgatccgatcccagctcgatctcatctactccgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacaataacttacctctaacaaactccaaattatctcaagcctgatttatctttagccaaacaaactcttacacaactttatcttcaccacttgtagacgcctgattcatcttctggcgcctatgatacatcccgccgattagcgtgtctgcaacactgccatactcttgacagcataacaaaggggatgtgcaacgctccacaaagctactagtaatgtgaatacttttgtgtctcattactgtagttagaagaattgtgccccatttctgtaatgctgtacttttgattctgatgcctcccatctcctggtgaactttcttagctggtctatttccaatactggaaatttgtctgatcgagtagaagaggaagcgagaaattaaggttatgttgttcttctagccagatctttcggattaacgtgggagctcatagaaagtgttcgattagtataagtatagatataaatatcgaagctttaggtctaactacagcactgccatttcctatatatacatgccaccatgcatgtattttcccttgatatacataccacaataccagagattatacgttattttttcattcgtccattttatgctagagaaaatgtgataataatgagaggtctcaggaaatagcaaaaccctcatacctatgagcctaaccggctggttgagcccccctgctgcactgatgatggaagaagccatccagctgactagtcgagatctttcgttccaagaacaagcggtcaaagttgtttgattcctgtaaggtactgctatacaacaagtacaaggatatgtaaatgaaaagctacaaccatatgtaagccaaaagagttcaattagcttaataattatcattggggactattacgggtgaagtgatctaaagtcaaattttgctacaggatatcggtgacttcgtgtttttagtataggatattgtggaagtgacttttggtgggagacactatcaaaagtagatgttttctggtggacacgtgtacccattaaa

SEQ ID NO: 22405 - DNA, 1246 bp, Oryza sativa
ccaataatgagtttatctatttcaaggaacaaagtcggataaatatgtaaacatagtgtgtaatacaatcatctctatgattgcctctagggcatatcactaccagtctcccacttgcactagagccaatcatgaacgtatcttatacccattgccctagtgtgtgcctcatgcttaggctgagggagtggctttgtcaacggatctgcaacattcaaatccgtatgaatttttcatatcttcacatctcctctacccactatctcgcgaatgaggtgataccgccgtaaaatgtgtttggacttttgatgcgatctaggctccttggcttgcgcaatggcaccactattatcgcaatagaggtccataggtctagaagcacttgtcatcacacctagttgagaaacaaatttctttatccaaacagcctcctttgctgcttcagaagcggcaatgtattcggcttctgttgtagaattagccactgtatcttgcttggaactcttccaactcacaacgcttccattcaggtagaacacaaatctagactgcaatctaaaatcatctttgttggtttgaaagcttgcgtcagtgtaactatttacagcgagctcttcctgtcctccatagactagatccatatctttagttcttctcaagtatttaaggatattctttacagctatccagtgactcacctggatctaattggtatcggcttgttgcactaagtgcatatgaaacatctggacgtgtacatagcatagcatacataatggatccgattgccgaggcatatggaatcacactcttcttgttttgctcatcaatcgtttgaggacactgattcttgccaagattaatgccatgtgacatcgataagaaacctttcttagaatcttgcatgttgaacctcttcaacatcttgttaatgtatgtactctggcttaatccaattagcctctttgatctatctctatagatccttatgcccagaatatatgttgcttcccctaagtccttcattgaaaaactatttttcaacgatgtcttaacggatttaagcataggaatatcattcccaatcaataatatgtcatctacatataggattagaaacaccagtgcgctcctattaatcttcttgtatacacaaggctcttcttcgtttttgacaaagcccaacgccttgactacttcgtcaaaacgaatattccaactccgagatgcttgcttcaacccataa

SEQ ID NO: 22406 - DNA, 598 bp, Oryza sativa
ctagcctagagtgcattttgtatagcgaggtttcagtgagatatgaatactgataagaagctcttttctacaatatggttcaatataggcattacctgtgcatgagaagaagtcattacctgtgcattgcaattataaaagaggtggaaaaacataagagatatacatattatcttcaaatatctatacaatttctagatcttttccatttggaactggaaaaactcacctaatgctttccttccagccttccaggagttttgccatagataactttacaagtaaatataagcgggacaaggtgatttagccccgtttataaggtactaatatagtccgaagtttgattgtgagcagaaaggtgtaacctgtattttcagtttagagattaatttaatttgctctcttattgtagaatggaacagtttgtagcaaataataattgtgaactcactgacaatttaagtatttccagggcaaattgccgaatggatctgaaattgcaaccaaaggctttcagcatgctctggacaagaactactggaatgcaatagcgaaatataacttttagtaaatattcagctgcatcgaaggagga

SEQ ID NO: 22407 - DNA, 12831 bp, Oryza sativa
  unsure (1)..(12831): unsure at all n locations
tgttcaacctgttgagcaacatcttgctcagcttgttgtggttgtgtggaccttgaaacattttccggtgtttcctgaatttcttcaagtcccaccatgctcccactatcctttcttgaaataaactcttttcccaagaaaacaccgtgtcgggcgataaacactttgccctcttcccgattataaaaataatatccttttttttccttaggataccccacaaagaagcatttatctgatttaggtgtgagtttgtccgattgcaaacgttttacatagacctcatagccccaaatctttaggaaagacaaactgggacgcttccctgtccatatctcatatggtgtcttatgcactgattttgatggaaccctgtttagtatgaacgcagctgtctctaaagcgtaacccaaaagcttagcggcagatcagtttggctcatcattaatcgcaccatgtccaacaatgtacgattcctccgttcagataccccattccactaaggcgttcctggcggagtgagttgcggaacaattccacactcctttagatgattaccaaattcatggctcaagtactctccaccacgatcagatcgtagatacttgattgtcttgcccaaatgattttgtacctcattctgaaattccttgaacttttcaaaggactcagacttatgcctcattaagtagacctaaccatatctattaaagtcatcggtaaaggtaataaaatacccaaaaccacctctggcagttgagctcattggtccacatacatcagtatgtactagtgccaatagttcacttgccctttcactttgacccgtaaaaggtgcctttgtcattccgccaagtaaacaagattcacatgtctcaaatgattcaaaatcaaatgagtgtagaagtccatctctatgaagtttctccgtgcgtttctcatttatatgacccaagcgacaatgccaaataaaagtgggattcaaatcattaggagcctttttgcattaatgttatagactgaacatccatcaagattcacaatgtataagccattcatgatgggtgcatgtaaatagaaaatgtcattataatagactgaacaaccattggccacaaactctaaaaccataaccctctgcatgcaaacaaaaagcagagataacgttcttacgcaaacctggaatgccataacaattatttaactccaaaacaaatcctgacggtaaagataatggcatagtgccgaccgcaacagcatcaactcttgctccattgcccacgcgaatgtccacttcgcctcttgctaagctcctacttttttagcccctgcaacgatttgcatatgtgagcaactaacccggtatcaagtacccaagaattagtagaggaagttgcatgattaatttctataacattaatacctgaggtgaaactctttccatcctgctgcttctgcttgagctgctctaggtatttcttacagtttctcttccaatgacctatctcctttcaaaagaagcactctgcatccttagggggccatgtcttttgaaccttggtcttagagttgcttgtactcgtgatctcatcagagtttagctttctcttttgaccactcttcttgttgttgggcttgtgcttatgcataaccatcacatggttggagtttttcttaatgctttcctcggcagtctttagcatcccatgcaattctgccaaggtcctgtcaggttgttcatgttgaaattcattatgaacggctcaaaagctgggagggagcgactggagaatcaaatcagtagccaactctcatctaaggggaaagcccagcttatccagactctcggtgtaaccaatcattttgatcacacgtgggctcactggattaccttctgcaagcctgcacgcaaattatcgtatgagcatgttacatagtcccgtgattatcgtatgagcatccaatgcctcatattgcctttaagctcagggacatagtagcaagtatgagccccccaaaaaaatcttttaaatatcannagaataatcattgcatcgcttttcatgctccctacgttgagcagcaggagcattgttgggcaagttagctggaaaaggctctgtaagcacaaactctttctgctcttgcctaagaacaattctcaggttgcgataccaatccatgaagtttgttccaatcaacttctctttctcaagaatagaccgcaagttaaaattggatggtgcaggagctgccatgatctacaatagaaatatatgtatacaaaatcagcaccatgtttgcatttaacctttcattaaacaatttaacaaaagatactcccactatgtattgtgaaacaaaattccctctagtaacatagtgagtcaagatcctcattttattagtgtctagtgagctttggcatcgcagctagacaactatcaaaataggtaagcaacaccttactaatcacatcattgtgactcttctgctgttggggtgacatcttcatatccaacccaacctatgccccaaggtccaaaactgttttgattaccttgtcaagtaaaccaataatctctgcatatagatgtccgacatctatcctattttatcatgataaaagtgacactttgctatggcaaactcatcacttatgatcacaaccgtaataggtgcaattattagaagagcataaattacacttaatttttctgagggaatctatcctaccatgtcatatcaaatatataacagtaataaagtaagatagatataaaaaccccaagcgaaatctaaggggcaacgcacacggcagtcccagtggtacatagatctcatctacgattcgccatgtgaaaaccttaacggcgtaatcaaattatgccgaaaccgagtcaatctcattggctcgtttttctcattggcgtgcggttccagtggacatcagactatccgatgaacacaatcgcgctcagccttggtgagtactaaacattccagtgaagtcaccaacacacataccgattgatctcatcaacccatgtggctatcggttcatctcatgttccgatcacctaagaactcatatacaacataatagatctcatctactacacccgcatatcaattatatgcaatgatctagatcataaactatacaaggcggctctgataccactgttgggatacgcgtaggctacgatagcatcaaaattttctatcgcgtaaactaggaaccatgcaagtattagatcatagatcgttaccactcgacgcgctgcgcaacggaagaagacgctgagaagtcgaaggaactctcacgaagtagcgcgcgtcgatgtagaggaagttgtcgatcataccggctcgaccttctcctcctcgtgcgttctcctcgccgtactcccacgccgatcaacatcgcaaaccagcggcgcctctaccggtatccacacgtacaaggacggaacaccacgcgcagatgtgctagcacccgcgcgcggctagggttttgctcgggaagggaagtgacggctaaggtttctcacgtgatgcaatgcctccggcagtcacacccctcacgaatatataggatccatcactcgggcctccaaggcccataggacttctattccgatccctatccgaattaagctcatattggatctctatccaatccccttattccgacccattaagcgtgcgaccctgtaggttcatatatactcggctttaacccgaaaactccttttcggtccacgcgtcaacagcggcccctagcaaaacgtattgacccaccgggcatacataaagatcatatcggctgaacctctagtatatacttatatggacctatttgcctcacgatatcgattaagctcaaggctagatatgtgccatcctctaattgctcaatcattcactcgaacctgttgatagattatataacttgcgattgactcctcaatcacctttggcatggccaagcacttccataatctacaacatcgaggggcccagggatatctctccataggaggggcaaatcccatcttaattattcatatcccactacatgtttcatagcatactcgaaaactacttttataactacccaattacggagtagcgtttagcagtccctaagtaagctactacacatgttgggaaccatcacaatctcaggtctaaggattcaacaccaacactaaataagatcactgatgatacaatacatatggctattgcagtgtcttatgttgggtctatccaacaacatgttcactaacatgtgtccacatcattaatttgttatctctataccatgatccatgagacatgatcatcaattaatacatgtgctgatcatctaaacatatttgttccacatatgatatttgatcagggatcctttagaaatagtaacacataatataaagagtctcatgaaagaatcacatattcattaaccaataatgagtttatctatttcaaggaacaatgtcggataaatatgtaaacatagtgtgtgatacaatcatctttatgattgcctctagggcatatcactaacactacgctggctctacaacgtatattgattcatatgtaatgaaagcataaagacaatttcatttggttccaggagtctttttgaaacctagttccaggagtcttgatggctcataattatatgcatagtaccctttgatttacactagttgcaaacctgcaaccctcggctataaaatacgacagctaattgatcctgtgcttcacttccaggtgctatcagagtacctcaccttcatttcatttcctgcagcaacatctttgtagcggtagtgcatacaagacaggcagtacatggtttgtatagcattttaccgcgtaaatcaaatggtaattaaattgggcacgagagacctcagggaaggaaggaacacaggatatgatggagtgcttagttttcactcgaatgccacatttctactctaatatggcacagcagatttcattcatgccacaaaactactgcagttcttggcatgatcaaattcctgtgattattgcctgattgtactggcgtagcagagagagagagaaattgaacatgtctttttatttgaaaccttttggctaaagatgccatgttttctataagagtttataaaatcctgggtgataaagttctagcatgcaacctctgctaaagattcaccttaaactaactaggtggagtaatttgcatgttggctgcattcgcctgcgatttgttgtagctaatgagatcttccagttggatgtagcataggaagaaagagtcataactaatgctgaaaaggagcttagaacatatctaaagacaatagtggtggtgttgtatctactttaaacaagattaagattagacataaggcaaggctaacttggaccaaagaaggtgatgtcaattgactgttctttcacttaaaagcagatgccagaggagagaaagaattatacatagatgttacaaaccccatcaagggatgtaaccactcaagacaagaaagaacttcatcgttttttcacacaactcctaggggttccgacgatctcggtgcctgaactggtcggcgataaacctaccaaatgtatagctctactataagaccaggaggatacagcacaaggtgaattaaaggagactatcttctccatgccatctgaaaaattaagcccctgatccggatggttacattggggcctttttcaaacaagcttgggacatcattaaagtctgcaactatatatgcccgagcattatcgacctataactttgattcacagttttgttcgaattgtgacagagctacttgccagtcatttcgccccaatattgaacgaattgatctcgtataaccaaagtgcttttattcgtaaaagataaattcatgataattttctttatgtgcggaatttactgtatggcttttatgctcactactagagaaataactattaacgatagaaaatgtggtccataaaagtataaatatggtccaactttggttctataattaaagtatagtaaaaacgggtattgtttggctaaggctctatttgttttaccctaacattattgtaatctatattattgagtcagattactataaactggattataataagctatagtagatttgtttgtttctctagattatagtagattaagggtagtgaatctttaaccacccgataatctaaaaaagaaaacacgtttataggagattaacatattatactaatatggcttataaattataataatctatcgtaataatctacttgtttgttacagattattaccaataatccaaattataatattcctaagctaaaacaaacagggcctaagtcaactagtcgggataacttactagtctgttggtgtcctatcatcggaaaagaatgttttagaaggcaccaatctctacctatactaattggacactttctacgagctctcacgttaattaaaaaaatctgaccgtcaattcaaaggaggttaacatcgtgaccgtagatcaaattgatctatctccgcaaatcaggccgagaataacctcagatcagatcaacctatccgcatatctggccataaccagaaagagcgtggcaccactgacgcgttgacccggcgggcgggatgcaatgcaagcgtgttcacacggcgatccatcgatcgatctggggaagcacgcgctccagcggcggcggtcatgcatggcaatccatcgtgtatgcagcggcctcaacacgtcatcctccagccctctagccaatttcgtttcctggtgagatcatccgcttgtggttgtggatccgtacgctgctgcaatctagcctgtggatgggttttactgacggctgctaatgcatggcgtgcatgcctttttgcagttcatgccctgctcgcagaagtggaggagatcaacttttacagtggtcatcgagcaccagccaccaggtactttaatatatctaacgaactctttcacgtctatctgcttcacatttatcgtcctgcatgcatgcatacgactatatacacaaattgacaaatccttctcatacatgtatcattgaattcgtcaacaaaaagctggcgaaggtaaggcgcccccagtcaaataaccaagattggtttctaaattggttgttttgttgttcgtccaaaactcatctgcgtatgcttgcacctaataaaagtaagatctatatatcatcggcacatacagttattatagttattatgcttacacacattcttaatccatagtttttgttttaaaacaatgaatcataagtgttttgtttttccacctattaaatgagttgttttatagataatttcgacagccaaacccccataatttacttaaagaagattgaacattaatatatcataatttgttagcagataaacatatattgatccacattttttcttaaaacaaactagcatataatgattaactttccgtgccctgtctctgtaaacccgtatgcactgtatgtactctacaatatgcatattattgatttatgccattcaattttgatccctgaattatttttttcatcacaagtaatacctatatcgctaataaatatttcccattctttgtccaaatacatttctttgaatgattacatgattatgttcacggatatatataatttaccagcctattccatagttgtttttatttatcaaagttaaagtgtaacacaatggtaagtcttatggttattcacattgagaaggaatcaaggaaagtcaagagaagagcaattagactttaggagtcataatctaatcatgtaatcaacaatgtatgcatagataaaagtgattccaggtcctttttagagattaaagataaatgaaaaagactgtgatggccatcattaaataaggtatagttggatttaagattgggtgaaaattaaataagtgatccgatggggaaaataacaatataaaattccttatatttgtggataaattatgagccccaaaatccgttatgttggtggatagagagagtacttattagcctcgatgtcatacttatgaagaggctattagtataaatactttttcacgtacagatagtgttcatatttacatgtcttcccacttattttatttgttgcatgacaccatgatatatgccaataaagaaattctgggtccattaataagagatggttaagtgcacttaataagaagatgcttcattaacttcatgttgacctcaccctttttcttatccagatatcatattctcttagcatctctcatagctaggactgattgaagaaacacaacaaagtcgtggaatgagaaatatcaatgacattatgctccaaatcatgtaagtttaattaatatcatttaatccacataagtataaagtattggcagcagtttatctgaaatttcagcatgtgcatagttgaaacaatgcaaatcacactatatttggagtgacgagaaggggaaattggaaaataatttttaattcactagaaagtgtattgtttcatctaattactgacaggaataaacatatgtagagcatactatcatgatcgctaaatattaaattacaataaataaaatataattagtaatatttaatttttagttcatttggatgtttagcatcttctttgtcaaaagattcatcatcatgaaaatgtacaacacgttgttgtataattattatttttaatatttatactaaaatattttatttcaattatatttattaattaacacattactacagaaggttacaacttagatgcgattcttaccttttgattacaatatcaaaataatacaccattcaaaatacttaaattttaaaaattaagaatggtgcaatgaattctatgattaaaaaaattaattcacgcaggaaacaaattataaatgtaaaataattaaccaattaaaattttatatgattaaaattattatataaaattccccgtgcaacgcacgagttgacatctaaaataaatgtattttaataattatattgtatcaaatgtgtgaaagaataaaataagttataatactgcagaacagatgtcacaaaataggagagcactgcatgaaattactcaatttatatacgaatctaaaaacgaggtatttatgagtttctttctttctgctgtgcttgtaagtctgatatacgaatctgtgagagaggtcgaattgattaaggtactaatgtatgtactgatatactgacagagtcatataagtcttcttatgttgctacaaatatatgttccattccatttctttcataattatttaccttgagattgattggattggtacactaatgataataaattcaattaattaatgttcattgatcgcactacataaatatacaatgaattcactaattaaaaaaataattcatatataaattgccacactcggctcccaattttgcatttctttcactcaactcagaaaatcaaaccaaaaatcatgatgttgcaatttccatattgactcttcttttgattaaacccattaaacttttacatgattcacaattagtataatattaccccgtgcaacacacgggttggcggcttgttcaataaatacaggatcacaaaattgaatagatttggaccatgggctttgatggaaacttcatggcctcaagaaaatttcgagcttatttttccttaagtagccatgttgaagctccatgtctgtttcttataactagtccatctcaaaatataaaagtttctgacattttaaagatcaataaagaataaaaagaaattattgtgatgcctctcattaattgagaggtgattgcagtgtgggagggtggttagatataaaattgagtgaaaattaaatgagtagtgattgttgggagaagtagcattttagaagttattatgtttttgtcaaatttcaaatgctataatgtaacaccccaaactgtctgtcgcctatagtagtgggttggtgcaagtacctataagttgcagcagatgtgatttattactatcataaaagttaggtgagtgatagccaggttaacccttttatatgaaacaatgatcataaaaatgtaatatggaatactacgtctatataggctaattcaatgtgtggaaagaactgatgcaaattttaaaggaacggaatgagatgtgtatgtgaatggaattgtgaaatatgtgaataatagatgtgtgaaatatgtgaataatggatgtgtgaattatgcgaatggggatgctggggatgtcgatgtgctgggaatgctggggaatatatatgtttctgtcattttacagcgggtatgactagcagagacctgaggctagcaaaaaacatatttttttttgggggggatactcatcggtgataggctttaacttaaacccgatgggatgacctcatccgtgacgggcttttgttaaagtccgattgagttgagttatctccttgcctcctgcttgctgcgccaattggcaatgggtccaaaataacataatagtttataatcacttctttggacggatatttctcaaagtgcaacgacaaaaattgtagttccccgacttattagcgcgttggtgagacaactcacaaaaaagggtgtcaactgatgcaggcaaaatctgcaattcaatgttcagcgatcgacataaggtcatctagaccggtcaaaatgtcaaggtaatctgtgaggttgcacactcccagtcgagtgaaaccagtaatggtgaggaaaacgaataggaagaggtgagaatgtgcatcgactttactgatgtgaaacaagcatgtctgaaagaaggcacccatggtaaaaaccaatttgccatgtagagaacctctgtggatgaagaaccaagaattgcaatacattttttcccaacttctctcattcctattattttcacaaaactaggaagaagaagaaaacagaatagaacatgagttgtggagttctaccacaatcaagttagtagcacatgggagcagaaagtagtcggcctagttcatatatggggaatatatatataacaatccgttacagtagcaagaaccaagatcattactgctgaatattcagcataggtacaaatcaagggagattgtattgaatcaatagtaataattaacctgtaggggagtaaatcattcgcggacactgaaagattatgaaacttctatcagtgcgttcagatatttttgaacaaagcaaagatggtattatgctctggtagttcgtggatagtctgtagatatcgatgagtaacctgtgggatcacttattaatgtgttctctggagcatcatactttcatataatggctgacgaatcaattcaatagcaactttaaagctttgaatgataattgggctgcgtactattttataaaatgcttaggaacttgtccaatgtctcttggacggtgtagaaaacaaatggataataggttggtcgtatcaatcaatgactatatgggttctgattgtagtgaaatgtattttgctaaaaaatgtggaactagttttgatagaaaacaagtggtcatcacttaactagtttccacaatagtgatcacggaccgaatcttgagtgttatggaattcctcttttaagtgaggaccacttgttttctactccatccgtttcacaatgtaagtcattctagcatttctcacattcatatctattatataagtccatgaaactttctacaaacgctctcataccgccacatggcattctaataaaatagagaaaatcctagaaattctagaaaaaagcaaaacatccaaccgttaatttttatttaaattggtggacccattattttgcactattagatttatctcaataagaaaacaaccaaagccacctatttccagcgttagatacttagattagattgatctgtacacctcgcctatttccgtacacacacctctcctctcttttgctgcccctcccctcctattctctttcctatttctatgcaatcatttttttatcaagaaatcaacggttcgatgagttcaaaataattactatagtttttaatatatttcgtaagcaaacaatcagctcaagaaaatccttcatcgatatatggagcagttctaccgactgctgtatcaatataagcaatgcaagcaacttccatctctttgtttgatctctcaccttacagctggcttatcactttgattccacgtagtagtagtgcagcaaggctatctttgatttcatataaatttcacaaagcttttggaatataaattaattaattttaggcatttgagttatcaggtgcttcaaatggttgtcaaatatgcatgcgtgctccgttctaggcccatgagtacttcatggaaaactcttggcactactagaaaaatgattttttatggcgtttgaaaaatattttttatggcggctacgagaaaaacccgccagcgtaaaaaatcggggggtgggaggtcacgggctgccagcgaaaatcagttctcgctagcggccacattaagagatccgccataaaaaatattatatttttcgaggcggacctcttacgaaaatcggcgttttcgctggcggctgctaaaaagacccgccagcgaaaaacactgtctcgctaaaaaattttgatggcatttaaaacaatgcgcgctagattcttcacccaccacatttaaaaccgatttcatcccactttcactacc

SEQ ID NO: 22408 - DNA, 9749 bp, Oryza sativa
  unsure (1)..(9749): unsure at all n locations
ctcccctcccctccctctccctctcccagatctagccggaggaagggagcggcggacgcagcggcggcaatggcaggcgggcgacgacgattttaatgtccagtttgatgtttatttgtattactgtttcatatatgcatgtattgatgcttgtttgtggaaaatgaagtgagaaattgatgtagtgttcttttgaggttggatctgatgtggatttgaattgttatggatttgagatttggggatgtggatttgggaatgcaggtagcaacatgtgggcatatttatttttgctggcggctgaagggaagctacataggtttttttttctcaaaatagattatctctggtggccggtataacacaacaaccaacaaaaatcgattatcgctgacggccggtataatacaaccgctagcgaaaatcgattatcgctagcggccgataaccgctagcgaagatcaatattttctctcgcctttgctccgccaaggaaaacctaaaatggccgccacgaaagatgatttccgtagtagtgtggagtcctctttcgagcagatctgattttatctcaaacttccttgtgagtcaccaacaattaaaataataaaatgttgcgccacctatcatgggtctttgggcttataacttagtttaggtccccaggccaaatggagcccaagtaggctgcatcctaacttgctgatgtacgaccttaagggttcctttgctgtcctcccacctcttcacctccttaaatagctagggacctcttcaggttcttgggttttctttagattaacgtttagtcattgttacttttctgggtaaagccatgatcagttagatcatacctttctttttatggaaccctaagccgtgatcccaagtagccttcatggcaaattttcttatttctttcacttcctagctagagattaacatgtcagcaaagaacacatcatatcaattttgaacgagtaattttatggttctttagaatgtaccaggtgggtatagcacattttctagcaactacaaattagactagctagaaatttgattactgatcatgaatattctatttctataaattaagaatggtttttttttcaaatgataaattaagaatggttctagtcagaaactaatattagatagtcttttgttcccagtaactcctcgataaccaaaaaaaaaatcaaacaaaattacataaatatgtacatgtgaataatgtacattgtataccttaattacaattctggtcccacaacttcatcatttatcatactacaatacctgagcagtctagctacagcacagccactactcccaatatatacataccaccatgcatgtatttttcctgaaatactggtacagattacaagttcatttttcatttgcccattttatgctataaaatgtgataagaatgagaagtcccaggaaatcgcaaaatcctcgtgccaacgagccaaaccgggtgcttgatgccgccagctgcatcctactacagctgcatttctaatttttagctgcgcgcctgcgccagcttactagcatccagcttactagaatctgtttctttctttggctgtgtttagattggcccaaagtttaaaatttggttgaaattagagacgatgtgactgaaaaattgtatatatacgaaaggtttgatgtgatggaaagttggaagtttaggaaaaaactttagaactaaacacaccctttcatccttttgcttggcttaggtctagtttgcaggagtaggctggctcgtccttgctctgcgcttgtgctaggattgtaaaaccggatgcgccggtgaacttgctctggctgtcaagccgtgtattcagacatctgttatgccttctataaagttgggcagtgagccttttctctaaaaattatgtttgccaagattttagtgaaaacggaatgtgtattaaggtgttgtttggatccgggactaaattttagtccctgtcacatcagatgtttgtacactaattagaagtattaaacgtagactaatgataaaactcatttcataaccctggactaattcgtgagacgaatctattgagcctaattaatcaatgattagcctatgtgatgctatagtaaacatgtgctaattatggattaattaggcttaaaaaatttatctcatgaattagcttttatttatgcaattagttttattattaggctacgtttaatactttcaattagtgttcaaacatccgatatggcagtggcttaaaatttagtactgtatccaaacgccacctaaaccaagcatgcagatcatgtaatcttgggctggatggatgttaactaaaatacattggtttctacatcaaaaagccatactggtttggaacactgttcttaaatcagaggtcataaaggttcattatatgctttaaaaagacactttaagagagaaactgccggttcgaaaaaagtacaaaatgccataaacagatgtgtttatgtgggaaatcttcaaagatcaaaacatggaaaaactaagaaatgatttaatcagaaaaactaaactaaaatattttggcatataatatatacttaaaaaggaaaaaaaattaatgttttacactactaaactttcatcggagtccaggaaaacggtctttgaacattgaaatcatgcacgtgtaggagttactccctccatattgaaatgtatgacgatgttgatttctcaacatagcattcaaccattcgtgaatgtgaggtaattatatattggggtgtttagattcaggggtgtatagttttaaagtgtcacatcagatattatatagggtatcacatggggtgttcggcactaataaaaaaactaattaaataatccgtcagtaaaccgcgagacaaatttattaaacctaattaatccgtcattagcaaatatttactgtagcaccatattgtcaaatcatggagaaattatacttaaagattcgtctcgcaaattagtcgcaatctgtgcaattagttattttttagcctatatttaatattttatgcagatgttcaaacgttcgatgttggcataaagttttgggatggaatctaaacagggcctgtgccagtattcactgcaatgtattaccacaaacgctgtgaagaagtacaaacatatgaagaagtacatccaatcaatttattcaagctttacaaatgtggctggttcgggctgtcttccagcagtttgatatcacacctaccgaacaactggataaatttcacatctattaacaacatgtcctccattcgcaatttttgtagaaatacttttatcatgttcttcacacacttcagtgccctaacttgattcagttcgtttccaaaaaataggctttacacaccacttgcaacagtttctactaatggattaggttgagactgaaatcccacaatcttttggcgaggcccatgtcgagcgcatgagattttaattcagtgacattgcagtcaacaaagtatttgccagtgactccagcaacctgaggatgcaatgccacatagcacactgtggctgcaccctgcaaaaacaaacaatgctaagcagtgattatgtgtttggatagtttgcacaattgtttgttggtaattggatggtttgcacaattaaacatgttatgaattactgaattagtaaaatttcaaggagactttgtcctggtgccagttagttcatggatttaataacattaactctacaaaaaatagtccctggtagagtcatggtaatattgcagctcctgttttttcaggttgcaggaagatgttgaatgatataagcaataaatacattttttccatatttatatatttattaggttaattattccatgatacatccaattatttaggagcagtcaaaaagttttagaatgtacacttaccactagtactaggattaaagttttagaattattttgtgtgtttctgttgaataaaatgtttcagaaaacatatgtaatgaaatagacataaattgcatacacaataaaatacaaattgaatatacaataaaatagtgaatataactgtcacaagaacatatgtaatgaaattgacataaattgcatacgcaataaaatacttaaattgaatatacagtaaaaatagtaaatacaactctgtcactttagtcttgtgaaaggaacagaaaaaaaatgatccaaaacttacttgttcaacacctttaacgaaaaatttaccaagtgtagatagcatacctgaaattaaaaaacaaggaagaacaatcactgtgcattgtttccagttcattattcattcaaataataaagcacaaatgtggggcttttacaatttgcactggacaaccatagtgatcttcgatgaatgaaatatttctttaataaggtaatgctctcaagaattttttgtatatggaatgatcatgcactttaatgaacaaaaaagttctggaaaaactctttatacaactggaagagaagtaaatcagattaataggctagaaagaagatgtatccatgcaattaagataatagtgatggcaactgaagcctaaacttatgtgactacatagaagaaatggatgtctcatagctgtactatagatgaatatgagcacaacgaagcaaaaactcaactagccagaaagataaaagcaaatactgtctgagattcgatgaaccatccatgaagattgatttagctttattttgccaagaactatatgcatttgtcagatatgcccataccatttacgaaataccagtgacgcataatgttggtgacaacagctccaggatgcagagagttgactgttacttttgcatcttgctccttttagcagacaaacattcatcatcaagaaaatatgtgaaactttttgaaatagtaatgcgatcattgatatcatctattcacagaacagctccataacaaaaataacagggctttgacatccatcctctgcatagctttgctattatgagatctattttgtgataacttcatattactgtctcagccaaagatctacatgatttagttaacagcatgtctaacatattacagttagtaatttcaagaaaaatagcctactacaatttcttttccattttacaagattacaaaattgtgtaattttgaggacaaacagtgtgtacaattaaataaacaagagttagtgtgaaccaccagttgttccaaatacgagcttaaaggaaaacaagaagaaaagtggaaccttcagattgctagatagtaaattggaatgcagtatgttggcaagcttggattggccgtaagcgaagattttgttatacctagcgggagagaataaaaataattaatttcgaatatgatgtttttgtgcagatctgttttcttacctttgatcgattgaaaaggtaaacaaatgtaaaaaggagtatacgttgggtcagaaagtaatacccagattcatcattgatcttatcaaaacgaatcccctctcgataagggtgcttgtagctgttagaagcaactatcacaacccttccttctatcccactttctatagctgtaactttcatcttctcaagtaaaagatcggtcagtagaaaatgccctgcattgcatgattaattgcacgatgcagttacacaataataacagaaattttgcacgtttgtaaccaaacatggttacaagatcagtcaagtgaaatatgaccacacacaaatgtgtaaagtacatctgtcttagtaacaaatagaaaataaaacaataatattctatgaattttggcaaaacctacttaaaataaaaaagttttagtatgcagtttaagggactgtaagagggggcctaccaaggtgatttgttgaaaaatgcagctcaatgccctcctctgatagcttaaatggtacaaacgcaatccctgcattattactttaaacagagaagactaaaactattttctcaaacataaaatggatgacgtattcctcgccaaaaaaaggcaatgtaaaaaaagaacacttcaacatagatggaataaaagttttttagtagaggtctgatggactgttttatcttccagaaaatgactgtactaatgacataacccagtaatacataaatactgtctattaagcatgctttgagtgtctgaatcccaatagccagctcaaatgctcattccagtttatttagcacccaaattctctatgttgcagaaggttttgctgctacaataattctgtaaaacagcataatgttttttttttctttttgcgaggaagcataatgttttgttctaccaaatatttccaatatacataaacattagatctgcttacaccaggatgttcagaggaagattcagagcattgaaattctccgcaaatctcctcacagaagacatcaagctgaggtcaagatccagcatctcaatctttgcagccggaagctgtctcactatctcatccctcacacgcgcaccggcagatgagttccttacccncatcacaacatgcagtccccgcattgcgagaactcggcatgtttcagcaccaatcccactggaggcacctgcaagaaacatctccaatcagcaactattccaccagcatttcaggccttcagtacaaaattcgattaacgagcaggaattggagcaatatgcaagatttactcctactgcttgcatcagcctgaagagtaaatattggggaaaaattgattaatggttggtaaaactataaatacatttagcatataaatcatctttcataatttccccccagatttatctactgcaatatgcaagatttttatacaccgaacagtaaactttgccaatttcccctcaaatcgaagagaatcactaaattcctcgagcaatttcagttcagaccaacgattcttggattcgagcagggaatgttcagaagaaacaggagtcaaccgagaaccaggggacgctatgaagtatgaaccgaaccaagaaacgaccagctgctggaggagagatgagagtacagttcacttgccggttacgacggcgacgaggccggaaccgtcgacggcggcggtgacctcctccgcggtggacgacggcgagaacccggaggggcttcgccgcctcagtaggccccacattgtcttgtgctgccgtgggaagtgggaacagcttccggccggtggcttaaattaagacactcaacttgcttaaatagaacgtttcagcttccaatcaaacgtataatactcctgttttgtaagacgtttcaattttaaatggttcaactccatagaagttgacgaatggctattggtcaatttgtaaactcatttgctccctccgtttcatataataagtcactttgatttttttaaaaaagttagaagtttaaccaaatttacggaaaaaataacaaaacttataatgtaagttagttttattaaatttatcattaaatatatgttgataggttgtgttgaaaatattgctaaacttttctataaatttagtcaaacctacaatagttcgacgtaaaataaaatcaaaacgacttataagagatggtagcatatcaagacggtccaatagggttccattatgtagcaaattttatagcaatccaacttttgctactaaacacacatactgccccttctgtgcattaacccttttattagtatggtaaattttgccaaaaatattgtgacttcgtgattttaaccttaggacatcatacgatgagttttagagaagacactctataaatacgataatttactcgtgtacaccacgctgattattttagtgtattcttagataccatctattttaatcggtgaggtcattaatccatttcttttctcttcctcctccttcccgaagaaacaatcagcctctcaagctagttctcccctccaatttcaccgagccaccgctaaagtcatttgcccatccgccatcgtcagcccgctccagaagcaccatcttgccaccaaggccagcattggagactgcaaaccctctttctctctcctcaaacgcaaacgtgttctaatcgttatcattctccttgttgttgccatcctccgtaacctgtagatgagtcacgttgtgggatatgtagtcctgccgccatcctcgttgtcgtttcacggtcaacacgttgaggcccgcgctcactgtgctcgtgttgtatcaagctgaggaagaacattgccggatatgccaagggcaattctgcctcatcatgtacaattgtgggccctctcacgcgttgtcagatcgaatacattaaaaaaaatggcatgatatccatgggctaattaccacgtttatagattgtcatgatttcctgtagcaaatattacctattagtatgtgctcccttcgtcccataaaaacctaatgttgagaatgagtttaaacctaattttttcctggaaaccaaagttggtcaggaacttattttcctgtatctgttctcttccagcaattatttcagctttacatttatcatttctgtacagccagtgctccattcacaatttatctttggagatactttattttttctaactagttttggtttatttcccatagtagactttacatagctattgcgacaacaatttctatcaacggatttggctgagactgaaatcccacaatcttttggcgaggtccatgtcgagcgcatgagatttcagttcagtgatattgcagtcagaaaagtatttgccagtgactccagcaacctgaggatgcaatgccacatagcacactgtggctgcaccctgcaaaaacaaacaaggataagcattgaatgtatgagtatgagtggttttgagcaattaacagaaaaaggttatgaattagtaaatttttcaaggagattttgccacttcataagtttaatataacaccaactctacaaaaagtggtgtctgagtctcctcaattctctaagtcctgtctactctcccttctccctcatcccactcctatcctccgagtggcagcgacgagaggcgaaggcaggggcggatccagaaaatagagtcattgggatcattactgaaatatggtggtgtcaatatatatatataagagagtaattcttgtttctagagtgcattagcaaagagattagtaagaagtcattggtgtccgctgacaccaatgcttacactatggatccaccactgggcgaaggcacagctggtttctagcagcggcgatggttgcttcgggctgcggatcgatgatgacaatggttgcttcgggtggtggaggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22409 - DNA, 253 bp, Oryza sativa
agtgttaacaaacatccggacaacacgtttgaggccgggccaagcaaacaaacgatgcactcgactgtatgtgacctgaatccctgaatgacctccaatagctgagcagtggaaagctatcaacactctggtctgcaaagtggaattcgaacccaaccaaatacagcctttgaagcgaagaatcccatctgtcagagtataatctagaaactgctctggagataatactatctgagaaatgagttgagaagta

SEQ ID NO: 22410 - DNA, 1111 bp, Oryza sativa
  unsure (1)..(1111): unsure at all n locations
ttgatcaattagcaaataatgcttgtgcaaccaccaaaataaaaaaaaatagacaataactccacttcatttacttgcagtattttcaatagtgatgaactagcaaataatgttggtgcaaccaccaaaacaaacaaaatagataataactccacttcatttacctgtagtgcattagtgcattcaatttgaaaataatgctatggcatccaaagaaagaaacaaatcacaaaataactccacatcatttaatacatatcaataataaaataatgccaacatatacaaagaaggaaacaaatcagtgaataactccacctcatttaatactattatatcaatatgatcacctaaaaaataatgcgagcacatccaaagatagaaacgaatcagacaataagtcataactccagttcatttactcgtctctatctctttctcgcgcgcacgccaaacaataatacgtaaggaagaagcaatcgttaaattgtcacaccgtttttaactatttaccgcttcgaatacatggactacaagggtcactcccaccatcggtttccaagagctcaggatcacatccacatagacatcgaacctcaaggctgcaaagcatccagcagccatagtccatacgaatatacgatcgatacggcccgtgagagtgaacaaaccaaagaaagaaagtggagggaaaacttcaaatcgcaccccaaacattcaaaaaccaaacaagttccacccctcttccaccggctctcctcgcgcttcgaaaacccacacgaaaaccatcggggtgacgctgacgctggtcaatgacccgtgggccccaccccgccagttaccaccgcgaaacccggctcgcgagactcgcgtgtcatccggcctcctttccccacacttnaccataccaacgccggaaactgacaagaggccgcagcacgcagcacgcagtacgcagnacaaacccccttccttttccaccccaccccacccccaacccttctccgatttaaaagaaaagagggtgagagagagagagggattaaaacccaaaccaaaccaaagccgagggcgagcactcgaggaaccgagcctcttctctctctcgttt

SEQ ID NO: 22411 - DNA, 3034 bp, Oryza sativa
cggttgcggtggcgagggggtaggggtgctcggccgcgcgatctgctgatccgggacatgcgtgaggcgggagtgttgtagcaagagccattccgctggattttgtatatttttgaggggggtgagttgctcgtctctgattttgttttccccttttttggaatcgttgttctgctcggtggtataatctattctgagttcatcacccgctcgggtttcctttttagtggaggaggttgttaattttggccatttcatgtgctttatgttgcattgccctaagtttcttgattaggcatgtccaaatccaaagtagggtttagggtggatcatgctgttcgaatctaagtttagatttacatttttatgagaaattgatgacaacaagttaagatttttatgagtttctggtcatgcacagggtgttggaattggaatgggccataacggttctaagcggagtccggtgcctgagaccaaagacggagcgatgaaagatttggagaagtctacctccttggaggtggacgactctaccattgatggtgatgtggatcttggtggacggctcactgtggtggggaggaagaagaaagatggaaggggttccctggatgaaaatggggcctccacaaagaggattttgaggtccaactccatgaaaatgcatgtggatgctgagacaaccgggggtgtggctttggatgtttgcaagggtgacattttggagaagaaacagtgtgatatcataacagggggtgatagaggaggggtgctgacagttgatacttgcaatgctgaggaagatggggaagtgactggtgcggtagtgagcgatgctgtggttgaggcagttaggtgttccgcaaataatgtggaaagtttgggtcttgctgaggttgaaattgctgaagggaatgggttggacgctgacattcaggaatctgatggtgagatggataaggcagatgacaaactgtctacaccttctgaggagcagaatgaatctggaggtggaacaagtgttgggggcatcaatgactcccatgaaaacaagggggttaatgggctttgccagggagaggtcatagacccattggctacagcaaatggagatgaattgagcatgggtttaagcagaagcgcaagtggacgagaatctattgagcaagagataccgttatgtgcgctagtgatgatcagaaagttgagaaccattgccagtttgacgataagcataaagaagctgaaatttctcagattgagctcgcgggtgataaccacattatgctaactggatgcactacccaaaagaaggggatcgacagtcctgggaatgaaaccaagggggattcaactcctgacattgtttttataaggagaaaatcaataactagaaaaacatgtgaagccgaagcaggtgaaatctgaagatgaggttcgatttgagaagcgagttacaaaggctgctactgttagacagagagaggtttctgctagcatgtgcgtaggtgctacaaacgatgctaacttggaaagcaaagaaaggaaggaagatgttcatcattatacaaggaaagtgggcagcaccgtgcgctcaaaagttcatcacacaggggtggcagaatgcgacactgatacaaagaagaaactaaaaggaactgttaccactcgaagaaactcagatgccattgctaatgatgatcctccaagtatcacgcagaacaaggaatcaaaaactcagatgaagatcgatatcaagtctcaaccactcacaagaaggggcagcatagtaaataaaacagaagacgcagtttctgggttagaccagaatatctgtagttcagccatcactgataaaaatgatatagagctcacagattctgaaggagttaaatctgagaacaaggccgctgtgaggaagtcaatattatcagttggcgctaagattgttgccagtaagaagaggatattggaatcaggacttgataaagctagtggagagtcaccagttgcaataccatccctaaagaaggcaagagatacatcctcagacactgagctagagcaaccaaaaatgtcttctggaaagaaacttaccagaaataactgtggctcaagtaagaaaggtatgtcgacaagacggcaacatcagagtcaaacagctaagttgagtacatctgtgaattgctccaataaaaacgaatctaagctatcacagaatgaatccgatgatgatggaactggcagtgatacttccttgaagaacacttgtgtaagacgtactcgaagtggtggtgttgtccccaaaaaacaagaggattctagtgaatctgaggaaccgatcatactgagaaaaaatcatcaaagaggaaaatattctgggaaaagggctggatctacaccaaggaaagttaaagctcccaaaggcaatagaaaggaagtcaaggcttccagtttgaaatcttcgggtccaagtgagcagataaatacaggaagtcttcgtgaagaaaaacaaaaaataagtgatcatatcaagggcatgcttctagatgctggttggacgattgatctgagacccaggaatggcagaaattacttggattctgtgtatatacctcctagtggtaaaggatcttactggtctgtcacaaaagcttatgctgtgttccttgaaggtatggaatctgagaagaagggcagagctaaagatcagcgaccctcaaagaaatctgtaggtagccctgggaaaagtcatgtttcagaggaaatccttagcaaattaaaaagaatagtcgttaataaacgaagaaccaaagtagaacttcagaagttgaaaaagaggaaacatggtttactgaaaaagcagaaaacttccaagcgcaactcaaggggttccaaaaataaaatttcaaattctagaaagttgcatttaggcagcgaaagaaaaaagcgaggtggttgtgctctacttgctcgtggatcaaataaggatggtggaagcagcactaacggttttgttccatatgaatgg

SEQ ID NO: 22412 - DNA, 27141 bp, Oryza sativa
ccaatgagttgtctagaacttgaggtatgcacttaaatcgagcaagtaaatgcggtctatactctatagaagtctatttccttaatgccacccatatttactttagcaatacctgtatgaaaattctttcgagtacatcagtctgtcttttacttttgtcttgcctgctgtatctattatttttgtggttcctggattagaggagatgattgaaatgcctgataacgtgatctccaatttctttttgcactaaggcttgataatttgatgcaatgttttctaatggatataaacctcttattttcaggctcttccatctgatgattggcgttgtgctaagtgctcctgtaaattttgtcaggaacattcaaggcaggatgctcaagacattgctgaggttgactcttcactctgtacttgttcccagtgcgaagaaaaatgtatgtaatctctgcttgtactcccttttatagcgtgtcagtactttagatacatgcacaatttgtttagctattgattaacttcactgaaatatcgtgattgccaatcatttgtttttttgacacaatgtttttgatttcttcacaatgattatgtctgtagatcacccaggttgctctcctgagactactaacacatccaatgtctccagtcaggcatgcgatttattctgccaacaaagttgcagactggtaatactaataaaaaaattgttccttttcattcctagtttcgccgagcatgatttcagaactggttgttgtagtttcagctaagttagggtaggctagatatgaaatccaagtcaaaccacacgaaccaaaagattgaacttaaaagtaaggtgccaaaaaataataagaacaaaactcacctgttaaatatctgcagtgcattagggtttatgctgccacctttattcgtcagttttattgtttccttttgtgtccaagtagctctacttgataagcaactgacattgtgtaaagcaatatagatatgtaatttcaccaaaatcattaacatttaattctcctttagttttttttctgtatcttaatattccctacatggtgtctgtttactatttgaagtacacgggtcgttatttgttatgaatttctgtaccaagtgatgttttaggatggtgtgctactgaacttattagttttcaattagatttctgggcggcaatgatatctatggaactgtcaacagtgctctcatgcagtcattaagatatatctatagtttattttcctgtgatattcattataggggaaaggtaatgcactttggatgatgagggtaactaaaaagaatcatattttacaatgaagtgactataaataatatgtttactataatgcatggaaccaattcttttttgtatccctttagtatgcttttttgccatttaaatctaatcacataacacatattaagttactgtgttcatcttgtatttgaactcgtttagtgacacgtgataactttgtctttttattatcctactggtaaaatattatgaacttatatcccctccctcaaacctcactccacccatggagttactaagagtgatttacaggatctgaaatgacatttatgtgatgcagctgtttgagggattgcgtaatcttcttgctgtgaagaaggatcttgaaccagaattttcatgcagaattattcagcgtattcatgaaaatgtaccagaaacagttgttgctttggatgagagggttgagtgtaactccaagattgcagttgctctttcgttaatggatgagtgctttcttccgattgttgaccaaagaactggcatcaacttgatacgtaatgttgtgtacaactgtgggtatgcaccactctttctacactgctcacattactccatgcaattttgaggttatcttgtgaaacctctgtgatgttgatattgttttctctttgtaactctttgcgcgcacttcccctcatttcttcctctctgcttttggtgagtgggtctatggtgggagtttatcttacattattgctatagattcaatctggtgacggcaccagcatatgatactacgaatgggataatttaggctgatttgctagaacatctgcaaattcatttagaactgagtgcatttgcaagtaaccatgctgactatgtatgcaattagtgcacatatcaccaccagtgcttatatgacactgttcactgttgtcctgcaaatttctgaagataattttgtgtcgatctagttcactgcatgactctttaatgagccttttggcgatcctgagttttggatctggtgtatgcatcagctcaatgtgggaattttgagcttttggcatatttcctaatataatagtatgctactgtagccaagtaaaagtttatggaagccttaacattgtttcctccatcttcaatgcatgatatggtataatcaaatgttttttaactcaagagtggtagatgagtattcaatcactgtatatatgcttatgtggattgtggccttatgtgagatttaactaatcaaaataaacatatttatgcatctaaaggtgtatatgctaaatctaaactatatatgaccaaaacaacagaaaagtccctacccactgaagcatcagctatatgtgctccatataaaaaaggtatccaaatgaaaccatgtgattaatgctagtaaggaaaataaatccgtagtagctcacggtgagtgttttttatgattgacctgtggatctaccagctattgctagttttaactgaacacgtatgtgatactgcgacttgtttggtttctgtttagtatacactgtatcaaccttctagttcacgttttgctgatttactggactacgttattaattttatgatttttagttgacatcggatgaagtggccatgatatatttaatagttgcagaatttcttctgtgtttgacaagttgaaatggaaattttattccttgaaggatatttgattgccatcctgtttttgcctatgtgtaggtcaaattttgttcggatggacttccatgggttttatatctttgttttggaacgtggagatgaaataatagccgcagcatcggtcaggtgagttgccttcctcttgccctttttggatgctttgtcctgtgtatatatttcatctagattgaactctgtgctattcaaaaataacatagatgcatgccatcactagttctccgcatatactgatcatggtctagtgcatagctgagttgttttgtttcagttgcaaggttgcaagtactgcaagtgctttgattgcagtgcacacgcactaattgcaatcaattgtatacagtcattgtgccttttctttgcctgaactctctaatgaaataggcttgctatggttacttttatgtaatgtttttcccaatgaatcactgggcactaataagattttctatttggtctcttatcctgaaacagaatacatggaaccaagttagcagagatgccattcattggtactcggaatatgtatcggcgtcaagggatgtgccgcagactgctagatggaattgaaatggtatattgatctgagcccaaatctaggcatgattcatggtgattatataggacaactgtttattgcagaaatcctatttgcattgtgtctagtttcaagacattgaggcactgctcaaaacctgacttcttaatttatgcaacgtttttgtcgctagctgaaatatgtgacaaaagtaggaacaataacagactctagcttgtaaattgtagtgctctgatgtggttctgactacttcaggcatgctataattggtctttacaaaatagcatcttagatagtatttttctatatggtataatttgtaatacatatgtcggatgatacattggcctttgtattacatctctgaagagaataagtaaactagcttgcctgtctgcgtacctcattgataatagtttatatatgggcttacttcattttgcttgtttgagcatttgttatgtactgtgtgtactaacgtattctgatatttacacttcagatcctcagctccctcaatgttgagaagttgataattccagctatcgctgaacttgtggacacctggacatctaaatttggatttagttcacttgatgtttctgaaaagcaagaagtcaagtctaccagcatgttagtttttcctggaacaggtcttcttcaaaagccattgctaaagaaaacttcacctggggaaaattcaagctctcaagaaggtcagcacataaaatttaaccctcatatatcaatgagttattctcctcccccttttatttaatggtgaatggccatttgtgcagttgatggtgttttctctgagctcgagtctgggaaaacttccaatgtggccaatgaagactctctttgttctgcaaatgctgagactcaaggttcggctgccccatgttatggggacaacagcaaagatgctagtgcttgcaatggtaatgtttcacaataatccatgtaatgttactccatgttctcttttccttttcatggcatgacccataaattgaaaactcagaatacccacttgttttgcaaaacatgtcatgacatcttctacaaatctttgaagaacttgaaccgacatactgggtttcttgttgtttgagaagataggaatgcattacatgattgattaatgacatgaacaataggctacaaacttatgttagtggttcttagagaacaacgcatacatttgaattctatgatttcaatatcgttatgtttgtctaactattttgaatatcttttgcagattgacatgcttcctttgcattattttgtccctgtcaaaaggtgcaccctggtagtttcaagcattgacagatactattgaggacatgaagcacaccgatccttcattgttactattattctcttttgactcggcatgcggttcgtcggttggcagaagtagcctggatagagagggcgagtttttgaagatcccttgcagagcagcagcacctcggttctgctcaatattgatgattcaattgactctttggtttcggtttgacttgaaaccagcctgtgcagtgttggactccgatcacctaactttaagtggtttacctttacctgtaaagtcagcatgtagaactgagatgatagttttattccgtgttttttttttctggatggttaacttagtaccaaaggccaacgtgtgccgcaaaatcttcgtacatgtttctttacctgctatgtgacagtagctttgtttttgctagcccatttttttgcagccagatctcatctgtaagacactaatgcatgggcaagcagaaaaaaaatctcagatatgccacctgttctcatgttggaagtaaatctgataatgttatggcatctatcctcgtgttcatgcagatgcaaggtgcttttgttcgctgaatcgaactactgatcaggtgagatgtggtcaaagatcgcaaggttataatcactctggaaagcatttacttgtaatcatatgttctatctgctcttttctgtctttgccaatgatcttttcgcaggcaaagtgaaggctggctacaatgcaattatcactcgttgattgttggcagatagtactttttttttctgacagaagaaaataaatctctacagaaaggcgtctgcagtgttgaggttggcgaggatcttgtccttgacatctttgggcagcgaggcgaatggccctgccttggagtagaactccgccagtgatctgatggccttctccagcgcaacgtatgactcctggatgagcaggcaaacaattttgttaacaaatcgtcaagtaagcaacccagttatgttctgatgtttgcaaaattgcaactaaaaaaatcatgccatctcctgttccccaggtgagtgaacttgagttcaaacttgctttgaatttttttcatgatcgtttacttgtgtgttaattttcatatttattttaatttgatcggtgtaactcacttcaagcctcctttgaaatatacttctccgtcctgattcagggttcaaaatttgtcgccaaatgtaaggggttttggacggaggtagtttgaattttggaggattttcattagaattaaactatggagctagaagataaatcatgggctatatgtgtatccataaaatactacgggtaagtaacgataagcaaatggacgtaggtgaggattcagccttccctactgacaataaaaccattaaaaccatgagagtttcctagagctcttattaatttctttttttgaagtgagagctatagctttgtctatatttcttcctagatccatcacttcctgggtgtgtgaatgtggtagcagcgttgcaaaaatagggggaaaattggcattattacagccgaatgataacgctgagatgcgcgaaccaaacctcagcagcgacggcttgctggcctcgccagccgccgaggaactcccggatggactccttggcggcgtcggcgcctcgccggaacttggccacgtcgccgccgtcgtcctcccccagcgactcccggagcgtgcgcaccacctccctcgccgccttcaggtacgccttgggcaacaccttccccgacttggtcctctcgttcgggtcaaatatcgatttgatcgccccgaccaccccctccccctcgccgccgccgccttcctccgtcgccctggcgcgccccgccgtgccggagcccacgacgacgatggcggcggccagcagcgccctcctcgtcgtcaccgccagccgcgctccgcctgcactgtttgcgacacacacaatcacgcaggaatcagagttaagctgtggattaaccgcgagagacgaaaatcgaaggcggcggcgataagttacggatgtgctgctgctgctgctgcttgctctcggcgtctctccgctgcttcggcgacggcgaaggcggcgacgaacagcagtagcaccggctggccatcagcgacatggggccatgaggaggaggagacggcattgcacgcatgcgatgctactccggctgcgacatgcacgcgaggggcgatcggtggtggtggccgagatgggagaggtgggcgaggagagattggtggtgagctcgagcacgagcacagccaccttatctcatatctgcaagtagcttcagggaggaggagcaggagggaggcgatgcgagttggagagacttgggagtttggcgcgagaagacgacccggcccgcgagggatttccctcgcaaattgagtgggcttttctttggaggcccagaatttgttggaaatgggacgacgcagcaaattctcactagccagaaaatatgcaaaatctgctactccaaagaagtattatcctaacatgaaaaattcccttattttgtgtgtgtcggtgagaagtttgaagtttgaacgcagggaattcaaggagattcgacaaaatctgccattggaccaacataaagatatgtgctttcttccaggtcttaaatctgcagcctctctcttgttttctcccccccccctccccctctccatcgatccgccattacctggcttggacagatagtcatagagcgatacttctagtagttttttttaatcctccctaaccacttcgatgtatgagtaaactccgtacaacagatcacgactttgtaatccccaatggtgatgggatgatgtcattgcttacatttgcacgagctaccaaccaaccagcactatctgcgtgtgctctgagctcttttgtgttgtttctgcagtctgcaacgaggtccacttgagcatcagaattcagaacggatgaccccctgtttgccgcacacagaaagaacgcacggctcgatcgagcagagcccttcctctccaccgggcaattttctgcgagattttcgaaggttcttcgcaatattttttatagctaaacacgagaatacgatatcacagctgggttaggaagcagttgagagaactgaatgttttctcatgtttcataaattaggcttcgattattttttaaacctttgacctactgttacaagtaacaatataatcaagctgtcaacgaatagcgaagtgagcgtagctcagtcgattaggtttcttatggtggaatcagttcacccgtatttaaattctagatttgagacgagtgcttacatatacagctatttatttttccagcgatagatggcgtacctataaacaacgagacgtccatagtgacttcatcaatctcatgatatgctggcctaatcttccaaatatgctcattattgtcgataacgaggcatctgtgatgatttcgtcaatctcaagatatgccagcccaatttttcgaaagtgctcattgtggacatctttgtttgtaccgtgtttctaaacaaaattgcaacaaaccttacgggatttgggaggaggtgggttccgtcaaatgtacacgtaccgggttaactgttagtggggattgtctgcaatattgcacttgtagggatccaacatgtcagtggcagctactgtaagtgcagcactgcagataattcacgtccgttatctgcacatcatacatgcaaatgctgttttagaaaagaatagtttttctctgtttatctggaaactgaacaaatttatgcaaattcctatggaatcttgagtgcctgttcactttgatgccatttgtcaacgtttgatgtcgcgattccggtatttgcatggtatggggatcgttggtcctaggatatatgcgagacttaggtaaaagagacggagacaaggatttttatacaggttcgggcccctgaattgttaggtaataatcctacatcctgttggccgaagccggtgttgctctttattcatctagatcacacaagtacaatatttggggtagcctatcaaactgttgtcgacatggcgatctgaagttctgactcatagtcgacaacagggtagccttccttctcgaatccatatccggcgagatcagagacagcgctatatctctcctgacgatattcgtaggcaccgtaggggactagccatgtctatctctgaagtcgatatccggcgtcttgtcttggcgtatgttggcttatatgttgatcttgtgtcttaacctattgttccgtgtcccctctcctcctagggggccttgtatttatacccatagttgtccccttatccgagtagaactagggaaaccaatatggatataatccgagtagtccttgtcgtttttatgtagaaccctattcatcattccttatgcggaactcctcctatatccgaagtttgtttccgtataggacatgatatgtggtaggtcctgtcgagatttagtcaactactattaggtatatggtatccataaccctgacatcatttttaaccatacctttttttttgtaaagttgccaaaattttggctacgtttagtttattgccaattttaataagtacatataaaatcttgccaaaattttggcaactctaccaaaatttgacaatgccaaaacttggtatggtttaaaatggtaacaaagtgaaccatccctgaatatcgtcttaacctcttttaacatttgtttaaagaaataatagtatgacctgcgagtaccgtgacatatatacaaaaatattttctgagcgagaggagatacagggactagtgacaacaactgacaactgacaagtggagcagcactacataaaaagggcaggaggggatgatgcgggcgctacaaagtgcttcacatctttgcctcgttcgtcctccggttttctccgcagtttcttgatccatccgcctttcctctcgcagccgtcggcggggggagtggttagttggttactggttagtactccatcggtaaaaaaatccctccttttcatatctttttttcgcttccaatcttgcgcaattcgggacctttcctgccatttcgttctgtccaaattcagaacattgatacggttgtttggtgttttctcccccttttctgtgtctgtacactgctgttcgtcggttgatcttgtgtgagttgtgaattttggcaattgaagaataagaccttgatgtgtttgcacgcctatgctgttgttatccgtgtccatgcgagtgaaatgatccgctgaatttttgggtagatctgaacttggtacttgaatccagtagcatttgtgatcggcgcggggattagggtttaccgttcagaggggacgcggatatttaccgttgtgctccaaaatttcactgattgttttgggctcaccaaccttttgctttcttgcaggcttgcagagttttcagagagatttaggcaatggcggaatcaggccaatcgattgcgagtgatgtgactgcagtatgtagacaaaattcgccctttttatgcttgggactagctgaattgtgctttaattcgcctttagtgatgctgattttctttggtgctcgttttgggatgtcagctgatcggcaatactcccctggtgtacctgaacaaggtggtggatggatgtgaggcccaaatcgctgccaagcttgagatcatggagccctgctccagtgtcaaggataggtatctaaagtaccccagtctgtccctcctgctgatagttttgcgctttacttatttttattctggtggccatggtttgcaggattggttatagcatgattacagatgcagaagagaagggtctcattactccaggaaaggtgagacactgagacctgaaagtataaatcaactctcagattagaatatgatggagtcactttgcttatttgtgactaagaactcctaccaataaaatctactccctctagtcaaacatatttgattggagagagtagcgtaccattagaagattaatgtctcagacttctcatttaaggaaaataagatgttttggtctcaccatccctcgtctagattcactaacatccatatgaatttgaacatatatataaagctcatacataaatctattcaaaacctaaaacatcttataatatgaaacagaggaatggtgatgtcatggttggtaaattaatacaagcgtgcgtgtgtatctgaccttttattttttactggaatacatctgactgtattgtctgatcgatcctccctttcttatagagtgttttgattgagcctactagtggaaatactggtattggccttgctttcatggctgctgccaagggttataagctaatcctgacaatgccagcatccatgagcatggaaaggaggatcattcttaaggccttcggtgccgagttggtccttaccgatccacttctgggcatgaaaggtgcaatccagaaggcagatgagctggcagcaaagatgcctaactcttacattctccagcagtttgagaaccctgcaaacccaaaggtgctaaattgctaatatattattatccttgctagaaaagcacaatagtttaattactgttttgttttactggactatgctcagatccactatgagacaactggacctgagatttggaaggccactgctgggaaagttgatatccttgtctctggcattggaaccggtggtacagtaaccggaacaggaaagtacctcaaggagcagaaccctgagatcaaggtaacttatatactccctccgtcccataatataagggattttaagtttttgcttgcacggtttgaccattcgtcttattcaaaaaattttagaattattatttattttctttgtgacttactttattatccaaagtactttaagcataatttttcgttttttatatttgcacaaaatttttgaataaaacgagtggtcaaacattgtaagcaaaaactcaaaatcccttatattatgggacggagggagtacttgtttgcatgtttttatggttttgtgtatatgtgatggtgacttaactgtgtactaattttgtcttaaagatctatggtgttgaaccgacagaaagtgcaattttatctggaggaagacctggtaagatactgctctttgtatagctcaacttgcataaatcacattagtaatactagtactatttgtgatgcataactatggatgtcaaaaattatttgaaacatagggtgcacagtatggatggttcacgtatttgatgtaataatttagctgtctcgattctgttgaaccatcatgacattatcactgttccatgtttttggtttcaggtccacacaaaatccaaggtataggtgctggttttgttcctggtgtacttgatgtcaatctcctggatgaagtggtccaagtaagcaaatccaaattttctgttccaggccactaatcaaatgaaaaagatcttgtattgtttctatttttctgtaaacaatggcaatgcagtatgtgctgctaaacctgccacaaggcctgcatataaaaactctcttataaccacgtctctgtcgaatgtccagttccagttcacctgatgaaccgtttgctaaccccaacgttagaattcaattgttgatccacagatccagacatgcgcacggttatgtatatagaaacaaatgtacggaatgcaattactaaattgatctgaacatttcttgcaattctactctggtaggtctcaagtgatgaagccatcagcatggcgaagcagctagcgttgaaagaagggctgctggtgagctcagtaccccttaagaatccacccaactcttctccacctattgctgcacatatagcctatggtttaattccatgacaaatatttttcaggttgggatctcatctggtgctgctgcagtcgctgccatcagggtcgcgcagcggcccgagaacaaagggaagctcgtagttgtaggttccctcctcagaaccctgttttgccaggcatttcttaaaccgttcatgatctccattgttttgcaacctacaaaaacctcttagattctctgctctaacatgtccatcgccgtcatttgtgctcgcaggtggtcttcccgagcttcggtgagcgctacctgtcgtctgtcctcttcgaatcgatcaagagggaggccgaaaacatggtgttcgagccatgaacggctccagcattgtgcaaattgtgcttccatggtttagggggcttggagagaatggcgtcccgagtgcatttcttcatgttggtcgcacttgccatcatgtagtcgcttgatctgaataaagaacttacatacatcaatcaaagtctggggattcgatcagctttcctggtgttatatgagcagttcatatgtgtactttcttccatactgaaatgtgtatcttagctactgaagcttccatggattgctgggctgctcgagtgacaagaacacgcataaattaattcggcccgctcatagattcagcccacgcgagcgcggtcgtactacgaagctactctagtttattttcttgagcgagggtagctagcttcttctagtttattttctagaagaaactcgactatttttaggagtttttgattctgaaagaagctgtaatcactaaaagtttccttaaacatgtccctggtcatgcttggcaacagtttaatagtaataataaccaaatcaattctgaattttaaaatttggatttttgacctgttgagttgacagtatcttttcccggcgatttctgacctgaaagtctcaatcagacagctttcgaaaaggaaaaaagaaattccaaatcacacatggtttggtttcttcactggcacagagaaaataaataaaaaagataaaaaagtttttatttaggtggcggtagcaatccccgggcttcttttctcccaccgaaagggagctcgaaccagctcacacccccgcgaccgccaccccactccttcgcaccatcaccacaccaccctgtatattcctcctcttcttcttccttcgctttctccctttccagttgttcgcttcgcgtgcgcattcgcagctaccagtttggtttgcggcgccaagaattggtggctatagccttgccttttcttttcttttcttttcttttttgcatgtttgggcggcggcgatcgagctgagtcgatcggccggagtggatcgacgacggaaatggtcagccgctagcgttgtagtagtagcaagctactagctctgttcatcgagttgcagggcttgcgatcgtgttgtgttgggttgggtcttgggtttggtggtttgaatttggtgtggcgtttttcttgggcaggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacggtcggtcgcttgcttccctgccactgagctagctgatcattctttcgttgtccccggttcttgatatgatcaagaaccccgagtattgcagagctcgaagcgaactgttctgattttctgaattcgtattttgctgttgaaccgtgcgcgctaggtgtttgtagaattgcctgaatggaactgctactgaagcagcagctgttgcttttttgtgggcagattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatgtgagtgtttaccattcagaattctccatcttgatatttagtacttcgttcaggaccatttgggcttagccatctttccttttaccatgaaaatatatcgaacagacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacaggtgtgttctgtactcctgttcacgcctttggtaatctatggaccgtgtcagtctcgaattgtgagtttgtgactgatgttcttttcttcattgtgatgctatcaaactcagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagaggtacaaagaactccccatttctcaccatcttatttgttttcactatcttttttagaacatctccattcactctattgatttctctgcaatgcatatagtctaatccagtactggaagcatttggaaatgcgaagacggtgaagaacaacaactcgaggtgtagatttgaatcagcaactacaaccatgatatggcaattgatattttgtaatttccaaatttgatatgttgaatttttcagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggtaattctctagaaacacttaaataccacttccatcatctgcatgctcagagtgccatagtactgattacttctgaatgttgaactgatttcaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggtatacttcatagagtttttttttaaaaaaaggtccttgcatagactagtaagtactaaataagttgcggatgctataattgattcatcctttttacttctcaaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtatgtataaattcttcccatggtttataatctatcatctgcaaatatatatttctgctgtaatcaagtgtaaaatatattttaggtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggtaagaatgaaggtatatcatattcatcagtggacagtgatcaaatagcaagtgctattactcttactgcctggtacgtctagatctgaatgtgacaaaggaacttctttctgagctaacaggattgtggacaagattaacaactcaatcggtcaagatccagatgcaactaatattataggagtacttgatatatatggatttgagagtttcaagattaacaggtttgccagcagactagtttcaattatgcaagtgtgctattggttttgtttcttaatacctgaaacacaaatcatactatacttatctggcagcttcgaacaactatgtatcaacttgacaaacgagaagttgcagcagcactttaaccaggttagcgagacctttagattactactcctccgtcccctaatataaggggttttgacattttacttgcactgtttgaccactcgtcctattcaaaaaatttgtgcaaatataaaaaacgaaaaattgtgcttaaagtactttgggtaataaagtaagtcacaaataaaataaatttttaaataagatgaatggtcaaacagtgcaaacaaaagtccaaaaaatttttaaataagacgaatggtcaaacagtccaagcaaaatgtcaaaatcccttatattaggggacgaagggagtagatattaagaaaaaaaatattgcagaatatttatgactaataaggagactggtgaattcctgttacagcatgtattcaagatggagcaagaagactatacaagggaggaaatagattggagctatgtggaatttgtggacaatcaagatgtgctggacttaattgagaaagtgagttcctgaagcatttcacaagtgataattgtatctattgatgaataacacctgccaattccatgcagaaacctggaggaataattgcactactggatgaagcatggtatgaatagtcatctttccagaagaaaaaagtatttttatcaagaaactctgcatgtgcatgctgacacctgcaacagttaaaaatattacttcttatgttttgtccataaaaaaacattggggtagtttttcctagcaaaaaaaacattcagtagcatcaaatgcaagtttccatgtgttaccctatgacatgtgcctaactgcctatccatgcagcatgtttccaaagtccacacatgaaacatttgcccaaaagatgtatcaaacatacaaggcacataagcgcttcagcaaacccaaacttgctcggacagcctttacaatcaaccactatgcaggagatgtaagtgataatcagcgaaatgtgatatatcgtgtttagatttaccatcaaggattttgaacaattgttctagtaaacaggtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaaggtgtgtcatgattgtagccagaggcttagagttatatgaattagccttggaattttctgtaacccttcattttgctacaatatgtgcagcaacaactacaagctctcatggaaacactgagtacgacagaaccacactacattagatgtgtgaaacccaatgctgtacttaaaccaggaatctttgagaatttcaatgtccttaaccaattgagatgcggggtatgatgtgcattttgctccacattgttattcagaagccttgtttttttttgtgttattttactttctataaaagctggaccgtgaaggtcttttgtctaaaaaatgttaaaaatggttaatgctgcagggtgttctggaagcaatccggatcagttgtgctggctatccaacaaaaaggacatttgatgagttcattgatcggtttggaatgcttgcagcagagcttgtcgacaggtatggatactgatgttatgcaaccagattaggggattgagacatgtgaaaaacactcttaactgaaatatgtccatcaaatgttctcttattcttctaaatggataataaagtgactctaatgcttgtacagctctgatgagaaggctgcctgtgcagcaatatgtgataaaatgggtttgaagggatatcaggtaatctttgtgagaggtgaaaatggaatatatagcaacaattcacagaatatatatttgcaactcattgcatgcaaccttttgttttgatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggaggggtatttcttcactgatgtgcctttagtaattcatatcttccgtattagtaataagttctgacttggcattgacatacaatgtaattcaacactgcagcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccaggtttgtagtattattaatttattatgatggcactgaattaactttcatgaaaagcaaccacaatttttcttgaacagaaataagcagcaaccacaattaaccgcttcattcattatttccagactcgatggcgccaacacaaagcttatgttgattacaaaaagcaaaaaagagctactttgattcttcagtgcctgtggagagcacgtattgcaagaaaggaacttcgaaagctcaaaatggtttgtccaattatacagttgaaacccaagttattcttgtgtgtatgttaatgcaatgtcaagtaaaaaaatctgaaatggtaaacaggaagcaagagagactggcgcactgaaagaagcaaaagacaaacttgaaaaaagagttgaggaactcacatggcgattagatgttgagaaacacttgagggtaattcactgtagagttttatctgtccttggacccaaatgaatttgctaaattggctgtgtacatcccttctggatgtagaggccgatttaatccattttctaaaaagaatgagtttgctaaatattgtcatgctgacagattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggtataatactcgataagctttaattttactaaaaaaatgattcagcccttttgcttagactaattaactaattaccatattcatgtttgcatccaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggtattaattattttaaatatttacataaattggctcgtgcatattacaaatgatacccagtcacggccttatgatatatggtgcaggcttgaaacaaatttatccagcttggaatctgaaaaccaggtcctacgtcaacagtcactacttgcatctgcagatgacgataaatcaaagcaaatagagaggtaatttttgaaatgtttgcactgcaattcttatccactttgtttttgaaagcctcataacttaacataacaaactcttcttctagtctggaaagcaagattgccatcttggagtcagaaaaccagttgctccgcagtaaatcttctgtagctgttcaagcagtaattactcctgaagtgattcagccatcagcaatggaggtataatcctgtcagtttaacattaataaaacacatctcttatctgataagatggatgatatttctgaagtatagtacacagttgcactaaattttctatcaaaaatctcaccagggccttgtgaatcgatatcagcttgaagaacataaaatcctcattgtacgtgtttttatagctctctattacccaacatgagagcaaaaaaaaaacctcagttggacattttatttatatggatttatatatttgctttgtttttttttcaggaggaggtggttgttcctcctataaagaatttaagcaaacaaaagtcgctcacggatcgacaacaagtatgtttcagtgccttcaaaatttttttatatcaatgcaagaaacaagttccacgttcttagttaacaggcattgtgcacattcaaaataatttttttctcgatttggttttcctgctctttcacaggaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgaggttgttacttccaaaatactatataaaactttccgtttgcagtgacattatatagttggtgagcaagctctcatgaaactcattatctgagtatttacagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcaggcaagttctttatccatactcatgctttgcgtaaagcaaggttctttattggcattgcaagtcgaagttttcaacatactttcgtactgattaaccaattacttatatatacaccacatcaacgaccaaagtgatattcacaacataaaaatgagcttacatcccaaaaattgcgtgtcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggtatgcaccccagacatttccatgccaatcgtgaatataaggcgatacaatttcgttaacaatttgtcaatttcacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtgagtatggcaataattgttttcagttgtcccatgatcagggagttttccttatgaattatctattcgtaggtacctccaatgataatcaggaaaacattcaatcaagcatttgcctttatgaacgttcaactcttcaataggtatctcaccacctctaagtcttgtaaagtaacttcagttaactctggttgactacacaaagtcatatgaaatatcattagcatatgggggaacaaattggttgattctggactataacaaaatctataccttctcattcagtttgctactccgtcgagaatgctgctcctttagcaatggggaattcttaaaggctggtttacaagaattagagcagtggtgctctgtaacaactgaagaggtgaagtgaaaattgtgtataattttgtttggtgacaaatgagtaaaaggcaaggaagtatttgaccaaatgcgttgtgataatgcagtatgcaggaacgtcttgggatgaatttcagcacatcagacaggcagttggatttctggtatgcttgaaagttgaaaccaattattttcaaattatatagatgtttggttagcatcatgtgaattcgcgtgcaggttttgcatcagaagacacataaaaccttggaggaaatcactgatgagctttgcccagtaagtcctgaatatgactaacttgtaaatacttgaatttctgcaaaagcgtatagtatgaaacgtagtgccactttcccaggttttgagcatcactcaaatatatcgcattggaacaatgttctgggatgataaatacggtgcacaaggtctatctcaggaggtaagttgcaaacttctcaatacttaggcatatttcccttttcaactacaatgactacttccacgcaaaaaaagtaaagaaataaaaataaaatcttcatatgatgtgaaacacaccaacgtggtttcaggtcattggaaagatgagaacaatggccactgatgactcaataactactccaaatagttcgttcttgttagatgacgactcaaggtatgaatatgattggctgctcagtactgctattaagatatgaacctaaaatgggagaaacagtagccattgatctaacacccaaactgaatcaaattgcagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagctaaacctgatgtaaaatttctgatatgattgtttctgtgtgtgtgattgtgagagtgtgtcaattcttaccattcttcatttactctgattgtttgacaagatgtatttttcgtgtaaatttgtacaaacgagagtatatttatatatatgtatatttcccccaaccaaatatgtactggtagagtggtgcatttctggtatgattgcctctaatatatgtttagaaggtaattttttcatccttaaaaaaatataatgaaagataccatattgtctaatataaaacttaatatttttatatatgtatctaacttttcaatataaaatttagatatgttgaggaaccataaaacttttcatgtttgggacacaatttttactattaccaactaacagcgtagtatttcagagttgaactgttcagttcagagttcattacaaaaagcaattcctctggcgcacacgacagagtccaatcacatgtggactcaaaaaatcattcacatcacaaccggaggaggaggggtcgagaagctcatgggcggtgcagctgccgccggatgcttcagtcggcgccgaggccaacccaggcccagccacaaccaaccacggcaagcacacgtcgtaggcggcgtggcgctggccgcatgcgcgagaaaagagagaagaaaaagaaaaaggagagatatttgaagggggggaagccgcgagaacacgctgaaccaacaacgctcccccgtcgccgtcctctcttgttcattcattccaggccgacctcactgacgaccgcccgttcttatcctctgaagcgaagccagagcggcaggcacgcagctgctacaacaaatgcatctcctaccaatttcgtcctaaattatactattaacttacacatatttgtattttacaaaaggtgaagtctattttaattttattattgttatatagtttaattaagatgaaattcactctaagagtttgtttggatatatatattttttaaaaaatcatgagctgtagttaggagtccgatcatctcaagttagcacataagttttttaaacagatttcttatatgattccttatgtattgacaaaagtaaacgatcttaaaaactaactcaaatacatatatgtatctccaaaagcaaacgaacttaaaagcctcatcatacacggatgatgtatcaaaataccgccaaaaacatcttcaatttttataatagtagagataacttacataaccaactactggctccaaatcatctatatccgattcatacaatagttacctataaacggagtactacacaagtcatagctggtcccatatgtcatatacacatgtattttaaaaagtttgtattgcagttggctacaaatatatagcatgttactctcctctatcttattttatattagtctgctattgtacctgctcttagatagtttgttatattttaaaataaatagtactaacgcatgagcacatggaaacaaaggaaacaaagttcaggtccacttctttattcttttataatatcattttggaatttactctggaatgcctcttatttgaatatttctggaatttactgagattacctcttttcatatttttcttggaatttactctggtccacgatggcacaaaagagtttttcttttttttctctttaagaatttgaattgctcaggaaaattattattatgttctttcttcatttctctactaggcatttcaattctggtcatattctattattacgatttctatcctacatgtcagtcaaaaatcgattatacagtatagtatggatgcttatgacatcgtccaacagagtttgccttctctaataaaaagaagaaaaaaaataaaggtttgcctttgttatggtgtttgaacagtcttttgtaacaagaagaaaaaagaaaaaaagaaccttgtcgattctctgaatattcatgttgaattggagttcggggcaatatacgtggccgtgaattgatggatgataagaagacaaaaacaactgagatttttcgtcaagcaacaaacatcttccagatatgaacaaaaattggacctttatgagtatggcagttgaacgagcagcatagcatagcagtatgggcctgattgggtcatgggctggcccaatggaagctagggtttctcttgctttttgtggaagtaatttaatagggggcaatgctatggccacacagccactcccactttgtaattaaaacacactacaaaactgggatgtttggaaatacctgaactgaaattgcaagaatagtatgattatggatgatttattagccctggatgatttagtttgctccactagccactgttaaatttattccctcaatgcctaactacaactatctttaacttttattatgacaagtagatatattgggataggatttccctaaaaattgtgagccacctaaggctgtaatattcctagtataaaaaaacacatttattggatgtgtatggcatgccacaaacttaccaaaactccgttacgtctttcttccatcgtagtacactgcaaaaataatgactatagattatcacggacgcatttctcaattttgtaaacaattttgtttttacacaaactttcttcctcattccaccttataaaaactctttaaaaattgacatatcaacttcctaacatttaatcaattaatttacgcccttccataacctattacatctatcaatactttcaacacatgcccagatatctccctaagaactactaccaccaataatagaaaatccttactaccaccagttgtcatttatacatgacacttctgaccagtaaatcaactagtactacatttttgcctcaaacattggctgtgtttagttcaacgctaaaattggaagtttgaagaaattggaataatgtgacggaaaaattggaagtttgtgtatgtaggaaagttcgatgtgacggaaaagtaggaagtttgaagaaaaaagttggaatctaaacatgaccattatgtcgtaataacaacatatattatactccttccgttctactccctccgtttcacaatgtaagccccctgttcgtttctcatgcaatctgaggataaaatagatactcgtggcacgtttttcaaactgctaaatagtgcgttttgtgcgaaaactttctatatgaaagttgctctaaaatattagattaattcatttttcaagtttgtaataattaaaaattaattaatcacacgttattaccacctcattttacgtgaaatacttaatcttcatcttcattttcatctttaggagattcaaacaccacttaaatcattctagcatttcccacattcatattcatgttaatgaatctagatagaacatgaatatgaatgtggtaaatgctagaatgacttatattatgaaacggagggagtatagactataaaataaggctgtgtttattggtt

SEQ ID NO: 22413 - DNA, 17948 bp, Oryza sativa
  unsure (1)..(17948): unsure at all n locations
ttttttttaccatctatattccacccctgccttctttgccccccgtacctcctggaattttcgccttcttgggatccaatccgcgaggagggaaagaaggcgggtttagatcgaactgggccggagggaggaggagaaggaggaaccatgcggcccgttgctcctggcgctggcgaccgtatcctttttatttttgttttctttgatgtgtttaatctgttttagcagcggggggttgcggtttgtgcggcagttcttcgtaaagatttgaacttctttttttttctggggtgataatttaaacagcctttttttttctttttctcgtgttcgaatcctatggctgtattattgtttagttgctcgcttttgaatcgaagtgtttcttccttgattcgcaagctacagaggctactgacatgatgcagaagctgtcgttggagagcaagaaggaaggcgccacccctgacgctaccaagaaggtagcttttgctggcgattcttgtctgtgatgtgttgcttgtgccatcctttttgtttgtttggaggagaggtagctaaaaattatggtcctttttgtgaattgcagcctgccgggatgccctatggatctgcaagcgccggcgatgcgcagaatgcggcgtcgccggtggacaggtcgatcactcccctgctccaggaggccgtgaatgccaacatcttgtatcagaccaatggatatggaccctcagcatattactatcctactggtacaaacacctagtactttgctggataatcaggtagtctaattaagtgctgattttaatgtttgtgcgttcgtgtatataggttatgacggctcagccaatgaatgggactccagatatgctgcccatgatggaacggagatgcctcctgtaagttaatgcagttatttatagttagttcatcactttgcgataggtattttaaggtgtaatgtgatatcacgagttcacctgtgcctagaggaggctaaggaccaaatatggagatagaaaccgtgggggacatatgttgttaatttggaatttaatgaattgcttgtctactcatgctatgtgttggagataaattaactcgattctgttacaatgatccagcagagtgtttatggtgacatgtatggatatggctatgctccctatggcccatatccttctggttctcctgtcccaactgttgggcatgatggccagtcatacggcgcacagcattaccagtaccctggtcaatattatcagcaaccagctccaaccaatgcaagccatggcgtcaatgctgtcaattctcagtctgagatgccctctgttgctgctcaccaggcacgtgttccggttgaatcagcaaaagctagtgccaatgggactgctaatgggatggcaaatactaacagtagttcattagcacgtaagcaaacccatcaaaatgtatcagtattaaacaatggttcatatggaggagggactttgcaaggtggaccatctgctaacaattatggtcacagtggtcttcattctccagttcagtggtatgatgggccagtctactctaatgggcatcagagatcaaatactaattccacatcttatggttctaactcgtattcagcaaaaaatcagagccagcgcccaactgcaaacctcatggtatgttctaggactgtccaattctccattgcccccctccttcccccactcttcttctttttccatagcttctcaaagcagtatgattgtctcacaattatttttttttctgcttattaaatgcatttacctagtattagattctgcgattactgccttccccttaagttgcacatagcaaaaatgatagtgatgcattatgtggctctcacaaagtacaagtattagcctaaaatatccatttgtttcagggtatgcatgcacagataccttcgtcgggaatgggtttgacatctcctagttatcataccaggatgtacccagacaacagattatatgggcagtatggtcagtatgggaacgcacttaaaactgggcttggtttcggatcaaatatgtacaactccagaaataatggacggtggggaattgttgatagcaagtacaagcctagaggtcgtgcatcttttggttttggcagtgagaaccaagatggcttcactgagcttaacagaggaccaagatctggaggattcaagcaccaaaaacagtttggaccttctgtcactattgctgtgaagggccaagccctcccctcagtcgggaaacaggagaatagtgccattccagataagggccaattcaaccaggaaggttttccagtaacatacaaagatgcaaagttctttgttatcaaatcttacagtgaggatgatgtgcacaaaagtataaaatacaatgtgtgggcaagcactcctaatggaaacaagaagctggatgctggataccgtgaagcgcaggagaaatccagtgaatgcccagtcttcttgttcttctctgtaagtattattattaccacattatgtgatccatttgtccctcatatcactctttattgacattgggcatggaatataggtaaacacaagtggccagtttgttggtgttgctgaaatggttggtcctgttgattttgagaagacagtggattattggcaacaagacaagtggaatgggtgttttccaatcaagtggcatgttgtcaaggatgtacccaacaacatcttgaagcacattacattggataacaacgacaataagcctgtgacaaacagccgtgacacacaagaggtatcctttctcaataacttgccaagttctgttgattgtacaatggtcaattgcaggccacgggccattaagggtactattaatgtctctgttattttagatagttaatttcatcgtcattttcttgagataattcaaatttcttgctgtggaaccagattagtcgttcagtaaatgagaacttaagacatgatatatatcaatttcttcatcatgcttatggtcatgagtggaccttcatgtataagaagctgatgaattttatttttatctattgatatggcatgacaatgtgatgatcctttcagtatgctccatgtgcgttacttaccaagtagatgtaatgcttcaggttaagcttgagcaaggtcttgaaatgctcaagattttcaaggaccacatcagcaagacatcaatcttggatgattttggtttttacgagaaccggcaaaagctgatgcaggagaagagagctaagcagcaactgcttcaaggacaggcaagcattctattcacacatagagccttgtgtggttaaaaaacctgttcagaatgttagcaccactcagagctattggtggtgataggttctgatgcctctgtttttatgcactttgtacagggctctcttgacaatgcttcacatgaaaaggagaagaatgcaattgatgggaaatccacagctcagaagcaggcattgagcaaggagggcacccctattgtcggcgaaatgctgaacgcctcaaaatctgcagttgaaagcagtgtaacaaatggcaattagcgcgatatattttctgcgttaattgccacagccgagcagtcagattgtgcaaattctgaaggttcgcggcgtggctgagcgatagctacttgggttgggacttggcaactaaatttcgtaacagactttctataggcttggtgcctggggagtgggtcagttcttactttgattttagctcgtgtgactggttttttgcgtcgttaggtctcatatattactcttatgacatcgggttttatgtaacccttatcctttttgttttttttagccttttcatctattgttattgttagcgaagcatccaaatttcgataaatctgaacaacagtaaggtagttttccgagttttgcagcactggagaaggtaataagacaagaactctggttttggttggtcctcccttgtgttgtgtactatctgctttcaagtgtcaatgtgccaaaatggcatcaatcatctcgtgcattttaggcatccacgatgtgcatgagaagaggtcttactacctactttacaattggagaaaatcctctatatatccttgagagagatgctctgaattttgcctattcccttatatactctcgagttttcattttgatcttctctatgtaatcgttaaatgtttttgaaattaactatataacccctctcttatacctgtgttagtttaatgataaaagcacaattcttatatggaaaaaatctatttgtaaataaacaaagggaatataattatttgacaacaaattttaaaaataaaaaaaattaaattaacttttatgatatcatcaaaatttgaacccaacaaataaataattttggttcacaatttcttgctaaaactcttctatggattttgtccaaaaaaaataaatttgttcaacagtttaaattttctattcaataaataattatgtcccatttgattttatcatgaattacaatttttcacattggtgaattataaagtagagtagatagcatataactgtaagaatgggaaatggacgatagggtcattttagaaaaaagaaaattaacaggcaactaacataatagggatagaggagattaaaatgaaaagttaaaggtatataggggatgagacaaaattcagaggtatagaaaagattgcgaaacttttcagaggtatgtggaaatttttttactattgtggaggtgggtaccagaggatgtagtaattccatccggcaagagcattactagtacctggtaagaagcaataaaaaacacttaactctctactctccctttttcaaccaaccaatgttttagacgtgggccctagcttactactatctacacattgtactccctccgtcccaaaaaaggtaacttagtattggaggtgacattttctagtacaattaatctggacataaatttatctttttttcgacggagggagtaggagttaggaataactataacctagtttcgtgggtttcatcttagagcaagttttttaatagtatagtcaactattagctccaaatcatctatagttaatttaatagccaattcatacaatagttatctataaatatatattacactattaatatatggttccacctgttatacacatattatgtcttgtagtcagtactgcaactggctataaatatgtagcccgctgccattctcttttatgtattatctcctcgtatgtgtttatagctggcttataatctagtattgtacatgctcttattgggcctgtttggtagagatttgctgcggctgttcagctgcagcagctacaatatagcagtagaaattgcactgcttgtactgttgaggcagtgcagctattgccgcagccggctgtagtgtccagctaacgaacagatccattactcacttgatcatttatacatcgaggatgccatagagacgtcctgtatagcctttttctccatgagaatcaaaatctcagcagaatcaggacctgattgtggctctgttagctgctggaggttcccaatcgtggaatagtgcacgtggaaatagagcagtccattagcgcgtgattaattaagtattagcttttttccaaaatggatcaatataattttttaagcaacttttatatatatgctttatgaaaaaaaaacacaccgtttagcagtttgaaaagcatgcgcatggaaaacgacaggcaatgccgaacacagtcaggttgacaaaggaaagggaattgagcatattaaaactccttcctcttaacacacatggactatatttatttttaaatttattaattttcatttgtacaccgacttctgaacttacaaatggaattacaattccagttacaatcacagggaataagcaatacaaatagctagagttatttacagagtctgctgtgcacatgtatcatgtatggatattgcagtgccaaactcttctcgtttctgacgagttctactgacacctgacctgatcattgtcctgatcgggttcacctgcatgtgatctcaatcgactgacatcgttccacagattacaagttcatatatagatccggcaagatttttcatggctaaaaacagttcagacatcgattccccataaaaacaaagaacagttcaggcacacgcagagtggcagatgcagaactcggaatccgtcggaacatgacatgttcgattgttcaggcctcccaaatcttaataattacgtgaagtgctaagtatacttataattagtagtaatataattagcagtataactagaatgataaagcccataaaacccgtaaggtcagaattaaggcttagaacgaaaagtaaaataacacaacatgcatgcctaatacataaagttaaatctactgaactagatattattatgttctatgaatcattgtgattgaccatttgttcgttttttcccgttctaaaagttatatcttgtcaatcatgataacaagaacgtggggatttgactgtcaaattttaagacctcactatgtatttcgaacaggaccttcaaatcctagctatgacgcggccccttcacatgcaaagctctaaccttcgtcaaggagaggctctacactgcctagatgagaagcaggtatcaattcactgttgcacaaaagataaacctgccaataaacaaggcaaataggagtattgaatatcacgcgtgccgatttcaccatcggaaggaaacgaatagaaaaaaaaaaggttcataatgtccaatgtatgttgaacacataattgtgtgagactgttaattactcactacatcttaaaatatgtacgtttgaggttttgcacataaatttaaaaatagataaaattatagagaggagggttacggttaatcgagatgaggaggtatgtgaagaataactatattttaagataaaaatttaaataaagatagtgtgtatatataaatgtggaggtgctaatgcaagatattgcatcgtaacttcagtgttagatggggaaccgcctatgacaggctggtttgcatgaaatgcaataaatttaatggacaacagtacacatatagcagcagattgagattctctaacttaataaatttaatggacaacagtacacactatagcagtagattgagattctctaactcaattatttcccactgacgtgggtcactgacacgtggaccctctacccaacggacccatacatcagtgactcaaagttagaggagaataagtgagagtatccttttcagtattcgtattggagtctggaaaatgttctcagagctgcagggaggacatgtccaggttagaaagcatttgtgagatattatctcccattcttatagaggtgtactcctgtatacctctttatacttgagaaatattttttctaaaaaaaaagataccaaaactaatctaatatattagaataggattgagaactaattattttttaatttatcttacattttgaggcgtataaatatttgtgccaattaagatatatttttagtggtatatctagaggtagagatacctctggactaacgtacacactataaggtatatatataactctcatacctcaacaattagaaaagtcttgtcattgcttatcataaacttgtttattaatcaaaataattagtttaatttatttacatctcaaatgcagtgcgaaggtatatacgtacctctccaaacataggaaagaacctcaagctaccaaccgatggttccaccactagctaaacaagacccatgtggaacagaaagataaataaccttgagcaacctcaaagtcatttagtatgagaatattttcagtcacataccttccatatttccaaataaaggattgctaggtttaagataggaactgcaatcaccttttaacctagcactgaatttggaaagacaagcaggagggtaattcactagcaatagcgatagtggcatgaacttccaagtggtggtagcgatgactttccagctatgacgatggtgtgttggaactccgatagagaacgtagagtttaggtttatgggtttggggtcaaggtgggagaggggtttgggagaggtggaaagggtgtggccaatgaacacgggaggtgaggtggtgacgaaaccacgactatagaggagggtgctggacaatgtcggtagtaggaaaaagatgtgctagatcctaattgttaagaggtgaggatagtgatgacttcccgatgacgggggaactgtcgaaaatgaaaagcacaatagggccgagtcacctaactgttattgggcttttgggaggaggagagaaaaaacaagttgagggtgatactgtaattgtatagatcttagtgcaataccagtgcgagctactcaaaataatggacctcatgtgccatgtaggccgagatcacacctcctctcccacaatgcagagttgctcttggagtgttttcaatttttcatgtcaacccttgccatcttgtattttagtcctaatgtgttttcaatttacataaagtcaaaaatttagcacgcacacacctagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacggtttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatgggtaggcactacctgtgcccgtcacacccgattgccatccctacacacaccctaatttccagaagcaaatataaaatctctcccctctactctcctcaatccaccgatggcagccagtggcaaacgagcaccaactgacggctcccctactccacccaccatgatccactagaggccggcgatatatagctccatggtgcccctcctctctcctcgcagcggcgacgtccaaagaggctgggaacgcggcggcggattgagtaggccgaggtggtggtgaagccaccgagtagcgggggttggggggggaggacgacagctccatggtgcccctcctctctcctcacggtggcagcaaccaattaggaggctagggacacggcggtggcggagccaccaagtggaaggcgacgtgacgagctcggtcgggaggggggggagggagaggactaccacaagctctgcggcgcatgccagtgcccctcctctcccggcccgcgatgaggagacgaagcccctcctcaaaggacgacgacctcgacaacagcggcgtgtgcgctcggctgccaccatcatcgcctctctcctctcaagcgttgaggaggagcgggattcggcctagagctcgacggcgccgcctggatctagccaaaggtcagcgacagtggctggcaacttgagctccaccatagccaactctctcctttcccgcgcctcagcggtagtcagctcgctggggcccctcccctcccagccgacgacgaggagatggggcttgagggctcggagggcgacggcgacagcagtaatggagctcggtagtggattggcgtcctcctcgtcgtccattgccggctcccctctcttctcctccaaggatggggaggtggggatggtggggattgttgcagcctcgcagtaagattccttgtttttcttagctttttcagctgaggctctcggctctcaagttagtcttgtgttacccacgaagtaatggtctctcaccgccacgatagcatgctatcctacgtggtgagccgtggccatgctccacgtaggaacactgtgaagggccacacgattccaaaaatccaaaagtaactaaattttgatggcattttcatgtgattaaaaaaatagacaacaaacagtcctttccaaatataatcaagagctagcgatcaaagttctggttggaccacacagcatacatgctgcacaagtgcacagtctacactacttgtgcggatctacccactcggccactcctgtctgtagtgctgtagtagatctccaatctcaatcgagaaaaggccatcgagtcggtgagattctttcacatatatagttcgccgtgaaagtctatttatagtaaatccggtgcctatatatacgtcaaatcaaatcaactatcagtgtgtgagctatacacactgacagtgtagtgtgctgctctcctagctagctagagaacgccacacactggactggactggatggaggcgtcgtcgaacaccaacgccatggccggcgtgatggcgccgctgatgctgcacggccgcgtggcaattgtcaccggcggcgccggcggcatcgggtcggccgtgtcgaggcacctggcgtccctcggcgcgcgcgtcgcggtcgcctacatcggggaccccgcgccggcgaacgagctggtgagcggcatcaacgacggctacttgcgcgcggaggaggaagagaagcgcgggccgcgggccatcgcggtggaggcggacgtgtcggacgcggcgcgggtgagggcgctgttcaacgcggcggcggcggcgttcggcggcgagatccacatcctggtgacgacggcggccgtgctggacttcgcgtacccggcgctggcggagacgagcgaggcagcgtacgacgccatgttcggcgtgaacgcgcgcggcaccttcctgtgctgccgcgaggccgcgaaccggctggcgcgcggcggccgggggcgcatcgtgacgttctcgtcgtcgggcgtcgggtcgctccggccggggtacgcggcgtacgcggcgagcaaggcggcggtggaggtgatgaccaagatcctggcgcgcgagctgcgcggcacggggatcacggcgaacgcagtggcgcccgggtccacgggcacgccgatgatgtacaccggcaagacagaggaggacatggcgcggtacatcgccgaggcgccgctgggccgcctcggcatgcccgacgacatcgcgccgctcgtcggcttcctcgccagcgacgccggcggctggatcaacgcccaggtcatccgctgcaacggcggcactatctagctaccctggcctgcgcgccaaaataaatgatttctccgttctaaaatataacaacctaaaataaaaaagatatatcatgtactaaaaatttaaacgtaagatttataatattagaatatgtcatgctagctaggttgttatatttgaaatattttgaagtagattttctggctatgaattgcattatcctggtacacgttgtgctcttaccttcagcttgggagagttgtgcgtgacagttataaacagtatttgtctgaatgttctggtcaccttatgagcacctgtttgttctctgtccttttggaatggttacttcggttttgatatactaataggtgacgtttttaactttttatttgtaacgtttgaccattcgttttatttgaaaaattagtgcaaatataaaaaaagataagtcatatgtaaagtacttttgataataaagcaaatgacaaacaaaataaataataattccaaatttttttgaataagacgaatcagctaggaccatgtatcctcgctactttctccgttttacaatataagtcattctaacatttcccatatttatattgatgttaatatcaatataaatatggaaaatgttaaaatgacttacattgtgaaacggatgaagtatatcctttccgtgttcgtgtgcggtgccgaactgccgatgcgatgcatccaatagttgcgctagctacatgctaaaattcgtcgtcgtcgttgtaacttgtgtttgttcgttcaatgtaagagtggtttcacggtactctataagtaccatgatttttacgctataaaatacgataatcttccggttaactttttaagaaccaaaaggatccacctaataattattttagtaaactgttaaactactataataattgatgactagttgagtagaaaggatcgactagactatttgaaaacacattatatatcggattgtcgtcacgaattatctacttatattcataaaagtagattaaatattttttaaaaatatcttgacaaatactcttctgtcccaaatataatgagttttggttgtattagtttagattggatgggttggatgagacatgttttagtaatataaatctagacagaccatatgcccaaatttatagtattaagatatgccacatccaaccaaaacttttttacattttgagatggagggagtactataactagtgatgtactctctccatctcataatataagggatttggacggatgtaacacatcctagtactgtaaatctggacagactatctgtccagattcataatattatgatactccctccatccacaaaagttacacctataaatagatttgagttttttccaaaaaagttgttcctatttatagtctttatatttttttcgacttaaatgaagagataaattaaatgttttattagaacccaaagagtcatctaaatactcattggttgtatgcttgcattcacttcttgattttggttgtatgcttgcatttcctatatttatattgatgttaatgaatctagacatatatatctatctagattcattaacatcaatatgaatgtgcaaaatgctaaaatgacttacatcgtaaaacggaggaagtattagctaaatatggacccacgtgttatcatgcacacgcccacatcacgttcaaggatgcttaaaacacttggagacattattgtattgtcgatgttgaagcaccttaataacttcatcaatttcaatatatactggctcaatttttaaaggtgttcttacgaaacaaagatagatgtaaagtgtgtgtgcatattcatagggatgattgtgtgcttgtgtcaaaatcaatagtctataatatctttcataaaagaatactcaaggttatctgaaagcatcctcatcatctatggttctgagttctgacttccgagccaccgtcgtccctcgctaacttcgcatcatctcttccgccacccaccaatagattcacgtttatagtccaaacccaccaactctatattacctaaggatgaaaacccgccaattttgagggtctgaaaaattacttccgggttcccaatttgaggttctgaagttacttgggatggaagtagattccacgtaaacttgaatggtttaagaattaaatttgaatagaaaattnacctatttatcaagatctgggaaaattcatacagatcagggaacaggaaaggcccatgaggcctccacccgacggttcagagcccacagaaccagacaagcccactagcccagtggatttctctgaaaaaaaatgtttttttgctagccgccgtcctccccgaaaccctaatccccaaatcgaaggatcgggagccgccggattggtcctcaaatcgaccccaaatcgaaggattgagccagggacgccgccggatccgtcctctaatcgaccgccatggcgatcgcccgcaccggcgtgtacgtcgacgactacctcgagtgtgagattgctagctcccgtgtcagaggccgtcgaatttttttttgcggttgccttcgatttgcttctgtttattggctccatttcttgtcgcagattcgagcacgctggccggcgacctgcagaggattctctccaccatgcgcgagctcgacgagagggctcatggtgatgatcttttttacactcctttttcatttttctaaaatacagattatccaaaaaaaaatttaaaaaataatcattttgggtacttctgatatgtagtaatttttaatagttgatacaaggctataatgtcatgtgattgttttgtatagggctagtgcccacttatagattaaatttatgtgatattgatagttttctcaagtttgtagttgtacggattatgtttctgttgatgcaggcattatgggacagaccaaagaacagataaagtatctactcggagtgccatcccatgggttcgacaggtcaaacatggatgatgatgaatctgcctcagagagaatgaaaaaggacatcgaagctagtcaggacaatgcgttgagtctctgcaccgagaaagtgttgcttgcacgccaagcttatgacctggttctgcatgcacccttcatttttttctagtcccgtaactcaaggaacttgtacatttcatttcatgttaagtgccatcttagttgcccgcttttcttttagacgagatcttagataccctttaattgatacacctaaacaaacttgatcgttctatattaaagtccaaacttattttgacagtttgcgtttgtcaagttcaactccagattccataatgaatagttacgaacttagaagtatcacacaggaagactaatgtttgcagtctaaaaactctgttttgttacaattacaaaccactaatagtatctggcatcttgagattatctcatgagatttaatgaaaagcctgatgtctgtcatactgtgttatgtctcatactgcccatatactaaattgaatgttcggatgcctgacactaaattacatcaatgctagaatcatatactaaattgcatgtcctaattctagaatctcaattacattatcaactcactgtgtcccattcagggacccagactaacgaaacaaaatccatttttgatatttgttccaatttgtgtcatttatatcctataatattttgttaatacctaactgtaagtaccatggatggattattgtacagatagagagtcatatcaaacgtctggatgaagacttaggccagtttgcagaagacttgaagcaaggtataatcaagagatagtagcatttaggagcaattgtgtttttgaccctgtttttttcaagtttgctcatttgaccctcttttttcaaaaatgaagatcaggcatgaacctgtttcatgaagacaacctaacggggttaactcagggaaaaataccatttatatccttgctcatttgaccctaatttctcaaaatcttcgtttatttgatccaattttttttaccttatccctataaaaatgtgatggcaatttttgactaaaatatgagacaaaattgacacaggtttgacatatttgacttagtttaacaaatttgacctagatttgaggctgaaacgggaaaggccgatactgtggtcttgtttatttttccaagggcattttggtcttgttcattctctaaatgcattttctaataacactcctaatggtgtggttagaagagggtcagacggcaggttcgtttttgaaaagtggggtcaaatgagcaaaattggaaaggaagggggggggggggcaagttggtagttagccttcagaatagggtctgaatcacaattatccctagcatttacttgtatcttagaaaggtcatcctattgagcagaatattgttatattaatgagctgatctcatttgcagaaggaaagatacctccagatgaaccatcaatccttcctgcaatttcagcatttagcagggatgacaaacggaggcctggtttcagtacacctcaagcaacaaagaagttcagagagagggaatgggacagggaaaggggtatggacttcgacttaatgccccctccaggtagcaacaagaaaacaactgcacctatggatgtggatcaaacaattgatccaaatgaaccaacatactgtatatgccaccaggtcagcttggaatgtatagcgattttcctggaaattagtctacatcaaactttttctaagatgttttctgaaaggtgcctctgcttcttattgatatttcagatttcatatggtgatatgattgcttgtgacaatgataacgtaagtctttatggtgctaagtaatgatagttttcttttggaggagtttaattcctatgttctaagttactactttcacttttatcaggtagttttagagaagctttagaacattctgaagtgtgatttttgttgtgattttaattattatttcaagcaatatagcattggatccatgatgttgtggctagactgctagggtggcggtgatcatcttatcttatgcttgtaatttccttttaccatttgttcttacttgctgccatccagaatgaggacatgcctcactgcttaggggtgatcgtttggctgatttggtcagttataatattttttacaccgaatgaattatatatttctgttgaacaatctggaaaactgaattagcggaataaaaaatagaaacagaacctgattaactgaataatactttggtcagttcggtcaatttattcagctctactagaacaaactgatagtaattacacattgtccatcatgtaaaaataaaatgccaactttgcagcgaatgttgggctgtagccatgggcagtcagccaatgtgggaagacgtcagatgttgggctgcattgcgaatccacacaccacataatcattaggatccacgggtgtgtatatatatattattaccatgtatactgcagcacagaattcttggttgattgtgaataaaatcctcgaaggatcgagccatgcatggtaggtgcaaaattcacgacgtcagtagcttagaaagttgattgcatgttagtcttaggttattacgccgcttcggtctgcaaagcctcgaggccgacagaataccagatcaccgaagcctgtcttggtgatttagccggccatattagcaaaatatgggccgtgtggttcggtttctcggccttttaattttcttgctcactcctatcgctgctttactcttgtcatttagattataaatattgggacgcctcttgcttatatatccttgaacttgttgcaattggcagatgttctagaacttgtcaatacaagttgttttgttcttaatgaattatgggtttgttctacgaaaggcatcaacctatgctaagtgttagctgtttaatgtttctcaacagtgcgaaggaggtgaatggttccattacacttgtgttggtctgacaccagaaacgagattcaaggggaaatggttttgcccaacatgcaggaatctttaatgagaggttctccaaagttggtaagaagcatactacttgccgcttttgctttctacaaatcctaatttgccttatagaagctcttgaattcattccatcttccaaatgaatattcattgttgtagaacagtgtagaggtgtaaaggagaatttacgtcatatgactcaatccttcattcaagtccaaagatttgcttttcagatttttccttttacaaatatatagtgcactagcagtatcagaattccaaattggaatgtcggcctctgtagtgaaaagaatggggtaagttagggggagaaaaagacttagaaaaggcaaagctataggtacaacaaaaatgaacttgtctagagaaacttgctagtcatacatcacataattgttaactaggtcgcatgtag

SEQ ID NO: 22414 - DNA, 36075 bp, Oryza sativa
  unsure (1)..(36075): unsure at all n locations
gttcctaactattatatgttggctcaacagtgcgaagcaggacagtggctccactgctcatgtgttagttcggcgctcggagcggtttcagaagatgcatgagggaatcctcagtaatgagttggtccaaagttggtaggatgcaaaatggtgacaactttggaattgtagggtgcgcattacttgacagttaacagtgggttaaggttgttggttcaccaggtttactttagtttgtccatgtatatgcaaggggcaacagtaagactatatatataaacttgttcaaaaatctctccctgtgagacagttgttcttatagtggtgaaatgctttactgctcagtgcagctgctgtagtctcccaaatgttggctaccaagtatccatttccatagttggtgaagcttcatctccactgatctcacatgattctgctcttttgagcatcgcatcttgcataagtagaacaccacagtaatcagtgaaacacatttgcaaacatatatatattgtttcacatgtttttcttgcttattgtgagccaacatgtacaatgaccattgttttgttccccagcagcattgagtcgccagctagcctgtcttgtcttgtctatctagaggtttgggttgcgcaggtactgagcccctgaccatgtggccccaggtgacagcacgatgggctccagcatggcgggccccacgcacacgtaggcgtacttcccgtaccactggtactttgaccccgggctgaacacgtacacctcctcgaaccctctccgctgcacgcaaatggagttcctcctcccctgcaccatcaaacgaatttgatcaaaagttcagatcgaatttgagaaatttatttcacttttattacgaaaattgagctgtcgtgtgtgaattttttgtgtttttttagtaatattattttctttctacctcagtattccttaacacatttcttaaaccgctaaatgatacgtttcatgcaaaactttcttatataaaagttgctttaaaatattaactaaatttatttttcaaatttataataaacaaaattcaattaatcactgataattttctcgttttatctgtccttaattttcatcctcattttgcgaacaccattttggttttggttttacgtacgtaccctgtcgatgatggtgaattggcggggggcgtggctgtagatgcggcacatctcctcggtcatccgcttgtagtcgtcgtcctcctcgccgtcggcctcttgcgcccccgcgccgccgccgccgccgccggagaggaccgcgtcgaaccccttggtggcccagcgccgcgcgagcgtcgtcgccgacgacgaccgcgacatgaagtccgggggcacgatggcgaactccgagagcacgggatctatggcgcggtagtcggagccctggagccccacggcgtaggtggcgtccggcgtgctcacgcggaggtgggtggacaccgcggcggacagagccaccggcgacggcgaggcggcgttcctcgccgtgaactccgtcgccagcgcctccgggtgcagcgtcacgacgcacctcgcctcgacgccgctcgcctccggcggcgcggcggaggccagctcgacctcgatggagcccgtggggctccccctgacgtcgcggagcgaccatgcgccgctcggcgaccacggcggcatcccgtcaccgcctccgccggcggcgccgccgcagcggaggtccagcgacacgccgccgcggatgacggcgcggccgccgaggccctcggcgacggtggtgtggatcacctcggggggggcgccgtgccacatggccggcttgtatgacgtgacgaggccgcccgggagcagcacgtgcgcggcgctgccgttgcgcagctccatcttgacggcgcagctgccgccgacggcctcgaagctgacgccgtggccggcgaactccgccgccaggtagtccacgttgggaggggcgggtgccgccgcagccgccgccgcgtctgccgccgtcgacgccggcgccaatgcgcgcgcctcaacacttgcaccggccggccgcgccctctggccgccgccggcggcggcggcggctagccgggaagagttgcagaaggcgagctgcttccatgaggtggtgagaggaggtggagtggcatgaggaggagtggtggcagtaggagtgcagaacgccatggccaattcttgcaagaattggtcgagtggcagtgtagccttatctgaaagactgcaagttctctctatctgtacctgtgtgtgtcagcagtgtcttcgggttttgaggttgacatgtgacgaaaatatcccttttccgttctcacgctttttaagtgcaaaaaaaattatatgtgatagttgctttaaaatatcaaatataattaattttaaagtttatactaattaaaacttactccctccatcccaaaataagtgcagccataagtttctgtgtccaactttaatcgttcgtcttgtttatttttttttttttgaaaaaactaaaaaaaataatcacgcataaaatactattcatgttttataatctaataccaataaaaatactaatcataaaaaaattttaaataagacggatgatcaaagtttagcatagaaactcatggctgtgtttattttgggacggagatagtaattagttattccctaatagcccaaacgaacggaaccgaaatgagaaaagaacattgtgatctcggtaggatattggagggtattctttactactacatctcattttattttattttaagtgcagttatggattttaatgtccaatgtttgatcgtttgttttatttaaaaaattaattaaaaatagtcacatatagtacaatttatattttattatctaataacaataaaaataccaataatatttttttctcaaataagacgaacaatcaaacattgcacataaacaatgcaaaactgtactcttttgggacagaggcagtacttatacttcctatgatcaaaatttacgttgctaatcttaccggttcctttaaaacataggattttgaaacacggggataaaaatctcatgccttataaaattcctgcataaaatagtagtcgtttgcataacacgacaaaattataggaattaaagacacgttaaaagaaatccacgaggtgagaataaacttctcaaagataaaacatggaatatagaaaaccaggtctataagatttttaaagttgcattccttcattccaaaggacactacagaaattctaaggatttgaattctttgaaaatcctaaaatatcgtccaatcctaaagaaatgattcatttcatatgattttcaaaggaattttcatggttcatgttttttcaaatccttaaatccttctctcttgtttttcttttgttgcaaacaaggcctaagaatttagactaatggctcctttggtatgcaagatttaaaaatacaagaataaaagaatataggaattagaatgtcaaaacacgggaattactcaatcttgttgtttggatgtttcacaggaaattagtataggaatttgaagagggaataacacaaggaatttttctaagagttttgaggaccctttaaatcatagaaatgaaaaaaaacgaaagaatataaaaaactcaattataatagaaatagaaatacaaaatagaggattgcaaaacgtagaaaaaatacaggaaataccatttaaaaacacatgaattggatgagagagatagactcaaaagaaaattttcaaaaagttgaagctcttgcaaaattttcttcaaattctttataggattgtccattacataggaattttcaataataggatatggttcatttttttatttcaaaggtcttcatagtaaattttcatatatgattgaaatccttcaagatcctataatttttctacaaatcaaagaggccctaagctatggtagatttttttttccaaaattcctataatttaggtcattccacataggaaaaattatcttagaattagaatcctttaaagtttctccaaatatcctttggtcaaaatgggccctaaactatacggttactagcatcattgctgctgctcccgcgacacagatgaattgctctcagattgctctttgttttccactgattatccgtacgtgtgcagctggtagtatatgcggttgtgctactaaacaccacaatgtcacctaattttcagattgggttttacgaggggctaaattctcaatttaaaaaggttgtttatatccgattagatgtagagaccgggtaaaaattattattctctaaataaataaataataataataaatgtcacctaattttcagcccctactaatgcactgaattttcagggatacgcacacagccgcaccgatttggcagcagtgctgatgcgccgcgctgccgctggtccagctctcgcctctctgcactgcgagtctgcgacgcagggagggagcagcagacacattgcccgttaattttcgtcagaaaacaacagcacaaaaataaacgaagtaaaaaaatacaaataaaacttttttatatttatagctgaaaaataaactatcataaaaaataaaaatcaatatttaattgagtttaaaatctatttttagatagtgcgtcgtttcgatagtgcgtcgtttctatcgataaagtaggaattaaaatctaaattttagtttgactgataaacaaaaaccaaacaatgagctgtaaagaagcgggcagataacagtttcttgctgtgtgtgctactgtttgcaagggtacaagagtagcattttctggagggatgcagatcatctgcagcagtactattgataggctgatatgtgagtccggatccatacatcagtccctgctactgcactaaacagtactgtagaaaatcaacattgtttctggagacattgttttcttattcagaattcgagctcatgcatgtgatgggacttagtggaggaaaatgattaattaaaacaacttagtggagaaaaatgattaattaaaacaagcagttgattactttatctatcttttgtgctttttgtctgtaatattgtttgcttagggcctgtttagttggcaaaaaattttgtccacgtatgtcacatcggatatatagatacatatttatattattaaacgtagtctaatgacaaaacaaattacagattctgtcaagaaactatgagacgaatttattaaacctaattaattcgtcattagcaaatgtttactatagcacaacattgtcaaattatagcacaattaggcttaaaagattcgtctcgcaatttcctggcgaattgtgtaattggttttctttctacatttaatatttcatatatgtgtccaaatattcgatgtgacagcgtaaaaaattttgttttggaactcaacatgcccttaatattatactgctggtagtgattcttttgagccgtacaaagcttctaattaaccaaatcgaagttctagacaagttcacatggccaagcctgctcttccctgttctctagaatattccaaggcgatatggtgaattaattttccgcatttttcatatgctcgttgctgaaatctctgtaaaatcaaagcaaaaaaaacagtgaagagatttaccgtgtcaagcaaatagagttacaagtttatacgcgacaaatatataagttgcggccgtgtagagtgtagacccaacattccaacaattttcactattcctcatgtgtctcaattgcataggattattcatcagtgtaggtcagttcccttgtttctctccaacatgtccatgtcatagtggatgcgtttatatttttcaaggaattattgatgcttggaattgaccttgcacttgacagggagcatgaacctgaacatgaacttgcttttccaggtagcaggcgtcctacacatttatctttcttgcaaaaataaagcttggtagacagcaagctatgcttttatctgaaatgttcacgtcttgttctaaagtaattaagtatatttaacatatatttcctccgttcctaaaagatattatttttaacatgacggttaatatattagataattgttacaacacgactacaccaatgcactatcccattctttaacaactgctttccactaaatttataaacaaatataataatgtttaaaataccaaattagttttattaaattagtaattgaatatattttcataatatatttgtatgggttgaaaatgttatttttttataagcttgatcaaatttgaaacaatttgattttgattaaagtcaaaacaacctacaaaattttttcagcatttttgttgaatacatgatattggcatgaacttttaacaattttagtatatgtatctataccgctcacaaatccatgggaaattctcgtaccccccctccccccaacatatcgagtcattgattgcagaccatgttaccagttaatgttatgaaaccagcacaagtcattgaattaaaaaaatgatgctgagaaaatcccatcataaactacttccttcgttttaaaatattactacctctgtttcagaatataacaactttttagctataaatctagacacagttgtccagattcatagctaaaaatgcttatatttgggacggagggagtactatctaacacgtgattgaatttgtccagattcattgttctaggaaatatccaatcacgtgctaggtagcaatatttttgaatggaggaactaagagccatactcaaaatcttgaattacaatatgatgagaagaacgggaccattttacaattggccttttttatttattcagagcatgtacaaatagtagattataaaccaactataatcatactttaaggagacaatagagaaaagaagagcactagattatagacttatagccagctataatatagatttcaagacacaatgattgtatgacaggtgggaccatgcattaataatgtagcatatgtttataggtaactattatatataaattggctactaaattgattatacatgatttagagttagtagttagctatactattaaacttgctttttattactatgattactataatgtaccctcaaagcgtgtagattcacggaggatatttagttagcctgtcctctcacccaaaaaaataaaaataaaaatcgaacccaaatttaaaagtcgtttggtaaaatttattaagatggtaattaaattagttgcgtccccaccgataaattttgccataataaaactgacccccctcgagccgcggtgagggaagcagcagcggcggaaggcgagcgccaccaccaccctttccacctccgccaccaccaaaatccgcgcggcgccgccccaaaaccctaatccgcgcggcccaccgcatcccgcggcgctcagatctagggcatcccccggcgatggcggaggcaagggcgacgaggcggcgggcggaggaggcggagatggaggcggaggcggggacggagggggacgacggcgacggtggcggcagcagcgactacacgtcggaggacgagggcacggaggactaccgccggggagggtaccacgccgtccgcgtcggggactcgttcaagcagggcgcctacgtcgtgcagtccaagctcggatggggccacttctccaccgtctggctcgcctgggacaccggccactccgtgcgttcgaatcccttttgccccccccccccccccttaaatttcctcgtggaatgggcgttccccccttttcccttcctagattcgtgatgatttgtgggaaatctcgacctggatgcgttttaatcatctggtgtattgcgggcggtttcgtttgtacccgcaacctgttcgttttattgctttggtggtatcataatggctaatttcgttgtaatgagtactggtttaattcgtaatcccaccatcatcatacacgaaatgtatctgttcttatataccctttgtgtttctgaatttgttggttatatatatgcagagatatgtggcgctgaaggtgcagaagagtgcacagcactacacagaggcggccatggatgagatcaagatcttgaagcagattgccgatggtgatcctgatgactctcggtgcgtcgttaagcttcttgaccacttcaagcactcggggcctaatgggaaccatgtgtgcatggtgtttgagtttcttggtgataatttgctgaccctgataaagtacacggattaccatggaattccacttcccatggttaaggagatatgccgacatgtgctcattggccttgactatctccaccgcacactttcaatcattcacactgaccttaagcctgagaatatattgcttgaatccactattgatccctcgaaggacccccggaaatcaggtgtgccgctggtggcaccttctgcaagaactgatgatcctcctccaaaggcacatgcaccatcagtgaatggtggtctcaccaggaaccaaaagaagaagattcggaggaaagccaagcgtgcagccgctgcaacttcagaaggaagtgggactgttgcatctggggagacggatgggtcagatgataggggaaatttgagtacggcaaacgagggtagtccgaatcaggatggagacaagaaagaagaaggtgaagggagtagacggggtagcaaagggaccaggaaaaaaatggcattggaggctgacctgaagtgcaaactggtagacttcggaaatgcatgttggacatacaaacagtttacaagtgatatccaaacaaggcaatacagatgccctgaggtgatactgggatccaagtattctacatctgctgacttgtggtcctttgcatgcatatgctttgagcttgccacaggagatgtgctatttgatccgcacagtggtgacagttatgacagggatgaggtatgtctatttatttctttccaagacatttcatatctatacaaaacttaactcaaactatcacctgtcaacactttagcttaaaaaaataggagtctatcacaatagaaatttgagtgatcaagccaaatgacatctactggctacagcccaaaactccagtttggcatgtacctaggttttcttttgtgacaatacttaaaaggaacatcactctgaaatttgatatttgtcaacatctaattgtgccatgatctcataaccaaaagcaaataaaatgaaagctacaaagattgttttggagaaattatttcttaataaagcttgagcatttcgatgcatcttctgactcagatttgtgggattcggtaggaatctaaccaattattccagaaaaaaaatgataatcaaattttaaatattgtaaataagaacatttcgttttgaaggcgatcatgtttggacaatggtaaggttgatatacataaaacattgtggggtaccggcctgatacagctcatttcttgttcatgtttgcttactgtttcacaataattttgaacacatagtatattttcttttcatgcttagttatgagacctgacaaggcctccaaaccaaaccaaccaccaccaccatacacaattacacgacgcaccctctcttcctccttactcgtggaagaagtactgtagcacataagatgacaggagaaaactttgctatgccatgtgtttattcaatttgtagtgtacttggctattcgagtctgacactttccttttaaccatgaataacatgcacctatgcattagaaactcgctttgttcaagaaataaacgaagtttcggttattggcagtttggcatggtctctggcatacatactttactattataattgtgattttatcattttgaaaatctgtgaacgtactcgtctacatcacgtgttctacagaagctataacttgtagtctataagagagaaaaaaagagagaatgaaactaagtcataccaatgtgataaaagccacagttttcttctaaaaatgatcggcaacagatgaaaggtaatgttaaggactggtctaagctagttcttttcaggtatgtcatatggttatcttgattgaatgaattctgaatgtgattgataaatacatttcaagtttgtggtatatggtattggaacatatcattgactacatgaatgcatgatgccaattgcttttttttgtcaagttgcattataagctcaaaccttttattcagttgtcctagttgattgaccacttcatatttgtgggaaatcaactgctgaatttattcaaacttttcatttagcaatattactaattgaaaagttctctgagtaatctttttataattcttaaacacctgccattgtttggagatgctgtgtgaaatagatatgggcaagtagcaaaaccataatgatagatatgaaatctagttgtcttccctatagtacagaatgccatccctttccattggaagtttattctgatcaattcttgcttgaagcaggatcacctcgcgctgatgatggagctattaggaatgatgcctcgaaaggtaacaaattttccatcttcgtaagctttcatgtaaattgttctgaattatagataaaatacaaagacattgtttcctagattgccttgggtggtcgatattcacgtgagttcttcaatcgttatggggatttgaggcacattcggcgcttgcggttttggccgctcaacaaggttttggttgagaaatatgaattcagtgatatagatgcaaatggcatggcagagtttcttgttccaatacttgattttgttcctgaaaagcgtccttcagccgctcaactgcttcaacatccatggcttgatgtcgggccccttcgccggcagcctaaacggccatcagacctgacacagaattcgtccgatgatggtgtttcagagaaacagaggattgagaatgaagagagagatgcaatggctgtgaacttggggaacattgccattgacggtgcttcatccaagacaactgaagacccccaagcaagtactatgcaaaataaaacaaatgctacccctgctaagtgagatgctattaattttacaagctgcattgtgtaagactgttttcagattagatatgtttcatgggaaacgagtgtttctttagatatattaggaatagttcctcggggaaagaaaagtagggcagacatttgttgtatggggttggttgggcaatgttagatttgttggggctgcagaaatgtagacacccctgacctttttcctggacatattctttgtacaactagaatctgcgattttttaaaaactctttaggagtgcacaatgatgaaatgagagtgatgaacctgagttattttttccccttgttcttggtgtagttgcaagtttacatttatcacatccaaaactggaaatattactgctttagaaatgttagtcctctttgacttggagttggagatcatagttttgagttgctatacattagtatgtgatatattgtcacctctgcctaattctcactatcgttctcagttattgatgtctttattgatgacctctgtaattcttttagacaaacctagattatgcataccgtctgcatccttttctgttccataatcccaatatcacatttgggtctgatcatgctagaacaggcagggcaatgcaagatagtcaggtcacaattcgcacaatgccactgaatttctggaggatatcggcttgaaatctcagtctaattgcaaggattctcgatcgagagattccatatttggtagagcattcggatcacgaggcaccgtgcaccattttcttgacaagtgtggccatgtacttgccgtggtgctcggcgagggccagctcgagctcggacggcggcctggagccgtcgccggagaagacgcccgcgccgtacggcgacccgccgcggagctcgcccatctccaacatcccctccccgaaggtgtacccgatcggcacgaacagcatcccgtggtgcgccagctgcgtgatcgccgtccagcttcatccatgcatgcagccagagagattcacggagcagagtgagatgatctgatgcgagagggatgcgatctcgcggcggcggcggcggatacttacgcggtggtttcttggccgccggcctgggtgccggtgctgacgaagaggccggctggcttgccggcgaggcgctggtggcggcagagcggcacggtggagtcgaagaaggcctgcatctgcgcaggcatggcgccgaacctggcagggaagccgaagaggaacccgtcggcgtcggggagcccgtcggggtccacgacggggatgacgtcctcgccgtcgccgccgccgccgccgtcgtcggcctccatccgcgcgagcacggcggggggcagcgtctccgggacgcggaagaggatcgcccgcgcgcccgggacggagcccaccccgcgcgccaccgcccgcgccaggagccggacgtgcccgtacatggagtagaacacgacgtagatgcgcaccggccgcggggccgccgccggcgccgggatcgaggtcctctcgcgctggtgcgagtgcgacgctggcgctgccgccgccgcggcggcgcggtgcctcttgctcgggatgcagccgccgcccttgcccatcgctggtgcccaccaccaccgcgtcacgcggctcgctcgcgcgactggtgagacgcacgcgccgcgacggtggtgtttggtttggtctccgcctcgcgcgtgcgcatcgcgtgtgctcgcgaaatggtggattccgcgtgatcttgggccgaaatcacggtggattccgcgtaatcttgggccgaaatcacggtggatcccgcgtggtattgagccgaaatctctgagcgattcggcccggaccagaaacggataggaaaaagtcaacccggtagcggattctttcgtgcttttttcctcgctgctgctccacgcgcacgggccaaagtcagtcggccacaactcctcctccgccttgccgcgaccatcgcgaaatcggaaggcggcggcgcgatggagcggaagcccgacgagccggagaaggcagcctccggcgccggcgccggcgaccctcctccaccgccggtaaacctgcttactttttttctacggtagagtgtcctcaatcttgagaacgaggagaaggaaattggctcaatgtgggtggtgtgtgtgtgtgctcgcagttcttggaggtgaagtgcaggagctccggcgaggtgcggcggttcgcgttcgggacgacggcgcggtacgcgctgcacgccgtgaaccgcaagctcgcccccggcgcaccggcggcgctgcacgtcgaggccgtgaaggacggcgaggagcccgtcagcttcggccccgccgcgccgctcgccgactacggcgacggatggaagctgcagaccatcaccgagcaggacgcgccgggttactaccagacgccggcgtccgacacggtatgcaagaagttcagaaaatttttttcctcctcttttcttctcggaaatcaagaacaaaatgagcaacgatttcctctctgaataaaattttcggttgccatgcagagacgagatgacacgaagcagtcggcgaagaatcctcgcgaccaggagacgatggcagcgtacatcaccaagatcgtgctcgcgttcgtgttcatcttcttgctgggcgggctgttcacctacctgctcgagacgctccccgacatgttccagcctgcatctgaacctcaacctctgtagaatttactactgatttgctgatgaaaatgcagcacaaattgtatcgtttatttttgagtgattttggccttcttgataaggataaagtttgctgttttgagcctcgtacggcggtcagctgcaggccttctctttgtttctgtgcaatgtcagtctgccaaattggagtattttgtttttcccttcatctaaaaaatattgtttccccaaagaatctccagagttatatagagattccaaatgcaaaaccacgggccaggaaggtgcggattccaaacacacctcggagttggtcttctccttaatttttaatcaactttgcaaagttcactttgatgtcttcaccatcaaatgtcaacggggcaaagctgtatcaaggtcaatgaagaagacaaacgtctgtttcacgcacgtcatagaagaagagaaaaagatcactgttgtacataaaacaaattaaggaatcataagataaatgctaacgaataggccctgtttgaaaaattgcaatggaattatcagctgagtagatcaactactatttggttcacttcgtttttacatgttacaatctcatctgtgtttcccagtgaggaggtagtatacaaacattaccaagaaaagctggtaaaacctacaatctaacaaaattcatttgcccgcatgcaaaatctttgatgacgtgtatttcttttctgtgtgttcagtgtttgcttagtgtgggcagggcaccaagatggcacaagcaactgcccacactgggaaatgctttccaccactgtgttatcaccaattctgcaactgcgatgccacgcttttcaccactgggtgatacttcgtgtgtagatacttctttgcgttttctgaaccaggttgcccaagccattcatcatataatcttttcgcaatagggttctcgaaggggttggataccgatacctggtacataaggccataagctttacagttagtggaaattctggcatacagcaaacataacatatttgcacagtagtaattagatcctagaagcatcacagctagcatttcatatgcacatgtgatgatcggtaaatatgaattgcatactaccacacagttatacttgattggcatgttaacagcaacatgatggatcaccataaatgaactgtgaggtcagattattctctctgtttttttttactaggatacatcaagtaagaagcttcaggtctactccacattgacatggaagaatccaaccaatgctgagacaacataacatagcatagaaaagcaagttccaaacaaacagcatgaaatttagcgagagatttcgctagcttacatcttggatgtacacatcctctagtagttggataagatccttcgcagactggcctttggcaggttttatttgacctcccccattcaggcagcctgcaagcgaacaattaaggtcatagaatcaagatcctatggctcagaaccatttacttaaagcgggcaagccacactgtatcataaatgggagtacctgaaggacatgccataacttcaataaagtgatattcgcattttcccatcttaatcttcctaataatgttctgcagatttctgaatccataacaaagtgcaaacttaagaacaggtttgccctccacctgtgcattaacacaacacacgttatacaaaattaatctaaggccacttgaatcatgcttaagagagaattgaaagcaggccaacatgatgcaggatgaattcacctccagtgtaacctcacgaaaatctgaatttcgtagattctgaaatcaactgatccttcaatttttctatcgaagagaacatgtgccgcatgtcgaaagactgtttctgcataaccccctgagccaccagaaaccccatatagttgaccgtcatcatcaacattggttaatctggatcaacaatgaacgtaagtatatgtgagtttccagatatgacagataaaacaactgtgatataccacagcatgttatccaaagcaacatgaattattctattgactttttattgaaggagtgattaaattcaatgcaaaatttgtaaatctgaaatatcggttgaacagataatgactgattttactttccaacttgaattctattaggacttcacccaaaggggctaaaggcacactagggactcacaatctgtccatgggagactcctctagggtcttgaaatcaacagatctggactgcacaagcatgaaaatggtataagcttctcatagttttttaaatgcatatcaaaagacaggacatgggaaaaaaatcagttacctgtatcaaatctaacacttcaccagtggttaatacggaatctacctctgtaacatctttatcttccactgagaaaacaaaatcatccctaacagcttctagttttttatcataacagggcatcacagtaacatgataaacatcatgtggcctacacaacaaattcattcatgtacaactgtaagtccaaatatttaagggtctatagtatataaaatatgaaggtaacacctttacatcaactatggcaaagtgctcacttcagaccaagttttccaaccatatgatgcttgatagcagcaccaatggcctgttgggggctcttcacagctgagatgtaaggcaagataaatgaaccgagagtcttttctgcatagcatatccaacctgcaagttgaagaggtttgaatatatttgtgcactaatcttactcttgtttataaaataagatgcaactaataagctaccccctacggtaaaaaaaaaaagggacatttaggacaagatcctgcccaacttaaaattccaacaatcaattttatattagaattagtttataaaatctaataagtttatgatattatgatagtacttttcgaggtaaatctatgtatatcatttgttttgtttttaaactaagcattcgatgagaaattattgatggtcaaaattttaaaagtttgagtgaatcttattctaaacatcaaatattttttaccagagtacaagcattatgtggaagtacagaattcatgatacctaaattacatagtaccctgcaaacaattttacctgggcatgcagatgaaagcatgggaagattttttccagcttctttgccactagataactggttttgatgataacgagtaacaaattcactgcatgcttcaattagggacagatctcgactggaacttgtgtcgtaaactgcctttacgcccatcgacttgaacagcgcagtgagttttctgaaaacctgagcataaaggtattaagctcctgcttttgttaccacgttcatgataaaaatgcactcctttatgcatctctagtcgtggttatgttcaaataaactagcatttcggacaaaacattttataaggacagatttgacagggaagcagataactgaaaaaaatatttaatcacctgtgattgagaaagaccaaagaatgcagctagcgatgctcttgactgtggagagaccgatactatgacagctttgtcagagttgatgcgagtaatgaagtcacccaagctttgcttctcaagcataactgtttctgctgatgttatgcaaccactatgggattaaaatgaaacagtcagcattatttggatttggacaagctgctgattgaatgaacagtgcaaggtagtaaagaaaacctgcaagccaaacagtccttcagtgaaatcttgactgcttcctctggaggatttgtgctcactgcaatttccttttgtttgatctgttaacagaagtgccaagatatgaggaatggtatgcggatgggaagcgaatcatccagttatactaattttgaagctacttgtacaaatgtgtgcagagatgtaaataccaaaggtgcaaagtctggtattgagtttattctgccattcaacaaacaattagggaactaggtgccagttagaaatcatatatgattgaacgttgctttcatgtttgcaaccaacacctgatactggacttctgttttggtttcatatgtttctctattactaatcaaaaagttttcttcaacacctctggagaggttgttcactcactgcaggctttaatttgatttctctcgactaaaacgaacagcaggaaagacagtatgcagcaaaaaaagcatctgataccataaatcccacccccgaactccgaagaattcagagtgttcgataatggtggctcgtctttagccaagaccattttgtcccctcgtctcgttcacaaacaacctaacagcagaaggacaaaatcaattccgcctccttttcctcctcctctctactctgcacgctctatcaatcgatgcctacaggctagacatcagcagtacagcactcgaaaatcttccaatatcgatacagaatcatcccgcatcgcatggtgagacgaactagtacgctgctaagattaccacgcatcacccatatggctacacaaaactacacacactttttttggtacgacgcacggttccacggccagcgaccaaccacgcgaccggcaagccaaccaacaccggagcagcgccgccgggcatagctccaatccagccccagcctagggcagaaagggaatcagcgagcgcggggtaggagtctcaccggaaggcggcgggcggaggggcccttgttgagggagatgatgcagtcctgcgagggggcgatgaagtcgttgagatccgacgcctgcagcgccggcgagaacctgctcgacgccgacgacgacgacgacgccatcgccgccgctctcctctctctctctctctctctctcctccggaacggaacgagagagcaatcaatttttcttcttttctcctgctttgaaggagagagaggggaagaaattgctgggcctcctgggcctggattggcctggagcccacggcacagtcagctctcgccccatgactttttctagtagcttctagaatttaaaaaaaagttttggatcagataaaaaaagggatttaattattgataagatatttttttgtttgctattttgggggtggattatgaaatggaaggggaggagatggaatgtaattcgtcttccttcatttgtatacacaagtgtgagatgcaaaagcaaaaggatggttggttggttggttggctagttgtgtcatgatattcttctcctcagactatcactcccccaacaactgggagacgcgacagcgacgcgaggagaggataaattaatcaagtggtgaaggggcaattatggtttgggtttctctttcattttgtggtccacagccttgacgctggcgccacgggtgacgcacctgatcaagcggagacgggttggattgaaaccaacttttgttcttccctcgaaaaccaatttttgtcctactttctccgtttcagaatttaagtcattttagtattttctatatatatatatatatatatatatatatgtctagattcattaacatcaatataaatatgaaaaatgctagaatgacttacattgtgaaacggagtgagtcctagttttttttaagtttcaatagtagagtttgaatgtttgttttgttaccaatttatgtctatgataatacacattctacgctatcaatctagaaagtatcaaaatttgccaaggttttaacacttgcaaaatattgataggataaaatttgattacaattcaaacaaacctaagtggtcgccggcggcagccgcttcagttttgacacgaacggattacggatgcacgacattgccagtgaatgcggaattagtacaggcaaaatccagtaccttccatttttcctcacttctcgatcatacatcatgccgttgtatacataataagctgtacaaactaacaaattacataaccatgttcaagggatgcaaccaataatggtcacactaatttgagcatctaaacgctcgacacggagcaaaattccaaaaggggcgatgaatccggtgaaaccaagctcgaatgcatccaaccaataggccaacaaaaaaatggcaccataacaaaactatcatgggcttcttatgaacctaagtactagatgtccttgacaggaaaatcatttcctggaattgtttctggaccgccgcctcggtctactgagcaacttcagcatgttatccgtcaggtcaagaggggaatcatcgccatcatcctgaagctttgtccctgaggtctgtgtcagccnnnnnnnnnnnnnnnnnnnnnnnnccctctcggcgagctgcttgttcctcttgggtttcccggcaaactgcatccctttgaactccactatggccctgaactcgttggtcttgaggtgctttgtcttgtacttgggaggggtgtggccggccctcatcagcagggtctggagcaggctcttggggttcattccgtccttgataatgttgcctttggtgtcgtcgctgctgctgagccttgctctgctcgtctcgcggccaaacacaaaccttccttcgcataggtcgcctgcagcgagctcttgtgcggcatataagatgtactttccttccttgtggatgtcgaagctggggtcttcaagctggagttcagattgaaaacatcgtagagttattacacatgactgatatataatagatgcggaagaatttgactgaaatcaagaaaaaaaaacactgcacagttagtttcaatcttttttgccctaaccgatgatgtaccacaggccatgtttcaatatcaaatatcatttcaagtgactggcaataaacaacaaaaggttgtctctctgtccattgcatgtgaattttctcctttgttcctagcttccacagaaggtggacagatttaagagaaataacatttggcgcactatagcagcatatgcaatgttagttatacatgcctcataagtcataacagcattggcaatgcctgtcaaatacttattaaacgctgactcggcaacagaaatatctagtggaacgaaatcaatagaatattgcatggcttaccttcttctgtacaagtttatcaagctcttctttaagttgcaagtagcattcacacaggctaggatccataaacaaatcgatgtaaccatcgagcatcttcaggtgcccagcctatgatggacaggttagaaggtatataggtagggaaaatagaaatgcaaaaatgtcataaagcacttgaacaagatttaatatttatataccatgcttccttttgtaacagcaccaccaaataagatcaggatggaatctgatactccggttgagtcacggatgaagacagcatttaccttcaccttctcaccaaagaccagccatggataagggatggtctggtacttagcattcactgaattctggaatagcgtaaaatgcaaataaatcagcacaattttggtatctgtgaaatgtaaggcactatacatggcaccctagatgggctatctcccatgaaaggtcaagtgataagctagtaagcagggtgttgcacatgaaaacttcaagacgttccagtatgaacttacagcataaagaagaacttggccatcatccatggtcttgaacgacatagagttttctctatgctgaaaggaaagctcaaaaattaactgacaagttttgtgttttcaaatagaatggaactttacaaagtagtctgacagatctttaccacaactgatgttatgcctgggaaaagtccagaacatatgataccacggaccaatgattgattatggctcaaactattatttgtatttgcatcagagtctaccaaaccagcatcctttaatatatagctgaattgcttccgaagagagtgaatggcttgaagtgtttgagcagaaaggaaatttctccagcagtattcataagcagacccttctctctctgcatccttccatccttcataagcccggactagggccatatgatcactataatcttttgctgagaatcttgatttggcggttcctgccaactaacaaatagaggacaaaaaatcaaacacatccttcttgccataatgaatacacaaagcctgaggcccaattcttccctttttttataaattttctatgaaagcaagaatagtgtctcccaattaataatagtaattagtggaaaatcaaggcatacatctctcttgtcctgtggcagcaggaaaggatcccgggcactcaatccagcaaccacggtaagtataggatcaatgcagcggaaaactgcacccattataagcatcttccccaactttggatcaacaggaagcatggaaaggtatcttcctacaaagttggattagggaatattaaataggtttcagtaataatatgttttgcagtgttagcaaagaaccaaagtgtaggatagatgtacctagatcagttaggttctcattttcatctaatgctccaatcattttcaggaattccactgcattttggacctgtatatttatcaattgatcagccaaaaaaaaaagcggagatgattgaaaacaagaacccttttgctagcccgtagccacccaagacaataagacatacagctagtggtgccgggggctgtaaggcagctgatagaaactccccaatgctgccaacttgcaaactttttatctgcaaacatagtgaattcaatggagttctaaggagctcaggaagctggtaatctgcaaatgcatcatacacacatctagggtagaggtgatagcattctccaggttgcacacgaccagctctgcccctcctctgcacgaagataatggggagactatcagacatatggcaaagaaggatatggtagaggaaaacaatagtatagtgtatctgaattaaggagttatcttcaagtttgatcacttgttacaaagtttctgatttttaatattgagtacatttctgctgcctattgaagcagaaaaaataaaagataggtcgactagccaagctcataagcaaaagagacacatggacgtgcttgttcagaaatataggtatttcccaaccacaaatctaaggcatgccctccccgagaaaatgataaaaaaagctgctaagctgcaaagtaagagtcaaaagtactaatataatactatagactcaaacaggacaaacgttcaattatattacattgaaaaaagtccattctactcccccgaactagttcaatggatcacctaaccccctaaactattttttggctcatttaccccctagaccatacagaaggttaaaatcgagagagttcaagaaaccaaataataatgaaagtaggtacaggcacatgccattttatgctgctgctgctgaaagacgagaagcaaaaaaaaaatcaaagttgggcattttacctgacgagcagaagcctttgaaatccatgagggaagcaagcagggagtgttatttagtgcatcgtatgtcgtttcctttgcctttccacaatccacgccaaaaacaatatcatttattgtaatacttgcttctgccatgttagtggcaagcactatcttccgaacattaggaggtggcttctcaaagattaacctctgcgaatatcataatacattcatagatgtcaatagcatgaattatacgatgcacaaaagatgctacagaaataagtatcaatagactagcagtccagatgcatacattatatataaaatatgtttatgtaatactcatatctccaatccagtggtttaactcgtatcacacaagcaatctcaataagataggggcaaatcagaagcaactacctgttcagctgtagccatggaaccatggcatgcaacagtaaatctctgttagggtcgcccaacaaagggtgtgcctttagttgatccttcaagcaactgatatcatcccatccggtcatgaaaactagaactgcaccagaccgctctttacgacatatgtggcaaagaacagcttctataaggttaaaccctatgcaatcaggattccaatttgacagagaatcgcgtgtcctcgatccataggtctcaaagctagaagttttaagggcatcctgtatagtacaataataatatcagaagaatgttgggaaagtgcgcgctctatatatatatatatatatatatatatatattgaaaatgtacctcaacaagcgttgtgatttgatttttcctttttctaggtaatagttgcctctgagttttccagactttatcttgtccataatcgtcaagttgattgcttgaggtcaacttatagccagtcctctctaatatatcttccagaaaatgtgccctcactggatatgtgaatccctgatagaagcagcattcatgagaagaataagacagatgtcagatgtaatatatttttttatatgagaagatattaactcacaggaatatggatagttggtgctcctccaaaataacttgagaacagttccgcatttagagtagcactcatcaagatcaacctcaaatcacggcgtcgtgataataggtcttttaggacaatcaataagaaatctgagaaaccaacaaagtaatgcaactttatcaggagtttaataaagacgatctcagcaaattcaaaggaaacaatgcaatcttccaaccttcattcatgcctctttcatgtatttcatcaacaaatacatgagttactccattcaggtttctgtcactgagcaatcgtcgtagtaatataccacttgtgcagaaaagcaaatgtgtgtcttttcctttgattccctccaatcgaactttgtagccaacctattaaaaaaactagcattgtatacaaaaaaatacaatagaagaatctagtaaagacattttgtccttaatcatattagagatgggacatggtaccatatgagacgaaaaaagaaagctttatcttaccgattcaccaagattctctcctctctcagtggatactctctctgcaactgccattgcagaaattctccgaggttgtgtgcagattatattacaaaaggccccacggccagattctatctctgactctaatacaaattgaggcaactgggttgttttgccacaccctgtctctccagatatcactataacctagaattgcataagaatgttcagaaaaattgaaagagacaaatgaattgccaaacatgtatgcagtatacacagattctatggctcataaacatatgttgtgaattatacagtatatatacctgattgcgtgcaatggctgctagaagcctttccttttccttgtatgcaggaagtgatttccggaattctagcatcttaactccttcaggtgattcctattgttacagatagatggatgatcaaccacaatggaattgttgaaatgagatataaggcaaattttacactaaatgctgtagaaggaatctctaatctatgtgtatccaggcatttgtaaattatccagatagagagctccctaaattctgtacccattgttgaggtacagatctataaaccatctaaacattttcaaataatccaaacctgtatccagattgaattcaaagttacgtagtcatatcaagagtgacatacctgccaacttctctgaaaattgcgcatccgtatgctcttcctctgaaggatcttctccatgaccgatcgatcgagaagggaatcctgctgctcatccaggttcacattctcagctttctcagccatctcagaaccatttccagttccacatttatccggcaagagtgcacgatcaaggtgctcctgcacaagtccttcaaccctcctctgtaagcttaatggaatcaccacctgcgtatttccatgcataacaaaggcattcgcagtatttaaacaccgtcaatttgcataagggaaagatgtttgatcttgccagtggaatgcatgggctcacctctctttgtggccgcttgtcgtccaggtccggcctgtaattcggcagcgggaccttgctcgcaacaatgaccttcccatacatctcactgccgttccacagagaaaacaccaaaccacaaatttcaatgtttcgacatctacatttgggaattatgaaccggagatagcaaaattacggtggaagacctgtagaggcccatcctcttggcgaggttggcgatctggtcgtagtcccggcgatccctccggtctctggagatgatctcctgctcctccgcgttgcgctgcagcatgctcagcttccacctccactcgtcgatgttcgccaccgacgacgacggctgcgggtcaccagttcaccactcgatagctcagcatggcgaaactggagaagaacaaaaagggaagaaaaagctagctcggcgcctgcgcggaggtggtacccggtgatcctcgtactcgtggtcgtactcgtcgtcggagaactgctccacggcgtagcccccgccggagctgcagaaggaccggcgggcgaagacatcgaggcggcggtggtagacgagcagagcagcgagcgggaccggcggccgcggcgcccggctgggcgagctggagagcgggaggagtaggatgcccagcccgcggcgcaagccgccgcgcatgctactgcccgtcggttggtagggtaggcaggctgggctctaccactgctgctgctgctgcggcgcgggcatgtgttagcaggtggggaggggaggggagggagagtgcacgccggcgtcggcaaaggggaaaagccaagaagccggcgtcgccgtcgtcggtgggcgctcctctgcttccggtcagatttgggctgaaatggttttgttcgacgtgggcttcttccgtcgtgggccacgtggcagacttgttgggccgttgccttcggttctccaaggctcggcttactgtgagactggacctgaggtgcttgatgggctgatacccaagtatagtactgatcgctccactaatggagtggtaataagttttggatttattataagttaaacttggtgtttttataagaaaaatgtaacaatatctataacactaaattaattatattaaatcctgctataagatatttgtattgcgttaggaatgttgttttatttttccaaagtttgaattataacaaaccaaaaatgacttacaccacaaaacggaatatagggattatattattgctcctttccttgataagtttataattcttttctgtgagcattggaatattcatgtgaaatttctacgtttaaatcaggtctaactttagatactccaaaaactaaaactatagaagtatatgtccatgttaaatgtagtgctaggtctttttcttttccctacgttttaaactgggtctaactgtagctccctccggcataagaccctgtttaattcccaaaaactttttccaaaaacatcacatcgaatctttagataaatgcatgaagtattaaatatagataaattaaaaaataatacacagttaaggaagaaattgcgagacgaattttttaagcctaattaatccatgattagctataagtgctacagtaaccagcatgtgctaatgacagattaattaacctcaaaagattcgtctcgcggtttccaggcgaggtatgaaactaattttttcattcgtgtccgaaaacctcttccgacatccgatcaaacgtccgatgtgacacccaaaaattttcttttcacgaattaaacagacactaagaaccaaacctgtagataggaaaaaaaacaaacttgtagataggaaaaaaaaacatcatataggtaggatcctatgttgtagtaacaacattaatttctacagtacaatcaattactaaacccgtatgctgcataatggaataaatatcccggcagtatgctgccatatggctcgtattgaagcgttgcagtaaagtgcttacaatacggatcctgtgtctatagtgagatggtactaaccatggcatttattgcactatgctaaactcgttgcttcttgtttttcaatttccacttcatcgtgataaactacttatacgagtgacataatgacacacttatcgtaataaacaatttcatcagacgttcaaagaaatttcacaagaatgaattcgccgttttacacaggaataggcagaacacgaccttacttatttttagttgacaaggatctataagcaaatggagagcacccgttttcgggataaaatttcatgaattatctttcaacacgtaattagccacgcgttttcctgtgaagactgaagaatatccacaaaccataattcgaggaggaatatatttttttcaaagaaattcaaggagaaaacttcgtcttaaaatactacaacttaataggttaggtttagatttactgttctaagatgattaaatattatcatactccctgtctagaaaaccaaactcatataggatattaaaggttaatttattttagagcgaaggaaacatgtcgcagtatgctggctgagacggagaaaatatgaattttagtagggcctgctcgccagcgagagagatggcaagatggctcacgtcagagcaggtacaatagcatgctataagctaactgcaaatatattttaagcagataaatgaggagagagaagggcagcgggctacagatttgtagccagctgtagcatggacttcaagacgcagtgtatgtataataggtggaaccagatattaaaaatgtagtatataactattgtatgaatgagctattaaattggctatagatgaattggagttaatagttggctaaactattaaacttgctctcacatgcaaagaatacagagctcttgtcatcattccgtggtgggaagcagacggcgacggatgtgccacttgacccccgaccgagctggccgtgggcccaaccaacgaccgttccatttgcacgagaccatatcacatcgccctggggggcccacctcgcccatcagattagattaaccccacggccccgcgccaaaattaaacaccggttttataccactcactaccccacactgacggtgactggagtgtgggcccagccgctgccgtgtcattattaggtcacttaatacagtaatcacccgaaaaaatattaattaatttaattatactagtaagcaagactggtcttgtttacaggtcaggagagatggcgccgccgcgaagcaaactcagcagccagcatgtctcacaagtaacaccccgaccctgcgaaaatactattttacccctcgtaccatccatgtgggtgatatggccgtgggcagaacgggtattacggcctccgaggtggagtttggttcgtgtcgcgtaaataactttctcggcgatcagcgaagcgaacagctcgagaaagaaaaagaaaacgtagaaaagtttttcgcagccgcggcggccagccaaccaaccaacccaaccagccaacgcggatcgcctctcgagcaccaaaccctacccggatcgccagcgcagccactcaccaagccttcccccccaccctgcttctgctgctcgcgccgggattcttggctcgtctgctcttcgcggtcggtgtcgcgccatcagcaaccatggaggtgagcggttcttggttttttcttttcttgcgccgcggcggcggcggcggcggtaggaagaggagtgatcgtgtgagggggttcgctgcttgcagggcgagaggagggcggtgaggacggtgcgggtgcggaacatctcagatctggcaggggagcgggaggtgcgggagttcttctccttctccggcgaaatcgagcacgtcgacatcagatggtgaggcgccgctttgcccttcgatttctttgttcggattgctaatggttgcgcctctgcattgctttagcaatcagaagtggtatatttctttttcgtgttctctgaaatccgcattgtgattttgggcttgcagcgatggggtggcgacggggaggacggcctacgtcacgttcaaggatcccaaggccctagagatcgcgctgctgctgtcggtatggctctgtgcattgattggctatgtttgtggatgggacttttcgctattggttgtggtggttacacaattggtgtgcctaatgaatgatttagtattttagcatactgccattgtgaatagtgtagttggtatgtgtagctacaagcctattatggcttgtttaggcgctgaagaagccaaattttgtgtcggttgctatcaatattgtagcgtgtagcgataaaaaggaaaatatgtattatataaacgggtattttgtcgttattataatatgtcacacttcctatagaacttgttggcatgcatgtacatattagagagcacataaatgtttatgtactaaatattcagttgtgttccttgtggagctctttcatattagatggatgacctaaaagtaagtgaggatcattatgtgaatcgaaggcatttttgatgcaaaaaaacattgaatcttgaatgctttatattcttcctatgattacacataaccgtgtgctttatggtttcatgcactggcaagcaaatgattgaaaggcggtgctttcttccgttgtcggtaaaatcttagaagccattgaccatggactataataaacaaaaacaaaatagatttatattaatgcctgctttgattggcatggaagtgagcagcatattatatggtgttactactgtgatcatttgactttgttattctgttttgccatttaagaaatctgctcccagttatatttctttatgtgcagcatgtgtgcaaatctgataaatgtgcatcaatttcaactgagattgtcataatgaaacacagtgcacagataacaatccagtgaatcttctaattagggtatattcagtttaaatctcattacgctacctaggtcttgcagcactgaaaagaaatagatgtttgataagcttcccctttcagtatggattatggcttattatcttctaagttccctttttcagggagcaacaattgtggatcgggttgtcaacataacccctgctgaagactacatctacatccctgttactgaccaggtgcaccatccaactaatttatgttacccaaatgtcagtactaaatcctttgattcgtctttttcatagagacatctgttttgaaaatcatgcagcaacttgtggtcagtgaggtggtcggtgaggtgacaagtacggctcctaatgcagatttggaccaacctaccgaggtgtccttcatttccagtgtactctattttattttccccggtatagacctgtagcatactatgaagttcccatgaaccaggggaagtgcgcactgataaagtttaacgaaaggagcatcccataacttgtagtaggtgggtggtagggatgaatcaatcaagtgcaacagcatgtgtgacatcttcccctggcatgacaattgggaacctacgcttattttcttatacatttatttagtgtattatgatcggtgctgatcaaaagtatctcattgtaccacataggccaatgccagccccactactggccgtgtttatgtcagcaaggctcatgatgtcatgacaactgtgattgcaaggggttcagcaatgcgacaagatgctgtgaacaaagctaaagcattcgatgagaaacatcaattgagggcaaatgcatcggccaagatcaattcctttgataagcgtgttggaatttcagagaagataaacagcgggataacagttgtaaatgagaaagtgaaatctgtagaccaaaggctacatgtttctgacaaaacaatggctgctttgctggctgcagagcgcaagctaaatgacactggctctgctgtgaaaaccaacaggtctcttcttatccatgcttttgcttatgttcagccaacaaatttgtttgacgttgtaccaataaccaatgaacattttttttttgtaatggttgagtagcttttaattttgatgaaatctattacctttataatgcctaaattcttttaggaggaatatataagatcttttatatacatgaatctccaaacactttactgatttttttccatcttcccctacttgtaggtatgtgtctgctggaacaagctggctaaatggtgccttcagcaaggttgctaaggctggtcatgttgctggctcaagaacaagagagaagttccaaatagctgtgtccaatctaacagcgaaagtaagtcaataataaacttaactatcggttgctactgagtaaatgaatcaagactctctatgtaggctacagctgataaatacttttagcaactctcgagctacagttccattttcctctttcatttagtcaaaattaataaattaccatgaaacagaccttcggttgcattgtcatttataggcatcaggcatgcctgataatttaggtttgactgttaccgtgctgcttcagtgtgtgcaaaggatctctttgcatctacacaatcacattaataaactctcacatgacaccatttctttctgttaggggctgtgttattatattatcctgaacgattaacttaacatcatattttcctggatatattttactcagacttgatatgtatcacaagttcacgatcttaatagaagaatcatctgttataatatctcaacccagagaaggagagaacaaagaagaataaataggggcaaacaagggtgggtaatgctggaacaggttgactgttagcatggaatcttaactaagaacttactgttgacatatagtgtgctgctaggtgatgattttgttaactttttggccaaacctaagtagcatcgctgaaggcagaacaaaggcacataatcccaccaggaacaaaatagcttcttgcaaagttcgctccaagccaattgatatgcatagccttttctcaccagaggaaatagtaattcaaattggaagggctatttatgtagcttgctgggctacaatgttatgtgtgtgtactttgcttctgagttctcatacttaaaattccattatttctccattatgctgcaacagggtcctgctgttgttgcttgagctgctgtggtcctggttttggaagctcttcttcctgggagaaaagtcgatcataaagcatcgtgcaatcaccttcactcagagtgtatcgacagtgtggcttgtaactgtgtatttcactgttcccattttttcttcggggaggtttttccagtgagccatgtcagatttggtacatagaggatctcatgtttttggaactttagagtcgccattcttttctttgtagtgtcgatgttaaattgattataggtgatagtgatattctgggccatatgttgttgactcggtatggattattggttattgaatgtctatgcttgtgccatgtttgttcttagcaatttaactgtcggtaattggaatgctcatccattggtagtgagtgttgttcgttggtatgtgttggcattgcttgaattctttactcacaacagcgactggttacttctgtagtggatacttaggcgccccttgatttaaaggaaattcataggaattttagaggattttatttctataggaattttttctatatagccctttaaattaaaggaatgaattttatggaatcctataaaattcctatggaatgcctaatgccatgcaaattttggaggaattctaacatgaggtagaaactttcctttgagtctttatctctcctctaattcctgtgttttgtctgcggtccaatcaaacggtcattcctttgtttttcctgtgttttgcaatcctctgttttacacttacattcctatcaaaatcctacggtccaatttccaatcaaacggtaattcctctgttttacacttacattcctaacttacattcctatcaaaaatcctatgttttttcatttcaggggcccttaaatatttatgactacatttggcacgcatctaaatgttgcttacttaaatcttgcactgggacttgaaaaatgagccgtttgccactttgcctgtttgaaagtcccatcgtatgctcctattcccgtcttattagggaatttttttacgtgttcttgtcacttacaaaatcaatgctgaaaaaggaactacattgtaatatcttaaaattaatctcaatattaagtttgaaaaattaaattttagttttttctttgacttatttgggcatccgatctatcaatgcaaaaagaaaagaaaggaggaaattcatatgattcttttaggaactgaactaaatcctgcaaaaattatgtaaatttacttcgattcagaaatcaaacatgacgcatatgcgtatatcctgccgcaatttcgcaatccgtagaacagaatctggactggaggtggtccaaagcatctattctcagcctctcaggaatctgcccggcttccgggattcccccacctcagaccttctctctctctctctctctctatatatatatatatatatatatatatatatatatatatatatatatatatatatatatatactcgctctccgcctctacttcgcgccatttccaaatccatttccctcgcctcacctcggtcgtggccgcgaatggcggcggaggcggcgccggagtgggtggagaagggggacaacgcgtggccgctagcggcggcgacgctggtggggctgcagagcgtgccgaggctggtgatcctgtacggcgactgcggcgcggtgaagaagtgggccgtcaactcggcgttcatggcgctctaggctgtttagatgctatactaagtttgccaccattcaccatatttttgtgccacacttgtcttaagttgtggcttaaaaaaatgagccacaccttagctagcaaaattggattgtaccacactttattgagttgatgacatgtgagacctaatagataagaaggaatcttgccacaagtgtggctatgaaccaaacaatagactaatttggttaaacttgtctaacatgagaggtggcaacctttggcaaactttgtgaacaaaccaaacagcctcgtacgccttcgccgcggtgctcgatcgtctgctggtgcgcctgggccttccgcatgtcgttcggcgacgagctcgcacccgttcgtcggccgccctgacctctccggcctcgaccaggcgggcttcctctctcgccggggcttcgccggcgcgtaccacgactaactgttcgatcgccgccatgcttggcttgagtgtgatggtgatggagccatgcatcatggacaggtcggtccgaggacggagaaggacagggaggcgttcccgccgaacaacgtcctgctcacgctcgccggagcggggctgctgctgtggatggggtggacggggttcaacggcggcgcgccgtacgccgccaacgtcgacgcgtcggtcaccgtcgtgaacacgcacctctgcacggcgacgagcctcctggtgtggctcctcctcgacagcttcgtcttcggccgcctctccgtcatcagcgccgtgcagggcatgatcaccggcctcgtctgcgtcaccccggcggccaggctggtgccgggcgatggtgatgggcggctctccggccgtggttcaccatgaaggtgctgcacaagcggagccgcctcctggcgcgcgtcgacgacacgctcgccgtgctccacacccacggcgtcgccggcagcctcagcggcgtcctgacggggctcctgctcctcgccgagccgcgcttcgccaggctcttcttcggcgacgacccgcgctacgtcggcctcgcgtacgctgtcagggacggccgcgccggctcggggctccggcaggtcggcgtgcagctggccgggatcgcgttcgtggtggcgctcaacgtcgccgtgacgagcgccgtgtgcctggccgtcagggtggccgtgccgcagctcgccggcggcggcgacgccatacacggcgaggacgcgtacgcggtgtggggcgacggcgagacgtacgagcagtactccgtgcacggcggcggcagcaaccacggcggcttccccatgacggccaatcccgtggcgtccaaagccgacgagatgatatggatataaggtgttttgactttggtcatgtttagataatatattaaacttagttaaatttaaagtagtttaattttgtctaaagtcaaaacgtgctataacctaaacggagggagtatttgctaagggaaatgctatagtaagggcataca

SEQ ID NO: 22415 - DNA, 36863 bp, Oryza sativa
  unsure (1)..(36863): unsure at all n locations
cttactaattattccatcctgatctcctcagctccatccatcgatcatttccaacctaattcctctaagagaaagtacaagctagctggttagtcatattgttaattttggtctcaattatgtctagaattaatcaagacacaacctagctgcactgtctagcgtgtcgagggcggttgcgcggcgccgatgcgcggaggcagggcggttgcgcggcactgatgcgcgggaccgagccggtcacgctggaccgtgccggtcacgcagcgccgtgatgcgggaccgccctctagcgagggaccgccggtcccgtagaatggaagagcggcacagagcggcaccgtctcagtcccgcattcctaatatgcggagaaggtatatttgtgaaaatatttttcatgcatgtatataaacataaaatagtgaaaaaaaggtatattttcaaatttaattctacagttacgtagaattccctatttgctaactgccaatgaattataatgcgcgcaagtaaacatggatcatcgtgtgggagtgcagtactcctaattactcctatgaactaagataagcacgcttaacatgttctttaattttgtactagctttgcttggacttgtgcaagattaattgctggagattgattagttagtgctccgattagctggagaaagttttcgactgctcaagtaattaaacgggctgaatggataaatggtggatatattatttattttatgacaatatttaagggtataaacaaatatcctacgcaacttatgaatagaattttctttccaaaaagttacggagcttggaaagcgtgcccacaataatttataatatgtaggaaaacaacgtgctaagcctctttggaatgaaagaatttgaaggatttatgtagaatttggcataactccacatcttatatcatgctaatctagaatttgcaagttgcatagcattggtttaaaatattattatatatattatttttctaaataagaacaatatgaataatccgtatatatggatttctaaagctaggaatacatgccttcaaaatattttagtttgaaataggaatacatcctaaattctatgaccattttataaattttttgtgttccagaggagcccatttttttttcataaaactccacagatttggcacatactactgtactacacaataggtttacaacatgagtttcataagaatgaacctggaaattttcataaagttccgtagatttgacccatatggcctcctttgatttgatggaaaatcatatgaatatttactaggatttcaatgctatagttttttttctcctaaatgccgtttggaacaaaggatttgacattattgaatcctataaaggctctttggatcgcagaattctagaacacgaaaatatgaaaaacgagcgattggaatgtcatggtccaatgaatcctcgagaacatgttgtctggttgcttcaaagggaaatatcaaaggaatttggagagagctaacacacaagtgtgatctccatgagattagacttcatgttaaaaatcctcgaaattacaatgaaatgagataacccaaaaggagtttcaaaggatttttggtggctcaatccctatgatcacaatccttcaaaattcctcaaaatatcatttgttccaaaagagaaattttttttcttggaatatcttaatccatacaggttagagcaaatttaacatggattaaacctaatgaaaagtttccttggtctttctcttcttaaaattttatgtttttccagcggtctacccaaacaatcatactatatatatatatatatatatatatatatatatatatatatatatatatgttatatatatatatatatatatatatatatgtttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctcccttcttgcttatcaacacgtacgttgcgtttcttggcaatgcgtgctgcaccgacgacgatgtggcgttcgccggcggagccggtgtgtatcctcgtcgccgccgttctcctgtcggcggtggcggcggcgacagcgggggaggagtacgtgaagtacaaggacccaaagaagccgatcggcgagcgcgtcgacgacctccttagccggatgacgctcgcggagaaaatctggccagatgtatgcagatcgagcgcgccaacagcgagccgtccgccgttatcagagaagtgacttcgtcggtaagccctctataggcgccgggcgtcgccgccgttgcgcgcgttcgatcgttgtacactgacattgtgttttgttttgtgtttgcaagggagcgtgctgagcggcggcgggagcgtgccgtcggagaaggcgaccgcgaaggagtggcagcagatggtggccaagatgcacaaggcggcgctcaagacgcgcctcggcatcccgatcatatacggcatcgacgccgtgcacggccacaacaacgtccacaacgccaccatcttcccccacaacgtcggcctcggcgccacccgcgaccccaagctcgtcaagcggatcggccagtccaccgcccacgaggcccgcgccaccggcatcccctacaccttcgccccatgcgtcgccgtaagccgcccaaaccggacgaacacatcgttgccagtgaaaatttacgtaatgttcaaggtgttcgaccgatcgatcgcatgtgtgtgtgcaggtttgccgcgacccgagatggggacggtgctacgagagctacagcgaggacacgaagctggtgcagctgatgacgtcggcaatggtgcccgggctgcagggcgacgcgccggcgaggtaccccaaggggacgccgttcgtggcgggggggatgaacgtggccggctgcgccaagcacttcgtcggcgacggcgggacgcgggacggcatcaacgagaacaacacggtgctcagcttccacgacctgatgcgcatccacatgccgccctacgacgacgccgtcatcaagggcgtcgcctccgtcatgatctcctactccagctggaacggcgtcaagatgcatgagaaccgcttcctcatcaccgacatcctcaagaacaagttgaaattcagggtaaccaatgctaaaacctctcaaattctcctcaaaattcaactgaacttttaaaaaatgtgcagggatttgtgatcacggactggcaagcggtggacaggatcacgacgccgccgcacaagcactactaccactcgatccaggagacgatccacgcgggcattgacatggtgatgatcccgtacgactacccggagttcgtcgccgacctgacgacgcaggtgtcgaacgggtcgatcaagctggacaggatcaacgacgccgtgagccgcatcctccgcgtcaagttcgccatgggcctcttcgagaacccgctcccggacccgcgcctcgccggcgagctcggcgacaaggagcaccggcagatcgcgcgcgaggccgtgcgcaggtcgctcgtcctgctcaagaacggcaagcacggggagaagcccgtgctgccgctgtccaagaaggccgacaagatcctcgtcgccggcagccacgcccacaacctcggcttccagtgcggcggctggaccgtgtcctggcaaggccagggcggcaacaacgtcaccgccggtaaatcaagcacgattccgatctcgatcgacactcgccgtcgcgtttgccactaatgtgaatcgtgatgcagggacgacgatcctggaggcgatcaaggcggcggtggacgagagcacggtgatcgactacacggagcacccggacaagagctcgatcgccgagagcgccaaggagtacgactacgcggtggtggtggtgggggaggagccgtacgcggagacggagggggacaacctgaacctgaccatcccgtcgccggggccgaaggtgatcaaggacgtgtgcgggctcgtcaagtgcgtggtggtgctcgtctccgggcgtccgctcgtggtggagccgtacatcggcgccatggacgcgttcgtcgccgcctggctccccggcacggagggccacggcgtcgccgacgtgctgttcggggatcacggcttcaccggcaagctgccacgtacttggttcaaatcggtggaccagctgccgatgaatttcggcgacaagcattacaacccgctgttcccatttgggttcggactaaccaccaagccaagccatagccaaagttagaggtcaaaacattttatctcaatgtgtagccagagccggagttaggggttaaacattgcatctgatggactattatattgttcggttaaaagtaaaatgagtgtgagggtatggtattttaaaaataaatattagtaggattttattggtgagtgattctcgtaccattttttttctacattattcgctacgcatcttaaatatttcctcctccaactataaaccccccctccctttccttccctctcctccaatggcggcggcgcgggccacagtggtcgtgtcggcacgggccacggcgtcggttgtgaagaatgttctcgcaaaatcgagagggtaagtcgtgtgcgctcgctctgcttctcgcttcccttactcatctgctagtgtgcgtttatatgtgttgtgttctttttgtgcgttgtgttgttcatctgcattgtgttcattcatctgcgttgtgttcatcttcttcttgcttgcgttcgcgcgtgttgtgtgcgttcgtgcgtgcgttgtttgcgttcatacgtgcgtcggtgcgtgtgtttgtgttgctcatcgtagtctcatgatgatgtgtgcgtgtgtttctccttatcgtagcgtgcgtgtgtttcttctcaacttatcgtagcgtgcttgtgttcgcgcgttgtgtgcgttcgtgcgtgcgttgtttgcgttcatacgtgcgtcggtgcgtgtgtttgtgctgctcatcgtagtctcatgatgatgtgtgcgtgtgtttctcctcaacgttctgctgctcatcgcttctcttgctcgagtggacgtccacccatttattgcatgtcatctaaatagttataaaaaaattgaaaaaatatgaactaagatagatatattacaaccacaaacatggaagttaaaattcaacttctacaacttgtaacaaaaataacaaacaaaactcaaattactatatgtatttttacaattaaatttgttatttttgttacaacttgtagaagttgaatttgaacttgtttgtttgtggagtgatatattacatattaatctatcttgtcaatttttttgaaaatttttcgtaaccatctacttgacatgcaataaacggatggatgttcaatcgagctattagaatccatctcccttgcgtgtgcgggaagtgtttgtgtgcttgttgcaaccattgcagacgctgttccgatttagttggtgtgcatcgtgttcgtgtgcttgttgcaaacgcttttcactctagttggatttagttggtgtgcgtgtgcgggtagtgtttgtgtgcttgttgcaaccgttgcagacgctgttccgatttagttggtgtgcgtcgtgtttgtgtgcttgctacaaaatatgtttcaattccaatcatgtttcatctaatatttttttggattttgtcagttgtttgacaaatcatttaaaaaactaaccgagctcttaaaaaaaaagatacgcaatataaaagacgaagatatgattggaaaaatcactaacacatgagacattatgacccgctggatgcaaacactgtttcaattccatttttgttctatgtttcaatcagttcatctaatattttcttggattttgtatattttttgacagatcatttgaaaaactaatcgagctcttaaagcaaaagatacacaatgtaaagggcccgctggatgcaaacgttgtttcaattctatgtttcaatcagttagtatctaatattttcttggattttgtctattgtttgacatatcatttcaaaaactaaccaagctctaaaagaaaaagatacgcaatgtaaagggcaaagatgtaattggaaaaaccacttacttatgagacattctgacccactggatgaatttcggaaaacacgtcaacgacaccaccgacaagactttcgtcgtcgctaacccccaccccgtcatccacaccttgcaaaaatcactcacttatgagatattctgacccgctggatgaattttggagaacacgtcaacgacaccaccgacaagactttcgttgtcgccgacccttaccctggatgaattttggaggatacgctggttacatcggcagcagaggaggcacgggcagcggtccggcggtcccacttgtcctcatgtgagcggtggcggtggctgctgattgcgggaggaggcacgggcagcggagacggcggtccggcgggaggaggcgctggcagcggtcccactagtcctcctgtgagtagcgacgccggcgacggctataaaggtgctcaggcagtgagagtcaagcatttgcgacaacccccacttggcatatcattctttccttttatttttttgcgtggacctttattggatagatcttgatactaatatgtttcttctgttttttcagacaaaagagggtcgtggttaactagaagtttcgatggtcatccagtgaaaaaataaaagttgagaaaaattcacggttagtaaagtagcgtggcacatgagcagtactactttttctaaattgtatttatactcgaatttttattttattttattttctaattttggattttattttattttttattttgattattagttaatctcgtattgggttcttatagggactcttctttcaatattgcttatttttaatttcgaatttcagttatttttaaattgtatctctagttggactctcattttatttttctccaattaatgtggtaatttctagctcctacagtgaacgtggtacctcctttcaaagctgatataatagatagaagattgaggtctgcagagctttttaaactcggtttacatcggttttaaatattgaggagacttatatcggttctaaggttaaggttaagggatgttgtgatacaaccaggagcttacataagaaacaaaatagatttattctaaaaaaaagaacggagtaagcttttttttctcaagatttattccaaatttttgcttaataattttgggtttactatatattctatagttatatgagtagtatcgagtaggcgtaggatatttaaagaagggaaatgaatgtaaatttgttgttatagatttattttttgcttaataattttgggtttctatatattttagagttataggagtagtgtcgtgtaggcgtggtatatttatagaaagcaaaggagtagaagttcatgtggctggaaagggaagatagttttggaagcctctagaatctatatgtgatatttttctctagatttttcctcacatatgattgttaggtgttttttctctagtataaatttatgatttttctttaaagaatgaggtgccaagtgggccaatcaaaaactagcaaaataaattgtatttatactcgaactcttattttctttttttcctttttgctaatttcagattttattttatttttttatttcaaatattaattaatctcgtattgggttcttatatggactcttctttcaatagtgcttatttttaattccgaattttagttatttttaaattgtatctctagttagactcttattttctttttctccgattaacgtgggaatttctagctcccacagcgaacgtggtgactcctttcaaagctgtcttaataataataactagcatggtggcccgcgcagattgcgcggctagcatctttatattttttctcatataatagcttaaatattttcacattttattattaaaatatattaaaatggtaacataattttaaattcttggttgaactaacaaacgtgtgatatttttaatgtattgtatatacgtgataattatttataaattgtatttgtatatggactcaagactcatatttcaatattccttattttctaaatttcgaatttcctttattcataagttctattcctatatggattctagactactcttccaatattcatttttcttagctttgaattttagttatttataaatagtatttatatatggactctaaactcttctttcaatattttttttaaaaaaattttgaatttcaattattggtaaattgtattcctatattgactgtagacattttttccaatatttctttttttttaatttcagtaatttataaattgtattcctatatggactcttttttcccaatattccttatttgttaatttcgaatttcagttatttataaattgtatttctagggtctcatcttttcgcttatgcttattagccaaaatttgaattttaacctattttgaggtttttttcattgaagtttattttcagcctttacttttagatcgctaagaacaggtatataaaagttttattcacaaattacttttcatttgtaaatgtgtcgtttcgcttattccgcgaataagcgaaacgatggctccactatatggacgctagactcttctcccaaatctttcttattttttcaatttttaatttttgtaattataaattcaacttctatatggagtctaaactctacttttagttttcttttttttagattcgacattcagctagttctaaattcctgtctggaccgtagactttttttcccaatatttctacttttctaattcccaatctgttatttctaattgtatttctatatggactctgaattcatttttcaatattttgtttttttttaatttcgaatttaagttatttataaattgtattactatatggactctagacttttttttctaatatttcttattttaaattccgaattttagttattgataaattgtatttatatatggactctagacttctctcccaatcttgtttttttttcattttcaattttagttatttctaaattatatttttatatggactctaacttctacttttagttttcctatttttttaattccgaatttcagttaattctaaattgtatacttgtatggactctagtctcctctttcaatatttcttattttaaattccaaatttcagctatttttaaattgtattcctatatggactctacttttctttttctctgattaatatgaaaatttctaggccgtgagagaaaacgtggaggctttcttttttattactttaataagataatagatagatgatataatagatggaagattgaggtctgcagagcgttttaaactcggtttacatcggttttaaagtttgaggagacgttatatccggttttaaggttaagggatgttctgatacaatcgggagcaagagataagaaacaaaatagatttattctaaagaaaaaagaacggagggagctttttttcttactagatttattctaaattggactctttagagccttcacgagctagtgagaaaaaaagaacgtagagtctgagtgcatcgaagacatcagcgtccgacgatgcataattattatacatcttattaaaatatcttataacttacatgttgggcaagtattccattcgattactaattaaagataggatccgttacagatagcatatcctgtgtaatatcatttgacgtaatatatttagttgagaaaactctcctcccgatgacttagttaaaaaaaacagaaaggatccgttaccggctggtaatgagatcaacatggtggctatgtggatccggtcacggcataaatatttacggcccgccgcctctacacgacagcgtggcgttcgcccaccgccgtgtgctgaatttcgtccggcgcgagctccttggtttcgtcgacgattcaccgccaattatcgctgatttactttttattattatatgccaagaccggccggtacgcaccttgctactcaattctttctttctttatgtataatatatgtttctgtccagccctaaaattgaagttgtagcttatacactatgagagtattagatgtactactatgttttattatcactgcgcccctccaatagtatagtctggttcgaaaatcctcaaatctttataaattattaataaattgtacaaatatgcgatacaacagttacgttttggtggcctccgattattgctttgtatgggattaaactagctagctcgatataatagcacattgttataaagttttattttctcatatagtagctactttcacacttttttacgaaatgaaaacattggaagtggtgatataatattgagttacggcatagctcgatcaatcttttgtgcaaggtgctctgatcagcatgataattcctatgctcataaagcaaaataattacagcaaaccaaagatataaaaagttaatagtaacctcccaattcgtataaaaggatatagcaaatgtgatatatggcttttattttcccttttcctcctatttgcttgagtcgatgcattgtatgttgcaccttcgcagtgactcttgtctttcctagtccttttctcttcttcccccctccgttttagtactacatgtttttggtttgtcttaaatcattttttatttgatcaaatttatagaaagaaatagcaacatctataattttaaattaccacggaatatatttgttttggtgttaaaattgtcgctacagtttttacaaacttagttaatttgaaaaaaaaactcagaatatactcaaaatgacttataacatggggaacaaagggagagagtatacgagtagtagtaactttatcgactagctcattcaagttaaggtgaggagccatcagcaacggttaagattggtgtgtccatccgtaacggcgccgtccgctgcctgtcatcgtccggccgtcgcggggtcggacctcgcccgccgccgcaccaggcgccgccgaccgtcgcgagaagtagtcccttgccacttccccgccagatcccagatccaggatcggatctggcagtcacttcaccgctgccatcacctccacgcgccgccgccacccccaccaaacgccaccgcccctccacacaaccccgccgccgtcatctcccccaccagatccggccaaatgacacggatctgtgttagagtttgtgtcgaatatgtgtacatagtcggttacagtttaagacttggagttgtaataggtattaggactagagtatgagtcggactctatcctaggatctctcataaataggggcatgtctgttgtaaccgcatagcgacttagcatagcgagagggagcggctgccggcgtcgaccagccgtgagtcgttgtaactctaatacgttgtatatgctggatcggggaggagtgcccgtaatcagtgccccgaagatgtaggctacggctgaactctgttaccaaatatcgtgtcttggtgccgtcatcgttttagatctcctatagcgttttcttccgcgtttagctaccgatgtcaatttcggggctggttttataacaatctgggcgccgtcccaaatgccgagcagcgccccccttgcccctgcgtggtgagagcgaagcggagggagggagaggcgggcaacgacggcctagtcaccacccgtgtcacccggggagagggcgacgcgaaggcttgcttcgtctacttcttagttttttgccgtgtagtagtagtattccgcctcatcttatcaaccaaaatttaaatttttaactttaaatctagagttgattttgaggttttttttcattgaagtttgtttttcagcatttgcttttatatcactaagaacacgtatataaaaaatatatttataaattatttttttggtttataaatttgttgtttggcttattcccctaataagcaaaacgacgtggcctttcgtgcaggaagaacctgctttgggacggccatcaccgtctcttctcctccattccccagatggtcctcccgaactcgctcactcgctggccttcgttttttttagagagagagagagaatggcgacactctattcattaagttgcataatgacagagcatctcccggatatactccggggtcacagagcgaaagatattactccctccgtttcgaaatgtttgacaccgttaactttttagcacatatttaaccgttcgtcttattaaaaacttgtgtgagatatgtaaaattatatgcccacataaaaatgtatttaccaatgaatcaaatgataggaaaagaattaataattatttaaattttttgaataagacgaacggtcaaacatatgataaaaagtacatagtaagtgctcagaacgacgagccaaagtgtgtgtcctacattggataaacggttcacatgtatgaaggaacatgcaaggaatgaactcttgactttcttgatgtcgctcaccacgcaaccagcagcagaacgatctcgttggagactggaagcgttggatgaatgagaggcagtccgaggccatgataacctgctggtatccctcctccccgtgccaggatcagcgcacgtctaatcgccaaggcttcagctatttcagggacaacaacttcgggcttattcattttaaaggaattgtaaagaaaaagcatagaaataggaatgggttttaaactaccattcgtttcataggaatgtaccataggaaaactataggaaagttttccattcctccatttttaaaggaaaagcataggaaaaaataattcactccaacctaatatttgtatttttttggttggcttgctcaacaacatagaaaaaattcatgtgttttttaatctataggtttgcacatatatttctgtagtattcctacgttttgaaaatcctgtgaaaagaacgagcccttcttgaattcgctcgtttcacgtgaaaaaacgattcacggactcgccgtgagcggcagcacgcacgcccacgcgcaacaatggcgcacgacccaggccgtttttggtgtcacgtcgccgcattattacgtgtgatttcggcggcacgcgggcgtgtgctggtgccctcggctgcgacgcgtctggttggcccgtcccctttacatgtgtggcaccagccggagatggaccaacgcgtgcacgctaaagtttagggcctttgcaacctggaaccttctcatcctcaccatcccattccgcggcggctaccatcgccccggcccagtggcccacaccccccagctgtggcggcacaaatcgacgatgccaatatgcccattcatgctggaaagtggaaaggtgtactctactcctacgtatagcagcagcacacagtgaagacagactgcaatctttcagtcatcagtgaccgtagtagtttcaggcagcattcagatgcatgggaaggctgcaatggtcactccagtgcgtgacaaagcttaatgcgcggctttcacggatccggtgattggtcggccgatctacccgagtcaattccatgtagctaattaacaatcctgcactactagtatagtgcaccagtgctgctgctgctgccgacttgagtcctaacccataatgcagcgtcgtgcgtgcattgtctccctttatattgctgcagcatagatgcagtttaagcacaaggatggttagtagtaacacggcactaattcgtggaaacaattggtagaacccacgctgttcggttagcttaaacccttcgtaaacctgctctaatggcaccgacacgcaaaggcactgcatgtccccgccctaatgacgggcattaatccacgacagcagcagcagccgcagccgcaacggagacgttgtgaattgtgatcgtggaattggatttggattcgctgtgagcctcctgttttttgcagatctttccaactgaaaaaaaaaaaggaggaaaaggctctcttgtgatttagcaactcaccaatgggccagcgataacgggtctagtacgtaggagtactagtgctgctacagcgaagtgcgaggaaaggttggccattaaaactgcccaacctttgctgtgcgctgttccgtggcgccctgcattttcctcacctgccatagctgtccgggggccttcactgcatgtgcagctgttacactttagtactccgcttaattcacctaccaaatgtactgacagtaatgtgacactctagtaaatgctaatggtggagtaatgcgctactatgaaaataattaactactatttgtcacccttacgagttgttctagagaatttaacacttaatacatagtttctccatcccaaaatataataatattaagccctcaggatttgtcttaaaatatacttcctctgttttagattataagattttctagcattgcccacattcatatagatgttaatgaatctagatatatatagtgtttaaattcattaacattaatatgaatgtggacaatgctaaaaaatcttataaactgaaacgaagggagtaacaatttctccaccaacattctcttcccaaccaatcacaaccctccaccatttattttttccacctacctccactattcatccaattacaaccctccatcactcacttctacctactttcttaataaccgtgttcaaccctaaaacttcatatattctgggacagagggagtatgtcataggcagcgaatgacaaattattagttgctatatcttgaaaatttcaagtaggagtacgttaaatgtcccgctacggagggagtatgtactgatccacgtcctcgctgatattcctatcgtgtgtgacagatttctttttagacagcgtctggttggttggatcgtagtactactactgttgctgcatgagcgtgaacaacgcgtgatcccatcatgctttatcctaacttctctgacgagcatgtagtagacgcctcgttgtcctgccattattctctgacgagctgagccactctggtttaatttactctgctctctggtttaacttactcctactctgcttggatcgatcccgtgatccgtggaacatttgttaatctaagacgcgatctggatctttcaattagtggtagcccaaaccctgacgcgatctgaaggaaattttgtcaacgacgcagccacgagaacgagcctgacgacaaagggcgcggacggacgagcagagcagtgccgggacagcgtatacgtgctgtgcctgtgtggcgccaaccccctccgttccaaaataattacagttttgtactatttacgttcaatgtttgactgtttattttatttattttttttattaatatttttattgctattagataataaaacatgaataataatttatgtgtgactaaatatttttatttttttacaaaatttttaaataagatggacgtttaaacgttgagcacggatatccacggctgcacttattttgggatggaggtagtattattctttctcattagagcaggtacaatagcaggctattagccagctacaatcatattttaatgagataaacaatgagagagaagagtagcgggctacatatctgtagccagctgcagcacggactccaagacgcaatgtgcgtatgacatgtgggaccatatattaatagtatagtaagccactattatatgaattggctgttagattgactatagatgaattgaagataatagtgggctatactattaaacttgctcttacaaaccggaacacggagtatctagatttatagttatagttagaagtttgctttatttttctaaatggagagagtatatctatagtctccatttcaaaataaatttacttttatatatgaatataaatatagactaagatcatatttatatataaaagtaacttatatatgaatataaatatagactgaggtcatatttatatatataattaaatttatttttaaacggagagtgtatctactatccacaaaactaattttgaatctgatcaaacatatgtacaaatttatttttataaattgattttttttcttggaaggaacactatctactcccatgcgtcgccggctgtatctgatctgcaggcacactaaaataagagtgaaaagaaactgcacgatgctttgacgatttctgtatttgcatttgtgtgattgggatttaataggggagatgcgaatagtagagaagtcctttttcttagcatgcctggctggaaggataaggaaaggtgatgatggtccatgactccatggatgatatagaagaagcagaagaataaaagtcatacatagagaagtttctgacacctgtagcttcttttggattcagaagcttcctcagcaatttaacttttcattcgaattatgagaagttgtagttgtagaattcaacaaataaactataggtaagaagctgtaaaactcggcttctccagtttatcaaaaactgtctactaatcaactatctctcacagaattttaagctttcctgaacaaacctaagatcactccccttgtggggaaaagatgagagaacatcacatgcatgcatcgctctgtctactgtctcactttgaactttccatctgttttcgtttttctaagagaaggctgcaagattttgatttcttttcccttgcatcatcatttggctatgaaagctttattcatcctaaaataaaaatcaactttttaagaatgaatataggctggtgcttatctagatattacatccttacttatccatattcattcgtataagtgagtacttttcttgatagaatgaatactggatcaaagcagctgtaataacaccccagcacatgaattctttctagtactagagcagtcgaaaaaggcaagcgatgccagaagtagcaacgaacgtgtgttgacgccgaagttaatgacgacattaaaaccttggagtaacacctcattgatctactaccttgtctgtcttctttccatttttttttccgttggaacggtcggtcctggataagttcaaaaaatgggacatttgatttgaaaggaaacggctcaaattgaacttttttctacttctacggagtgtactgcccccaacgtctctacgttaggtgcaaaccattaattaaaagcgtaaacagtgtcgcgttacacggacctgccacttgatcagggtacaaacactgttctttagttagaggataaatagttgaatacggttaaaaatacagtatagtccactggcgagacttatgccggggaaagcaacaaaaaggttgcctgtcacaactcccgagcagagatcccacgtccactaggaactaaaaaaaattaaacaaaaagacgatgacgaatgcaactgacatgtgggcaggaaccgaaacagctgcatgtgggccccactggacagtgagagttggcctttttgacaccgtggcatggcccgacatccgcacggtcaaaattaccgtcgccgtcgcgtagattctcggagataaaaagagagagagagagagagagaaaaagcgcaggaaaaaaagttgcaagtgaaaaaaaaatctgagagcaagcagttggttgtcaataaagcctcgcgttattgtcgtctgcctcccctgccccgccgcgccaaccccgtccgccgccgccgcacgtcgccatcgccggatctccggccggtattccggtgagcacaaggtacccgccccctcgcctccaccgtgtctccttgacctcttcctctccggcaacttctgtgtcggcggtgcgccggaacacgcgcgccacgccaccgcgaatctatcgcgtccaaaaaaaaacaaaaaaaaaatctcgcctgagaagacggtgatctgcgagctaccctcgcgttgtctccgcgtggtggcgagcgcctcgtgcgctctagccatcgcccaatcgcgtcgtcgtactggtatagtggccgacgacgacggtggattggtgattagttcccatccatggcgatcgctagcaagctagcttgctagatggatagatacgccacaatacataacaaatacatggggcttgggcgtttgtggagtagtggagagtgaccaccagctcaccaccacctcctcctcttttggctcgttgctccgctggttcgatcgattgcccgcacgccaacctcgcatgattttcttttccctccccatttgtgacacactaattaagcaattctggttggactcactcactaatctgccttggctctctttgagatagagagaaaaagaagagaagattttttttttatgggttaagatgcttgtgctgtttcttttttcagacaacggagcaaaattatttcaggctctaatattaaaaagaatatattatatatgtgatatacataatgtggagatgcttgcactatactgtattttgtattactagaggtggttagtgacctgtgttagtgagcctgctcgtgcgagtccaaaattttctcctaatttaattgagctaatctcctatatggaggaggttaagctgtctcaatctgcagcctctgacccggcaaagcagagtgcacacaagctccctcccgtgtcgaagccgccgtcgcatgattagacaaacgattcgtttatagctctcatgtccctttcacccggaggagcttgacaaaaagactcgccgccgcggcacagctcgccggtgatgagacgatgcaaaaataaaatgggggaacgaatctctcgcggtcgagccgcgagcgacctcacacaagcggccgcgtggagcgtgcagtgactgcagctctcacgcggcctgtagaagcagtttgtggagttttgtggccggcgtgtgagaagagaatttcaacagcaataatcaaagattagtctcttggctgatcttatccacagcgacattgcaccagattggatggatggatgcatatcatccctcttgcgggcgatgtggaggtcgccgttcttgattggcttggctggctttggcttccctgttcgatattgatttggtttgtactagtagaatactgctggtattagctaggcgttgatagtggccggggcttagcgtcaggtccactgaccactggggcactaatcaaagttgctgatttctttcgctttcttttttcgttgcaatgcgatcctcatgtcggcgcgggtatcgcgggggagatcaaagttcgtagcttcgttagccgcttagcctactagtgctctcattagtctataagagagaataggtcttttgctttgctttcaggacatggtcacctttctcaggcagcaagcgtaagcaaggcagaggagagggaaagaacctctctgcagtgctgctgctgctagcttgcagaaaaaaaaaactctcatcttttgcaggaagagacatcactgtttctgcattcgtgtgcatttggattaagctttgcttatccctttttagtggagattgttgagtatatcaggtaaacacatgtgcagtcttgctgtgctgtatgtatgtgtgtgcatgattttgtcgtttgttttatgcatgctgcgttatctgctcttattcaaactcttgttatgtgctggctggctgattcaattaatcaggttaggtacatgattgtttcccctgtaagtcatgttggttttcagcaacttgatgcgattggataaacaagtttgaaaaaccgaccatgttttgagtatgctgttcccttgtttctgttttgattgcaacctaagagactcttgagtcttgactattctaatgtttgaagatgttgttgttcaagcaagagacgtgcactactatgctcctatgtagttaccctcatactagcctgaaaagcttacactcatagatatgcttctctcacaggtctatatattggcagctctggttggagatagacactcacactgagccaagatggggagtttgcacaagttcagtgttattctcctcatgttatgttttgctacgttggggagcgctcagtatgtcaagtataaggatccgaagcagcccgtctctgttcgtgtcaaggatctgctcggccggatgactctcgctgagaagattggccagatgacccaaatcgagagggagaatgccacggcggagcagattgccaagtacttcataggtgtgtcatggtttactactcatgctcaagtaatgtgaacgatgaaatgctggatactatatgttttgtgttttgacattggtgtgctgtgatgcaggtagtgtactgagtggtggaggcagtgtgcctgctcctcaggcatcagctcaggcttgggcttcaatggtgaatgaaatgcaaaagggtgccctttcgacccgactaggtattccgatgatctacggtattgatgccgtgcatgggcacaataacgtctacaaggctacaatcttcccccataatgtcgggctcggcgctaccaggtatgaagtgattttacttttgatatgataattacctcttacacaacaatacgtggatacttttttatgtttgactacaagactgcaacatcttaaggtgataacacagttgtgatgcacacagtgcttgttctaaaaaacagggtgcttatgacgcatttggtggtctgtatttaaaaaaatcttgattcttgatttgccgtgttgcagggaccccgacctagtaaagaggataggagaagcaactgctcttgaagttagagctactggaattccctacgtctttgctccttgcgttgcggtaattaatactagatgatacctcttctatagtgggtgatctcaatctggttagggtgcgtgttcccttttcatcagcactatgaactcactgttgtgtttacatgatacctctcaggtttgcagagacccaagatggggacgctgctacgaaagctatagcgaagacccaaaggttgtccagtcattgaccacactcatctctggcttgcaaggcgatgttccatcaaatgatgtaggaagaccatatgttggtggaaggtatacctctgatactgtatagctttaaaatcatctttgtggcttgtacctttctgcctataattgacaggtgaaattggcgtatcactgcaatatactactatatgactaactttggtactacttgcttactgtgcagtaagaaagttgctgcatgcgcaaagcactatgttggtgatggtggaacggtcaagggaatcaacgagaacaatacaatcatcgatactcacgggctgttgaccattcacatgcctccttattataattctatcattagaggagtctccactgtcatggtttcatactctagctggaatggagtaaaaatgcacgcgaaccatcacctaatcactgattttctcaagaacaagctccgcttcagggttagtttttctaaaaaaacaaaatagttatcttgatttattttcttcaatgtatatttggagatattgcaggcgtatttaattgctttggatcttgtgcaaacagggttttgtgatttctgactggcaaggcattgaccggatcacttctcctccgcataagaactattcttactcaatcgaggctggaattggtgccggcattgacatggtgagatatgcagaccatgtgcattaacttcttcccttttttttaggaagattgaattatatccctagcctctatgtcaaggacgcataaagtcatagttaatttctcttttgaaaatccaataaagcatttgatttgttagtctgtccaactttagtttgtgggataaaaggtggattcaacaattaaaacatacatcatgttagaagagtggtcttgtcttgttattacgagtttatgacacatcattgatgagccttttttctactatactaatacagatgcgatgctttattccctttcttatcaatttatcatgcctaatgtatatgtgctgtttgcagatcatggttccttatacctacacagaattcattgatgacctgacagagcaagttaacaacaaaattatccccatgagcagaattgacgatgctgtctacaggattctccgagtcaagttcaccatgggtctatttgagagcccttttgctgactctagcctcgccgatgaacttggaaagcaagtcagtgctgaacacctcaatcctcctattactcacacttcatatatcaagaatttttactgaccaattccatctgaaccaccataggagcaccgtgagctcgcgcgcgaagcggtcaggaagtccttggtgctgctgaagaacggaaaatcctcctactctccggtgcttcccctcccgaagaaagccggtaaaattctcgtcgcgggaagccatgctgatgatttgggcagacagtgtggaggatggaccatcacctggcaaggacagcccggcaacaacatcactgctggtaaactattcatgatcaaaatgtttcaatgcttgtaacttcatctgagttttggtgggtggcaagaattaaaatccacggacaatgtgcaggcacgacgatcctgtcggcgatcaaggccaccgttgatcccagcacgacggtggtgtactcggagaacccggacagcagcgtggtcaccggcgacaagtacgactacgcgatcgtggtggtcggcgagccgccgtacgcggaggggttcggcgacaacctgaacctgacgatcccggagcccgggccgacggtgatccagacggtgtgcaagagcatcaagtgcgtcgtggtgctcatctccgggcggccgctggtggtggagccgtacatcggcggcatcgacgcgttcgtggcggcgtggctgccggggacggaggggcagggcgtggccgacgtgctgttcggcgactacgggttcaccgggaagctgtcgcggacgtggttcaagtccgtggaccagctgccgatgaacgtcggcgacgcgcactacgacccgctcttccccttcggctacggcctcaccacgcaggcgcacagcagctgatgcggcggcgatgtcggtggagagtgacgttggttgggacgtgacgccgtcgtgacgagagagatggcgatcatgtagtactacatacacatgttgttggggtggatttgtttgtggtgggggaatgcaataacgatgagagtgagtgatgtgctcaattcttgaggctgtggctgttgttagtgtcatagtgttgggttgtggaataataaaaaatcagatgcgcttttgccttctttctctcggcactcagcttgtgttgcgtcattcttttatgatgaaaggtagttcatgaaaacttagtactattagtcgaaaataaggttaaataaataaaatctactaccgagtagctccccactttgagaagaaagcgaaatggcacaaaagctatcacctgaagaatccttcttggctatcactatcagcgctgtcatccgagccaacccggtgccatcgcgacaagcaaatcgcgcccccgctgctcatcgagagattctgcaatgcactcagatcgtcgcggaggcgatggttccttgggagttgggacaagtgtagtcccagatttttcctgcattgaatcgatgcgtggcggagccctcttctcccggcgacatcctcgccgttctccgttgagcgccgcacacgatcaggctcccgccgcctcagtggccgggaggacggggaggggaatggaattgcggcgtgagtgcggcccaattatatttgggccgaaacggcattgcggtctacgtgcgacctgtcatacacgggccggaaatcgactgtggccactttgagtcccttatgtcagtggccccacaattttttttttgaatgacgaataggtcccatatatatgttttaaattctaatgtcgcctaagtctgggagatatagaatgaaagaaatcgtaggaccttctaacaaaagaagctcctagcaaccagcttgctagccaagattaaggaggaagcaaagacatgggttctagcggacacaaaatttttttggcaactgtcttctatatagttagcacggtccaaaggccctgagcttgtacatttctttctttctgccatcttgtgtagtttactcctttctctattcaatgaaattggcggctcgacgattcgttaaaagaaaagtcacctaagcgtcatatcaccgccacaaatcagaacaacactgccatgtcagcaaaatcgtcaagggagtaaaattgtaccggttttaatagttgatagtttgagatatctggttgttatcgaccaaatttggtaatatcagcatcagaaaaggagattagatcgaagtggagtcggaggcagagatcgattcaagaacagagcaagaatcggctggagtccagatcggctacaattaggattggctgggtctgagtcggactaggtaagccgatgcagccgattccgacagtataacttggtgtatgccatcgggttgaattgaggtgcttcaagatcattgccacacatggatagagtcctgagaatgcaattgtatctattaattaggatgttttatgtaattttcttagagatatgtttgggcaaaagtctgccgcaaagacttatggtatcttagaatttgttagagataatggtcgtgtccggtatggacatatcttgtaattctcgggtataaatagacctcgagccctatgttatttttaacacacacgttcaatacaatttcggcgcatcatcaccttttgctttagttttatttcgacgagttcttactttcgggttgagctgcatcggtttcgatctttaacaagaggtaaaacttgttatgacggcttgtgttctcgggattagtgcttccatctttatgatactctaatcctgtttatataattcgtcgagttatcatatatcttacataatctctagcaatatcgccatctaacttacgatcggctaacatctgtcagtggagggcagccgattaggttagattccgatgttgatttagattatgtaagatatctaccactctatgaaacttccagcggcttgattgtctagatattgttcttcttttcatacttaatgctgcatcagttgagtttgatccattaaatcgtgcttagaatatcaatctctagcctgccttctggttgccgattagggtagtatcggagtttcagccgatcttatctgatttaaccatattcgctctatatgcttcagtgacatgttaaatccgccctttatgttaagatcttattgcatttaagtatattaggcttttatttgatatattatacttgttttgatattgtcggtgacatgggatcaggagtatcatgactagaggtttgaggcagacacaatcgcacacatggcctggtacccccgagggacgtcgggcccgagggtgatgtgttcgccctcctcttagtccccccgagggggtcgggcagcacccccttcggccagaagggcaaaggcgccccgacccctagtgggtttntgctnngggtgtatgggttaggtgagnacagtggggctcacctaaccacatttattgcggttgggctgagcgtgtcacgccacatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacgcgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaaggggactggacttttcgagattagaaacccagaacaagggagaggctggctcatactttgtagctccttcatacacagatctcccacaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacatccacaggaggtggagaagggcggcgagatggggagcgtcgcctcctcgtctacggcgacggcagcacgccccagggcgtgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcatcaagacggagggcgcggcgagcggcagccgctgttcgccattcggccgccactccttcgtcaacgcctccgacccgggaagatctgcgtggggaaccggatgctcgcaccagtatcgagcgccggcgtaatggccgacgtgctccccacgcaacggagggcgcctcctcgtccggagtgtcacctcaccacggacgcggggatcagccctccgtgcccctggttggtggtgtcggttgtagggcctttgtggcgagccttcggaatgtccgttggcccccaaggttccggcccaccatctccgaaaaatatgacgggagcgtcaaccccgccgagtttctccaggtctacacgaccgggatcgaggccgccgggggtgacgacagggttatggcgaatttctttcccatggccctgaaaggacaagcgcggggttggctaatgaacttgccacccgcgtctgtttactcttgggaggatttgtgccaacagttcaccatgaacttccaaggcacatatccgcgcccaggtgaggaagcggacttgcacgcagtacagcgaagggatgatgagtcacttcgcttgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcctaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaattttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgtatccaagcccgagggtggcgacgagaggcttggcgcttccgcccccgccaccccgaggcaacggatgatcacaggcgacgaggtcccggtcaaggaggttaccctgggcgacggcccgtccaagaccacacggatcggtggtcttctggacggcaaataggaagacgcgctcgtctccttcctgtgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgtgaggaagtggcgcgacttctggaggccggattcatccgtgaggtcatccatccggagtggctggcgaacccggtggtcgttcccaaggcgaacggcaagcttcggatgtgcatcgactataccgaccttaacaaggcatgtcctaaggatccttaccccctgcctcgcatagatcagattgtcgactccactgcggggtgcgaccttttgtgttttcttgatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctcagcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggtgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacctgggaaagagcagggagaagaggcccccgagccaaacggaggcttaaggcccctgacgaccggagttggccctttgcccgcttgtccgacgacgccaggagcccccgacccccaggacggccccgaagccaccgtgggaaggccgcccctgttatcctccgaccccgaggtcatcagcacagaagataagtgcgccccgtgaggctgctgggacgaagagtgcaccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccaagcggagacgtcctcagatacttggtccgcctcgactttcgagcgaccaataacatggcagaatacgagggactccttgccggactaagagtggcagctggactggggatccgccgcctcctggtgttaggcaactcccagctggtcgttaaccaagtctgtaaggagtaccggtgctctgacccgcagatggacgcctacgtgcgccaaatacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccgacccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccattgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccaggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaaaggccaagtggagcgcgccaatgcggaaatcctcaaaggccttaaaaccaagaccttcaacatactcaagaagcacggtgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccatgtccgggcccgatcactctgcgtcgacgacctcgtcctacgccgcgtccaaacgcgtgctggattgagcaagctttcaccaatgtgggagggtccatatcgagtggtcggcgtcccccggccgggctccatacggctggccacgggcgacggcactgagctgcctaacccgtggaacatcgaacaccttcgtcgcttctacccctgaggggggggtcgggtgtcaggttttgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgtgcctgctcctcctgcgctgcctcgcggagggacaggctaaccgtcagctgttgcgccgcggcctcggccccctcgagagctcgctcccgctcgatgagcgcgtcctcgcggaggcggagcgtgaattcttcttcggcgcaagcagcctcgtgcaccgccagcgttgcttcccggatggtgacggcgggctcgcggtccgccagatccctctccacgacgcaggtgcgctcttccagcgccatggcgcgcgcctcaagggcctcttacgctgccgggacgccgctttggtctccgccgcccgctgttctcgggcagcggcagcgtcaagcaccccctgggcggcgtcgagctttttccttagctccgcctcccagctcccgtattgaaggcggagggtgtcctgcgcctcgttcatcacggtggtggcaatgagggcagncccccgctcctcctccacttccttggcgatctccgccagcaccttcttacaggtctcaagctccgagacgtgcggccggtgagccttacggctcacttccaccatggtcctcaccgagcgtcgcccctcttcgacatgcgcccacgcggcgtcgagctccgcccgctctgcatgcaggacctccacctgggcgcttaacccatccaacaccgtggtgtttgcggcggccaaggcctgcagaaggggctctgcgttcagtgggcgactagaaggcgtggggaagagccgctttgagagnatgccacgcggctcgggccgctgatgtaagtgccggactcgggaatgtcccccggacccggttggtcctgagcgtcgcccgagggagtgggcccaagcgacgcgcccgcagcctcgttgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagtggcttccccggcctggcgggctcgggcggcctcctcccgagcggtttcctcggcctggcgagcccgggcggcctcctgggcggcctcctcggcttcccgtaggcgatccgcggcctctcgccggtcagattctcgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgggggggtcggttaaacgaccactttggaggggaaatgaggtttccccgagatggttctgtctcccccatcttgcggggccgcttcttcttgcgctccccctcgggctgcgatgttggcgcggccccctccgggcgcctgctggtggcacgcgccgccccgccccctcggggaggagatgggggaggtgttcctccctgcttcctcttcccccgggcgtcggcagggcgg

SEQ ID NO: 22416 - DNA, 1645 bp, Oryza sativa
gagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatctgacgacggagatagtcgccgtacaccatggcccctgtgagcccctgggatcgcaggcccgccaggcggtcgaggacggcgtcatagccatcccccagatctaccgacgcccgccagctagaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaatagccgaagagatgggcgcaccccaatgaacatctcgcacagatgcgcgaagatggccaatgtcatcaccgcgttgggggtgaggtgcgccatctggaggtcgtagaactccagaacatccatgaagaaagaagaaaatggcggaatcagccctgccattgcaaagggaagaaagaagacggaccgccccgggtagtctggcgccgggcgtccctcgcccagcgtgactgtctcccggccggtggcagattccggcatgaagcggcgcgacagcccagcctgcctctcgctcacgatccggaaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaagaggaataatggcgaaaggaaggaaacagatcccttcctcagtgcctttatactcttgccagtgctgtgcccggctcctcgcttctcgcgcccactatttcgccccctcgtttatcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccagttgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgtgttcgccctcctcttagtccccccgagggggt

SEQ ID NO: 22417 - DNA, 10751 bp, Oryza sativa
  unsure (1)..(10751): unsure at all n locations
acttttcgagattagaaacccagaacaagggagaggctggctcatactttgtagctccttcatacacagatctcccacaaaacacaggagtagggtattacgcttctcagcggcccgaacctgtatacatcgcccgtgtcatgtgtgtttcctgtctcgcgagccttccacatacagagagcttagaatctctccctgagtccccggccgaaccggcaaaggggggcctgcgcggtctcccggtgaggagccccacgctccgtcagatatcttgacatagagtagtatcggagtattagccgatacatgctagatctatcttatcggctatgctataaacacatataatcctgttattaatatatatttcgatctaagtgatttatactgtctcggcatggcgaccgatctatcccaatcacttgatttaattatatatcgatataagaactatatatcgttaatatgtacagccgatcgaatagatttagttccttattgtttatttataaccgccgatcgattcttatatgacatcggctcaaagataaatgatatgtcatcggcacctagccgatcggttatgatttatagatttaaccacgatctctttgtctctatttcttgttgattgcaggatcaaatcaactggcacgctaacacactcgaaggcgagctttggacctgcactggagttaagcagatataggcctcgtgttttacgtcaacactggtattgcggtttaaggatatgaatcaaattcggtcactggttaagggacttaaagtggacttattccagcgtacgtgcgtgccgaccggaacgcgagtgtcgctacgtttgggccccgttttgctacttgtgctgttgttcatgggccggaacgcgattgttcggctattgggcttggcgtttgaggcggggcgcacgcgcgatcgcgacgtgccggccggggacgtttaccgcatcggctgaacgagtgaacgtgtgcgtgtggtgccgctgcttttcccagcaacctatacaagtcacccaggtttccgtttctgacttccggttcgtagcttgcaataccacaaaaggattacgttgggtagatctggtgactcagctttatgtgatgcaatcgtgatttgatatgtcccagtataataagtttatccttggctcattatccgcctttttacacgaaagtgactacaagaaaacgcaacggtaggtgctcacctgctgaaaattagtgccaaaaaacgtcagcatcccacgagaccgttggttatctagatcgtgtgcgtcctgaatttggacggtacccactccatgcatatcccttcaggggttaggccgttctctactagtactacagtcttgtagctttggagaattggagcacaacccttggtacatatgtacagctagcgtacatgtactgtgacatgttattactactggagtatacatatatctgccgcctcactgtacagtacggaagcgaggcggcagtggacccgggcggcacacatgcagacgtcctacctcacggaagatatccggcgaagaaaggcatcatataggagtaccagccatcataccatcgatggtccatggttatataggacgccggcgagatcacgttgttttgccgggatatgtatagtatagggtccggatctgtccgagccgggtcgctgtcttccgtgttccctctccagcgttagagcatccacaatgtacatgaaaaccagtacatagaaaataaaaaattccattcagctaccttaacacattgtacaactagtctatagcaaagaaataatgaaagttgtccatagcattatgggtagtccatagacaataaaaaattatagttatgccaggtgcatgcgtgctgcagcctgcaacttctgttccggctaatttttttttgcctttagtgtgacccaccttaattacacacattgtggtgatttctaaaactatggactcctaggtgtgggtcccacatctatgaactagtttgccaaatacattgatgttgctcttcgtgcatgaacgcagatgacgcggcacgagatggatgattccatgggcctcgctcggtggctagctaagttcacgtgacacggcgcaacgagaaacggccgtgttttcctttttttttttggaccatctaaagtaacttgcgcaagaaaatcggtacctaaatcttacgaattctcaattgttggactaacgaacgaattaaagaccggccaatgtagactcacagctcatccaatcgggcagtgctgatggtcggctgacctcgtgcagttgccaaccccttaaatccttccgtgtgtgtatacataagatcttttttttcctaatttcttgtccaatgttagttagtaaattttcttttactgcctaacaatcagttgatagactacctcccccttgcaatttttggaccatttgttcactttgagattcataaaagtatcatcattattcccttctctccatttccatcgctcacttgctctagcctactctctccgtcccataaaaaactaacataactatacgtgacacattttaatactacgaatctagacatacatctgtccagattcattgtcctagaatatatcacatctagtcatagattcgtttttttcggacggagggagtatgccattgctaactccaagttcttgcccgcccccgtatgccacacttcccccctcctagcctcgcagatgccaaaagacactaaggttgtgttcgttttaggaggatgggaactaatccatcctgcacagaaaacggaatagtcaattagcacgtgattaattaagtattagccattttttttaaaaaagtatcaatataattttttaagcaactttcttatagaaactttttttgcaaaaaaacacaccgtttagcagtttgaaaatcgtgcgcgcggaaaacaagaggggggagttgggaacccctggaaatgaacgcagtctaagggcccctttgaatgaaaggatttatgtaggaatttcatagtattcaaatcctataggaaattttcctatttggccctttgattcaaaggattgaagctttccaaatcctatgaaattcctatggaatggcacattgcatgtggattttggaggaaatttagcaagagctccaacctcttggaaaatttcctttgagtctatctctctcatccgattcctgcgttttttctgcgctccaatcaaatgaccattcctgtgtttttcatgtggtttgcaatcctttgttttacacttcaattcctgtcagaatcctatatttttcctattcctctgttttttctaccctatgatttaaaggggccctaaaggtgctagtgagactcattagaccaaactgatcctccccttaccatactcccttcggtccttctccttcccaagctgggtagtgataaggtgttccattccaccatctagcttgtctttggcgggacaccaacactaacacagactcctaacgggttagaatcccacaccctgtttgctacaccggcccatcattcgcatccgatctcatagcctcgacaaagtagtagccgttccgtcatctcccaagggcatttaagcatagtgaacatcctcccactccctgccctcagcctatcttcatgccgatgtctaaacccaaactcgttagatcaccgccagtggcggagacagcgtgggggcagggggtctcaagcccccactaccccctaacgaaccattagagcccacataataccccctacaattttaatcccaaagggggtctaaaataaactttgttctgagattttagaaggcccaacaggctgggaaggcccaaaatatcccacaaccctacccaaccggccaaccctaatcttttttccccagccgaagagaggcggagactagtggcggcggcggcacacgagtgcactcggcgcgcgatggcttccagctccaagcgccggtgaggcggacgggggccggcgatgggacccgacgcgcggagggggcgcgccggcactgcagcagccagggcacgcggctcaccggccactggccgctggggcatgggggcgccgggcggcagcaaggcagacaggcagggcgcggcgcgcggccggtctggcggggggacccggcggcgcgccgacacagcagcagccaaagaggcaacaaggcaagcaggcagcagcgccgggcagcaacaaggcaagcgggcaagccggacagcaccaaccaggcaaccaccaaggcagcaaggcaagcaacagcgccaagaggcaaggcaacaactcaacaattgaggatttgagcaagtgaggtatataaaatttctgatttgtcatttaaaatcaatttcaattgtcatgtctagttgttattgatagttcaagtcttcaaaaaatcatagattgtgattcctagtttgctactttgttatattgctagattgtgaagatggctaaatgactcgatgatatgctatactgagatagtgagaagcaaatttttaaaagtattagtaatgaaaaaattatccaaaggtttgaagatatgaaagcaagtcggatgttactactccatgcctccattccctactttaaattatttgaagctattgtttgttaattgtcattattcattaatttgacatttcttttgtatagattacccctgatgaagaataattggcgatagggtgtgctagtgtcgcacatcgtgtcatcatctattggatatttcaagatttgttttggtatggataatacttatttctcgtaattctatatatttacactttgattagatatatagtcaatttacataagacatgtctcgatttttgtcggccaattttagttcagcccccactataatgtaattctggctccaccactgatcaccgttgactgcctaagatcgttggatcttgctgtagctagaggaggaggacgggtatgaattgccgagcagatcctaagatcaaaatttgtaagattttgctcataatttcccgtccaatgcgatatagcaatttttcctttttttttattttaactgcgtgccatgtgatacgagaggcgagctagcgtacacgtatgggcatccgttgattgaacgatgttttccacgcgtgaacctgccgggtctcgcatcaccggtgtgtatagcaatcacgtccgcgacggggtttgcacgtatggagcgtcgcgtagcgtgcacgcgaagcgatgtagagcgtacgcacatacacaccgtgggctgtggagtcatctcagtccgtggttggcggccgtttcatctggtcttgtatctgtttaaacaaccgccgtagttgtcgccaaagcttaatcatggtgtggtactgcgagtgtgagtgtgcgtgcgatgcattgcatcatgtgaggagaagcatgcttccggttaaattattgtcatcacttctctgcagcatcatttgttccccactagtactgcacacagtacattagccagtggagtactccatttatttggttgcgttcatttcagcgcaaaatttagattttggttaaaattgaagatgatgtgactgaaaagttatgtgtatatgacaagttgatgtgataaaaaataactgaagtttgaatccaaactttagatcctttcttattataagtcgtttgatatttttttagttaagtttaactaagtttataaagaaatatattactagttttaacataaaacaaatatattattattttgatattcaatgttagattttataaaattagtttgttattttagatgttgataaatttttttataaatttgattaaacttgattaagaaaaaaagttaccatcgtagctagcaccatctaaagttaccatcgtagctaatactccgtactatcgtcgttgtattaatagctatagcaccaacaactttcattaagtaccgtgcggtagctgatatgccacctctctgcttgattgctctgatacgcaccttagatagtcatgtcccaccgaagctaatgcatgcagtgttcttttcatataattgatgggccaaactgatgatcttaatgttaaggatgaataaatatccatctatcctgatattactacaaaaaatctgaacaaatctgaccagttacattctgtgatataagagtattgtatattataataaactgaataaatagcttataatatattttaaaaaattgtttgtcggtgacatgggaccgggggtatcgtgactagaggcttgggcagccgcggtcacccacgtggccggaccccctcgggggggtcgggcccgagggtgacgtggcacccctccctctgtctccccgaggggtcggnccgctcccgtttcggcctcgagggctggggcgcgccacctccttgtggtattgcgccaacgtgtgtgggttaggtgagcacagtggcgctcacctaaccgcatttattgcgggttggacgagcgtgccactccgcatttaatacggcgcagcgtgcgctcgtccggtccgtgaccggtcgcagtgtgtgaccggtcatagaccggtcagatcgcgggttaggtggcaacaggcggcctgtcacacgcctcgccccgtcccgtcggaatgatgagagcctccaggcactcgtccctagccggagccgacgtgctaactcctggaattagcacgtcagtcccggccagattcataccaggcttcatcgcaaccatggaaggaagtcattgtatgaagaaaggcagacgtgcagcatgctaaactgacacgtggtggacaagaatgaccggtttgtgactggtctgacgccggtcatgtcatcggcagacaaccgtgctcccacgttgcatctgcttccggcggagtggaggtaggtatgacccatcccatcggagggtcattcggatagcggccattgcaaatctcaacccattaatgaaggaatgacagggatatcccctgtgccaggcgaaggcgcgagccaagttttggtcaagatagggtgggtccccacccaaaagaagagtaggtagacgtggtgcatgtggtatccccttgagatataaaaggtggatcttgcccaccaaagaaagggaaaaaaagaaaaaaaagggggggacgactctgggaatacctgagctcgtagaggaaagaaagaggaagaagggttctagagcctgaactctcttgctctccagctctctgtaactccttcacacacagatccaccagaacacaggagtagagtattacgcttctcagcggcccgaacctgtctacatcgcccgtgtcttgtgcatttgctctctcgcgaacattccacagatcgagggtgaagaacctcacttagcgcccccggccgaaccggcaaagggggggcctgcgcggtctcccggggaggagccccacgctccgtcattgttgaagagagaaaataatccgatagacaatctaaaaagaaaagagcttaacttataggtttttttgagaacttagggcaacatcaatgcttaaggtcttgatagaaataaggtagatcccactatactctatgtctatggccacaatgttgaaggcaagaataggtgttaagatggatcccacatctatgtaaacaaattctactttaaagtaggtctcaccatacaataatctattctcatcctctttagcatgcatctgtgctttatctttttattttattttttaaggttgagccataagcttatggctatttttagcatttaatgtcttatggctagtgcatataatgtatatgactagtcataagctcttatggctcattcttatggcacattgtagatgctcttatactagttttccattgtgtacctcaaggtggcaaaggcttgggtatttgatgacgagaatatcgacagatcctggagtacacattgggcaaccacaatgtggttctgttcagtacagcatgtgcaagtttgaatggcaagagttgagctgagctgagcatgtacttgctctgggccctcggattgaccggcgacacaagacgatcttcggatcgtcaaaaaaacgtacggattgggaagttcatgcaaatctcttgctaaaatacggaagcaaaaatgtttcgaagttcggtaaagcatgaagcctgaagttaaattactaagagcaagtttaatagtatagcccactactaacttcaattcatctataaccaatctaatagccaattcatacaatagttgcttactatactattaatatacggtcccacctgtcatacacacattgcgtcttagagtccgtgctgcaactagctatagatttgtagcccgctgttcttctctcttaacttttatctcattaaaatatatttgtagccggctaataatctgctagtattgtacctgctataaggattacatgtaataggagatatatactgcttccgattttaaaaatatgatgctactaactgccttgtaaacgtgacatgatgtttggtcattttgtcctagtaagaaaaactatattagttttatttattttattctgacttgttttattttaattgtgattttatttcttatatttgcactagacgaatttttaaatgccatatctaaaagtaaatagcattattatatatttagaaacaaagggagatatagcctatatcctagatccgcatcaaacatttggtatatcacgttggatctagaatatagagttgtgctaaacaacacctaaataaagcaatacatctgctgccgctgatgaaacctgctcgtggagcacgagataggagaaacatttggtactacaaaacataaggggatttttaatattccctccgtactcgtaaagaaagtcgtttaggacagctacacggtctacaaaacacaattttgactatttgtttctataaaaatatttattgaaaagtgatatatgtatatttttatgaaagtatttttcaagacaaatctattcatataatttttccatcttaaaactcaacaaattaagaattattcatgatttatattcccaaggtttgacttaaacattgtcctaaacgacttcctttatgagtacggagggagtattttcttttctaagataaacatttcattgtggacaaacgtgagagcacacgcaatagcaacatagcatgtcctgaataaagtgaccactaaattcaataaatatggtatacatcaatgcattatcttggtcctggtatccttcaatcatgttccttcacgagatcctccttttgatctgcttttgtcattgttgcttgcatgcccatagatttttttttcttaagatagtataaggattaactcgttaattagttcccgcatatcaaagagatacgcaaccaaagtcgagtttacagggaaatttcaaagcaaagacaaaccttcaataaaatgcataataaaaggacatggctacatcaatcacccgtcactaacttaatttgttccttgtacgtgatccaaactttgttccattagccaagcgtacattaactccaatacttctactactaataactactactgtcatgtgtgtgtcagatttatgctcttaagaaaagatttcagattattttttcttcaccggaacccttacgtacataagtacattgtatacgtatatgtatggtctgtatcagtatcactgcccacgtcttctttttctactaaaatgatagttgccaagtcttcgaatgatccttttaacagatggatcattttcaacgatataatcatactataagaggagggagaagatgttactccaaggacatcatttcttttttgtttttgttttaggaaatatcaaggacatcatcttgtataaattaagttgaaaaacataagaaaagaacacaattaatcttaatccacgcggtttacagattgttgagagagtctacatcaacaattgctcacgacttactcccttcgtcctaaaaaaaaaagacaaactctggtttctgtgtccaacatttgaccgttcgtcttatttgaaaaaattatgaaaaaaaattaaaaagacaagtcacgcataaaatattaatcatgttttatcatctaacaataatgaaaatacgaattataaaaaattttatataagacggacagttaaagttggacacggaaacccagagtttctctttttttttttgacggagggagtaattatgaactactcacagtttgcacctgcatcctgttgctagtttcctctgggcatgcatttgcgtgaaaagcactcgtttacgttaaaaaggatgcatgccaatttactctctagcttcattgcttttgatttgtagcatctctttgttcttagattttattttttttagataaagcttattttcttagattttagcatctctttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22418 - DNA, 797 bp, Oryza sativa
ccctcatcatctatggttctgagttttggcttccgagccaccgtcgtccctcgctaaattagcatcatctcttccgccacccaccaatagattcacgtttatagtccaaacccaccaactctatattacctagggttgaaaaccgtcaaattttgaggttctgaagttttacttgggatggaagtagattccacgtaaaacttgaatggttttcaagaattcaaatttgaaatagtaaaattcgacctaatttatcaagatctggtgaaaaatatcatacagatcagggaacaggaaaggcccatgaggcctccacccgacggttcagagcccacagaaccagacaagcccactagcccagtggatttctctgaaaaaaaatgtttttttgctagccgccgtcctccccgaaaccctaatccccaaatcgaaggatcgggagccgccggattggtcctcaaatcgaccccaaatcgaaggattgagccagggacgccgccggatccgtcctctaatcgaccgccatggcgatcgcccgcaccggcgtgtacgtcgacgactacctcgagtgtgagattgctagctcccgtgtcagaggccgtcgaatttttttttgcggttgccttcgatttgcttctgtttattggctccatttcttgtcgcagattcgagcacgctggccggcgacctgcagaggattctctccaccatgcgcgagctcgacgagagggctcatggtgatgatcttttttacactcctttttcatttttctaaaatacagattatccaaaaaaaa

SEQ ID NO: 22419 - DNA, 281 bp, Oryza sativa
caagattttataccgtggtggtggcagccggcgtgacatggagaagaaggacacgtggaactacgcacgtgtcaggtcctggatgcgttggctgcgcaagctcggcacacgtgggagtgacggtaggagctaaagccgagagttattttgggttaggaaaggggtttcataaggttgcgatttgaaggccatgccctgggctaattcactcctatcttacatcttttaacttgaaggtcgcaagtcttattattactccccgtaatgtcgtatatactaaa

SEQ ID NO: 22420 - DNA, 570 bp, Oryza sativa
ctcttgcgcccccgcgccgccgccgccgccgccggagaggaccgcgtcgaaccccttggtggcccagcgccgcgcgagcgtcgtcgccgacgacgaccgcgacatgaagtccgggggcacgatggcgaactccgagagcacgggatctatggcgcggtagtcggagccctggagccccacggcgtaggtggcgtccggcgtgctcacgcggaggtgggtggacaccgcggcggacagagccaccggcgacggcgaggcggcgttcctcgccgtgaactccgtcgccagcgcctccgggtgcagcgtcacgacgcacctcgcctcgacgccgctcgcctccggcggcgcggcggaggccagctcgacctcgatggagcccgtggggctccccctgacgtcgcggagcgaccatgcgccgctcggcgaccacggcggcatcccgtcaccgcctccgccggcggcgccgccgcagcggaggtccagcgacacgccgccgcggatgacggcgcggccgccgaggccctcggcgacggtggtgtggatcacctcggtgggggcgccgtgccacat

SEQ ID NO: 22421 - DNA, 254 bp, Oryza sativa
atgacggcaatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttatcttaacacctattcttgccttcaacattgtggccatagacata

SEQ ID NO: 22422 - DNA, 530 bp, Oryza sativa
ttgcatctgatggactattatattgttcggttaaaagtaaaatgagtgtgagggtatggtattttaaaaataaatattagtaggattttattggtgagtgattctcgtaccattttttttctacattattcgctacgcatcttaaatatttcctcctccaactataaaccccccctccctttccttccctctcctccaatggcggcggcgcgggccacagtggtcgtgtcggcacgggccacggcgtcggttgtggagaatgttctcgcaaaatcgagagggtaagtcgtgtgcgctcgctctgcttctcgctttccttactcatctgctagtgtgcgtttatatgtgatgggttctttttgtgcgttgtgttgttcatctgcattgggttcattcatctgcgttgggttcatcttcttcttgcttgcgttcgcgcgtgttgtgtgcgttcgtgcgtgcgttgtttgcgttcatacgtgcgtcggtgcgtgcgtttgggtgctcatcggagacacatgatgatgtgtgcg

SEQ ID NO: 22423 - DNA, 891 bp, Oryza sativa
attgatgtttctcatcgaaatgcttaagctttgtccaaagcatcttgtcgcattgttgaaccccttcaatcacagttgtcataacatcatgagccttgctacaaaaacacgccaagtagtggggctgccattggcctatgtggtacaatgagatacttttgatcagcaccgatcataatacactaaataaatgtataagaaaataagcgtaggttcccaattgtcatgccaggggaagatgtcacacatgctgttgcacttgattgattcatccctaccacccacctactacaagttatgggatgctcctttcgttaaactttatcagtgcgcacttcccctggttcatgggaacttcatagtatgctacaggtctataccggggaaaataaaatagagtacactggaaatgaaggacacctcggtaggttggtccaaatctgcattaggagccgtacttgtcacctcaccgaccacctcactgaccacaagttgctgcatgattttcaaaacagatgtctctatgaaaaagacgaatcaaaggatttagtactgacatttgggtaacataaattagttggatggtgcacctggtcagtaacagggatgtagatgtagtcttcagcaggggttatgttgacaacccgatccacaattgttgctccctgaaaaagggaacttagaagataataagccataatccatactgaaaggggaagcttatcaaacatctatttcttttcagtgctgcaagacctaggtagcgtaatgagatttaaactgaatataccctaattagaagattcactggattgttatctgtgcactgtgtttcattatgacaatctcagttgaaattgatgcacatttatcagatttgcacacatgctg

SEQ ID NO: 22424 - DNA, 458 bp, Oryza sativa
  unsure (1)..(458): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctataaagaatgatatgccaagtgggggttgtcgcaaatgcttgactctcactgcctgagcacctttatagccgtcgccggcgtcgctactcacaggaggactagtgggaccgctgccagcgcctcctcccgccggaccgccgtctccgctgcccgtgcctcctcccgcaatcagcagccaccgccaccgctcacatgag

SEQ ID NO: 22425 - DNA, 10256 bp, Oryza sativa
  unsure (1)..(10256): unsure at all n locations
caatgatgaaagagggtagcacacgagacctaaaagtaaatagatgcggagacaaggatttagatggatttagacaggttcagaccatctcaataagaggtacgtaagaccctactcttgtttggagattgtatctactgggtgtagtattgatctgacgatctaattgtggttatatgtgttcttgctcttgaaggactctcccagctcgtcttatataggttgggggaaggattacagaggagcctgccttttatataggctgggggaagaattacaaaggagaaacctagccggatacaacattagtttcctaatctattatatgatagtactcggtcggagctctatacctgccttaacatacaaggcaacataacaactgagcaactgagttctactctattatataatatatgaatccggtccacctactatctctagtcgaatatagaaaccgtgtggatgtccaatacacatattctctacagcctcatcgatgtttttagttttagtatatacgacattacggtgagtaataataagacttgcaaccttcaagttaaaagatgtaagataggagtgaattagcccagggcatggccttcaaatcgcaaccttatgaaacccctttcctaacccaaaataactctcggccttagctcctaccgtcactcccacgtgtgccgagcttgcgcagccaacgcatccaggacctgacacgtgcgtagttccacgtgtccttcttctccatgtcacgccggctggcaccaccacggtataaaatcttgcggcattgcacggcgcgcgctgcggcgagagccatggcgcaagttcaagcccgacgaccaagaggaggagaatgccaaggtcatcaggtagtacagcctgatggcggcgacggcgacgccgagcggcggctcatcgccccggcggacgcctcggggcaggccgcgcactgcggcggccccgtcgtggaggtcgacgacgcgtacgacagcaaggtcaaaatcggcgaagcgctggaggccgcggcgagggcggtcggtgaccagcccgtgcgcgggttcgacgcggcggcgataagctcccgcgaggccagcgcgggcgcgggcgtcttccccggcggcgtcgccgagcaggcgcaggcggaggcggacgccaactccggtgccgcgccgtccgcggaggacacggcgatcaccatcggcgacgttctcgcggtacgtcttgtgcagcattgatcaacccgccgcgccttctatttgcacctgatgatctcactcggccatggcatctgtgcctcgtttctagtggaacgcgacggcgatgctgccgacggagaaggcggtgacggcggaggacgcggcggcggcggcgggagcggaggtggagaaggaccccggcgaggggaccaggccctacggtgtgagcgcggcgctcgccgcggcggcgaagcacaaccgggaggacgccgagtgccagtcgaagaggagcgcgcagccacgggcagccgacgaatgtacacccgctctggccgagcagttcgaccaaatctagcgaatttagcatgcgtttgattatgtattagcgcgcggtttgccgaacgctaagcgaatttagcgagtgcttgaatccaataaaataattaataatatgcgtttgatcaagtattactaacacgcaagaattattagacttttttatcgtaaataaatggagaattacagggctgctaataaatcgtcttggctactcgagccatgttgcctgttgcgagagcgagaccagtgtgaccgatcggcacgacgtgccacgctcgaaacaaaggcggttgggagcgccgaactcggcatggcagcacacggtggtggcatgtcgtgtcgaccgctcccgatcccaatccgctgcgaacatgtctcgcgcgcgccttccaaaaaatctgtttcatggcacgttgcacgtagaaaatgggaaagtggttttatcccttaagatatctcctcattttatgcttacggatacctccttattctttacatatattatctaaatacttcaccttttcatattataaatcttataacttttctttgtcaaactattaaactttaactttaattatgtttgatcaagtttatagtaaaaatatacaaatatttttaatacaatacaaacatattatcaaaatatatttaatgataaatttattgagatttagtgttataaattttgctaatttttctatgaatttgattaaaacttatcaaaatatatttaatgttaaatttattgagattcagtgttataaattttgctaatttttctatgaatttgatttaaactaaagaactttgaataattgacctctaatataaaatggttagagtattatcttaaacagttatcaattttttaaaaagaataataagaaagattaatataaaatatatctatcatatatatgcaacttcaaattaaacttctaaaattataagaaaagtacgtcagtattatttgatattatatatttataaatgttccttctaaaaaagatttttttccttcaaaaataatatatatttataaaatgatatatgttatattaattattttttaaaaaatatatctatttaagcggtatgtaaaagacgaggcaaaagatgaaaaacccatctccatctctttcagctagctaacgcagcagcacaacgctcactgtgcatgcagtccgtgaagtggctcaagcactcgaatctaccagctagaatcaaaacacgccgcatctgccatacccataccctctcggctctcgctggttacccctttcgaccgccaccggcgcgctctggtgtaaaccccccacgacgccacgtactctcggtctctcgccccgcgccctcacgttgtcacgtacaaatactctcgtcgcgccgcgcgccacctcgccgccgaggcacgacgcgcacttgcgccacgagaacgtgccacgtcacgtgtgttcttttgacgcaagcatgagccaggggcagccgaggaggccgccgcccgacggcagcggggcccggccggtgatgtacggcgacgtgttcgacgtctccggcgagctggccgggcagcccgtggcgcccagggacgccgcgaagctgcagtcggccgaggaggccgtgctcggcgaggcgcagaagggcgggcccgccgccgccatgcagtccgccgcggcgatcaacgcgcgggcggggcacgtcgggcgcgcgcaggtcaccggcgccatcgccgacgagggcgtcgccgtcgccgtcgccgagaccgagctccccgggcgccgcgtcgtcaccgagtccgtcgccgggcaggtggtggcgcggctcgccaccccgccgcgggtggtggccacccagccgtccggctctctggacaaggacgccgtgacgatcggccgcgctctggagtggcggccgcgaccgccgcggcggcgggtaagccggtggaccagagcgacgcggcggcaatccaggccgccgagatgctcgccacggggcgcaccgtcaccgtccccggagggtctccgccgcggcgcaagctgggacggaccacaacgccgcgcccgcggcacgcgaagaggacaggatcaagctccgggacgtcctcacggtgccatccgccgcgctttgcgatgccaagtccgctttcttttgaccgtacagcagctatagctaaccttggatggtgtgtgtgtgtgtgtgcacgcagggggcgaggggcaagctgccggcggacaaggcggcgacgagggaggacgcggagagggtgccgtcggccgaggtgcggaacaggccggacatggcgacaacgccgggcggcgtggcggacgcggtgaccgcggcggcgcggctcaaccaggagcgcccgacccgtagcttttagcgagcatatgtgtttacggtgctaagtatgtttttcttttcgtttgttttattttttagcaaaaatgtgcgtgctaatatgttctatatactatgaataaaactgttatgtgtagcattctcctccgtataagagagtcgtcgcatgtgttaccgtaatccagagtgctaatagtttacaacgagcatatttgacatcaatcactactcactaatgatcgatcttctagacgaagcagcaatataatacatatatactccctccatccctaaatatattatataaatataaatataatagtactatataagagattttgtaagagattttggatgaatggtttgtattttagtactacaaactcctatataaacttctgtatagattcataatactaagatacgttcattcatccaaaatctcttaagatacgtcaattcatccaaaaattcatccaaaatctcttgagatacgtccatttatccaaaatctcttatagatatacgtcacattcatctaaaatctcttatggtttggttcatctaaaatctcttatagtttgggactgagggaacagtcattaacaaatatttatattcccagtcattaacaaatatttatatattaaaaaacccttatattttgagacgagggtgtagtcattaacaaatgtttatatattaaaaaaggagggattactagttacataatcctgacaatctattaagcgatatgtactgccaataagtgcagatataatcactccttagtgtatattcaccatatgctgtgaaaattgaactcattgaccaacaagatctcgccgctgcaagtattacaaaagaacgattcattgaactttgcatttaactttctaacaacagttgtgcactgccttcttttcaacttgaaacggagccagtgagacacatctacaagggggtcggtggtggagaatgcactttgagttgcaaacttgcaagagattttactctttcaatttgatgactctctaagacatacgcgactagtagcttgttgcagcatctaaacatctgtcagaattatcgatgatacaatcatgacatacgcgaggaagaagaacatgacaatctggatgaagaacttgggattgtccctcaagctcggagcggccactgatctactgcttgagaatacaagaataaattcagttatgtacagtcggtgatgagctaggtgtggtacaaaatgatgcattgcagcatatcttaccttgcaatgcgttgtgaaagccgatgaaagggtaggctctgtatgaagaccacgcctggtcctgtgagagatgctgtaagctggttacccccctgcatagccgatggttcatcagtgtaaggaaattagttattttcaacaagaaactttagttgataggcagtaggggggacggatgtactcacactgaagactactcttctcggttggttaggggttttcaactgaaagttgatggtggttgtcatagccacaatacaagcagcgtcaactgtaatcacctcacgaggggcaagaattttctgcatgactagcaaaagtgaagagcaaaatctgccagagttaggggctttgttggccagggttaaaaaataacttgcttatgtcaaaacaaaaacgatatgagttcaaaaggttccatgctaatttgaaacaaatcggagatttcatacttcactatctaacttatgacagaatatgtaaatatatagtgaattggatagtgccgcaggtattgccaatgttgacaacattaaaatcatgccagcataaactgtggcaccatattatgttcctttagcactagatagtatatatcctcaatgcatcctaaaaattttacagaacatcagaaccatagctcctaattatagtatgaacaataatatattctagtatttactccatagatcagaacagtattgcagtttcaaattccaaaatcaatctccagtccatgaaactgacacaaagggtgaaatgaattatacctgatccaccaccaacaaggaaagccatcccttgacccctaagcttctgtttgaggatcacctgtagagggaatgcacatctttcaattcccaacaaaaagttaacaagtactagcttgcaaagaactaacaggtcccacatgatctccaaagtacctaaataattagttaattaccctacctctgcaccaatttcaatgtttcgcggcctctgctcaactgtacttgtgactgacacatcattaactgagcagagaaaagcatctgcctgaaaggacaataaggtaatatgaggtttctgtgattgttttcagccaaacaactaacttcgcacataacttacctggcaaagaagttctccaccaaagtttgctagatccatctgtaatataataaacattttccatttatgactaagaaagcaggttggtcaataatataagtaccactttccataaaatttaatagagtaaattatatgaacactgaaccaggtattcattttcacggaaggcaatggtttgctggaataatatgataatatcacatctagtcatccagaacctacatctcatgcagcttactagattaactcatacatgttattatcatgctagtatgcacattacacctcattattaattgctacaggaccaaattctaatgtatgcacaatgaactgttgacctttttatctataggtaaaacatatggttcagattggaaacaactgagtgctggggagtgcatttgaaattttgaacaaaagaatgaagcaagtcctccaacagtctaaattctgaatcataattatagaagaatgatggaaatttgtcagtttgtcactaataagatatgtaatcttgctaattgtaagaggacaacagtgatgattacccatgagcgatatgctcatatgcagttctgtacagtaagtaaagtaatggtgcagagagtcaaagctaagctacaagtaggtgaaagatgatactagggatttgaatgacataatgactctattttcaaaaaagatactaacaggcagtattctcccaggaaatggtgcagaaatcccaacatatccatcatcagagccagggttgaagaaaacactgctgcttatgcttttcccaaaaatccactgccacacacctccatcattttcaggcaagtagttgttgtccgtttgaatattaccagacatgtagcacattgtacctgaagaatacaacaatgatgaaagctacacactaacaaactctaagaacatcacaggattcacagaagccatatgacaagcactagcagtaacaactgcatacatgtttttttcgagggagtagggcaggagctctgccattcatctaaagaagacaatttgaaatgtttacaacaacagttttggatttactattacaataaccgcataaatgtatgtttggctccgttgcctatctatgagcatgtaaatccttatccaaatttaggtactcctgggtaggtaaaggaacccacatagccccttaatttactaggaatttcaggacaagttacagtaaattgcactacaaaaccatgatagtaatgaaactactcatgtatattagatttatctggttttatcataacatacaactaaaagtatggtggtaatctatagttctgcaactgatcccaattattacaaagttaaccttaaaaacaacaggtaattcagcatctgaaacaaagagtattcataaatcgggcaagctgcagatatttcagctgcaaaagagaagttcaatcaagttactggagagtacctggtttcacggtcaacttttcctgtgacttaaccatcacctaaaatatcatttcgacacaacaattccgaatgagcagggttcgattcctcttaaggatcgaagattaagagctagcaaacaagaataaccaggagctacctgcaggacctgcacatcgccgccggatatctggaacgccgtcacagatccttcctggctctggaaccaacacacacgattcaaaccaggttagatcagaggggattccaatcagcaaccaaacgctacggatcgggcggatccagcccgacgagctcgaatctagccctaacatccacgccgggataagaccagaccgtgtgtgcgaagggaaaaattgaaggatcagatcgtgcagcggaggagccccacctggtagacgtagggctggaaaggcgtggagaagaagggcgcggccatggcggggggtcggagccttccggaagcttctagaagcgatcagtgagagccgactcggagcgtcgtcgtcgggttcgagggaggcggagttgccattcgacgacctctcggggtccttccggttcagggcttaatttctcgagtttttatctcctcttccttttgcagtcatacgacgtgggattatctgggccgtcgatcgagttctggacggtgggtgatgcaggggaggtgcttgcgtggctggtctcgtggaagccctgtgcacgtatgcgtccgtgtaatgttggccggtatggcctggcacgacttggcaggttaatgctcaggtgaatttttgggattgttggctttttttttttacacttacccaccactgcacacgaatttattcccgtttaaatgaatcttttattttcgtcataagttggtactcgtagttgagttctactgtaaatgaaaaagatacgatggtttttgttaacaccaaaaatttaacaccttgacacgaaataggaaatcattgtcagagtttgaaaagtacgtttctttcacatgaccagtctgaccgacgacttgtgactagtcagaccggctaagtccgagtctgagtctcgagtttcattgtttggtaatctattttttcgagtcctaattgatctctaccctaagttagacgtggaggaggtcttatagaaagcaagataaacctctttataagggtcaagaccagttcgattgaccacacaatctgtttctagcacaattagccaattgaatcactttttcaatgtcgcatatactttctgcctaattctagcctagttttgtccatttttgtcggtttgaactaactgtcatctatcctcgctgtaagagtgcaaatacccttttgtaaacttttcatttgcccatgagacgggtgtttatccctgtttcatctaaatcggctccactggccgatttaattttacaaaactcatcttgatttaggctgtgttctttgctcaatgttccacccctcttcctcgtgttccgcgcgcatgcttttcaaactgctaaacagtgcatttttgcaaaaagtttctatacgaaagttgcttaaaaaaatcatattgatccatttttttaaaaaaattaactaatacttaattaattacgcgctaatggaccgctccgttttccgtgcaaaggaaaggagttcccaatccactgaaaagaacgcagccttagctttgtttagatcgaggtggttggcgactccgtgtcaccatatgacgtttaggtgtttcgatcgtattttgtgacttgttcaaaaaagttgccaacaactttgaatcctaaaaatatggtaacacacatcgagtgaggtatagccttgaatctaatgtctaaatacaagatgcaacgtgtgagatatgcacttctttctaatgatagaaatccaactaaattgtatcgaacgggtgcaagtgcacaagattaagagacaagctaatagggttgctcatgtgttagcacaaatggcaacgagtactaggtcgtgtggggaatggaggctgtgcgcccccgcatcaatcctagacttgttaaatcaagaatgtaaccctctatttagtcattaataaagttctctcttgactaaaaaaaactacataaaacccaacggggttagacattataaaatccacttatatataagaacgctataccattactcatccaatcgctttatggcaaatatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22426 - DNA, 473 bp, Oryza sativa
attttcgtgaggttacactggaggtgaattcatcctgcatcatgttggcctgctttcaattctctcttaagcatgattcaagtggccttagattaattttgtataacgtgtgttgtgttaatgcacaggtggagggcaaacctgttcttaagtttgcactttgttatggattcagaaatctgcagaacattattaggaagattaagatgggaaaatgcgaatatcactttattgaagttatggcatgtccttcaggtactcccatttatgatacagtgtggcttgcccgctttaagtaaatggttctgagccataggatcttgattctatgaccttaattgttcgcttgcaggctgcctgaatgggggaggtcaaataaaacctgccaaaggccagtctgcgaaggatcttatccaactactagaggatgtgtacatccaagatgtaagctagcgaaatctctcgctaaattt

SEQ ID NO: 22427 - DNA, 1926 bp, Oryza sativa
  unsure (1)..(1926): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccaaaactagctcatttttcagctcatttaacccttgctttgaacaatgtgatagtctcttcactgctatctcttgaccatctaaaagagttccctgcaagtgtgtgatttagtttgcacgtatatatttagaacttggtgtgaagaacatgaaaagggatacaaattgtatgatcataaaatgtattaccgggaaaacatttttttcaagggaaaaggtgaattcattaaggaaagagtacgaattattctcctaaactatcgtggttgacataattattcccactgacatcgctcaccctaaacttccaataccgaacaaattacccccctcaacccaatccagagcggttttatcctacgtgacaatccaatcagcattttattttttaaaaatggtggaacccacttgccataccccctcttcctctcttcctctcttccacatgacccacatgtcatacgtggtcagtgggcgcggtgcagaaacgggcggtgggcaccggcacgggaacgagcggtgggcaacggcacgcgggggcgggccggctgtcggccacccgagagagagagagagacaaagagagagagagcacagggattgggaagggcagagggatgacaggtgggtccatgagttttttaacttttctttgctgactggattgccatgttggtgccacgtgtacaagctcgagtcgaaaacaattcaaaacagtgcttaaaggggttatttgtctggtttgtatagttggggatgaaggatgtttggttttcgggttcaggggtaattcgtactttttccattcattaattaggagacaattcctcacacacaaggtgtggtatgagggtacaagaattattatgcagaaggaaaagtctatttatgccttgaaggaacatcctctcttctgtttttacatgttgtctaaaaagtcataaaaatataaaaagaattgataaaatagaacaacgtgtgaagtgtatctcgtgccagaaacctaaatgaacttcacatcaactagcaatgccagatacctatgagcttcacacatataacgtacaatgctcgctatctcgtcaattatcctattctgtaaacagtgatctttttgttaaatgaattttcctataccatggtcatgagctactttatctccctgtcctagtgtggtgaacttgtccaaaatccaaacaaaacaatgaaaaggtaagatcaattttacggtacttaagaaagtaccttaatacctttaaaactttgctatgtggagttaccatcatttatattagaaaatatgagaccttcttaaattttaataccttctaaaaatgataaaattgcccaattaattaaatgtaggtcatttcgtccagattttattatattatgatgataccttataaaccataccaaaaccaccttccctgagcctatttcgctcgtcgaagttatttgttgctgtctgcaaagttcggagatcaagactgaagtcatcttgattaaatgaccctgttgaataaaaataagtacatgacagcagtcagcagcccaggatatatatgcctgatcagatcggctgattttacagcctccagtttatcagccctaaaataataataaatgtggtggggagtgcaatattacgtacttagcttgttgcgatccatgtgtgttaatagtctcttcatcacaaattataataactatattttttatatatttttatcggtattcaatgacatactatgatcattaatgtattccatattatgttcccaacaaatatgaaa

SEQ ID NO: 22428 - DNA, 956 bp, Oryza sativa
aagacccgatcccctcaggccagaaaatgcttacgctattatgagggctcgaggaagttgcgccattatttccaggcgcatcgggtcacggtggttacgtcttaccccctcggccaaatcttgcataaccgagagggtactggacgggtggtaaaatgggcaatcgaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcgacggctccctgtctcttcagggcgcctttgaagaaaggcatgcccagccgacggctcgacccgaccccctaggggagacggacgcacctgaacggcccccgaggcccgtcggagtccaggcctcgggacccgaggggagcgctcccagctcccctagattgattgcttggatcgctgagatctaggcgtacatcgcagataagactctacccgaggaccgcgaagggagtgaacgcgtccagcgcatctccaagcgctacgtgctggtggaagggaccctctatcggcgcgcggctaatggagtcctcctgaagtgcattcctcgggaacaaggcgtcgagcttcttgccgatatccatgaaggcgagtgcggagcccactccgcctcacgcaccttggttggcaaagcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccatttaggcgggccccgggagggttcgactatctgtatgtcgc

SEQ ID NO: 22429 - DNA, 761 bp, Oryza sativa
gctccgttcggctggccatgggcgacggcacagagctgcctaacccgtggaacatcgaacaccttcgtcgcttctacccctagtgggggtcgggtgtcaggtctcgggctcgggccaaccccgcacccccccgggcgtgcagggttggccgggggctaccacatgcatatacttatcttttttctcttccgtatttcaataaaagcattttcgatttcctaaggactgcgtctgtgccattgtttccttttgaataatcttggcttgaattagcacgctcgtgctcgatcctgcccttggtggcccgggccggctaaaatcgccaaaaggggcccagaaccgagccgtgccccggggcgtggtgaactccgggggggaatcggcaaaggcccacaatcgggttatccataaccctcggtcaccacgctcccggcctggccagtctcgacacgtggatctccccagtctaaagttataaaaaaccacctaatgttgcactattaatcagcgaagcatctacctatattcatactagtggaaccatgaatagagtacccaccagttggggttttgtttattctagggtgaacaaggtaataatatcaatagcaataataatgtcttaacaaaggtaaataggcatggctaaataaaacagtgataacgcgggaatgtaaataaagcggtaatgcattaatttaaatcaaaataattttataaacaaggattaaatatgctcaaagatgatgtgacttgccttg

SEQ ID NO: 22430 - DNA, 3664 bp, Oryza sativa
agattcggcccatcgaacccgggggaggcaaattagacttttgcgaaggaattgatttgggaaggatttggattcgggattgaactcgacaatagatcggggatttgagatctgagatggcacggacactagacaacaagcgaagaaataaatttcgcaattagggtttttaagagatagttttcccgctaggcgccacgacggaacgggcgctacagaccaacccccctaacaagaatctcgacccccagatttagcacctaagggagcagctccgggaactcggcgcggagaagatcttctcgctcccaggttgcctcatcttcagaatggttgctccattggactttgtagaacttgatggtcttccttcgagtctgacgttctgcctcttcaagaaccttgatcagtctttccttgtaggtcagattcttttccagctcgatattacccagggaaacttgctcttctggaactcgaagacattttttcaactaagacacgtggaacacggtgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctccttttccgaactcaaggtcacgcctccgattgtcagcgtaattcttttggcggttctgtgctgtctttaaacgttctcggatcagcttaacttgttcttttgctgccttgagtatgtcaggaccgaataccagcgcttcgcctacctcattccagcacaagggggtgtggcactttcttccgaacattgcctcattcggcgacatctgaatactggcctggtaactgttgttgtatgagaactcagcatacggcaaacaacgatcccaagtgccttcgaaatccagggcacacgcacgtagcatgtcttctaggatttggtttactctttctgtctgaccatcggtctgcggatggtaagctgtactaaaatttagatcggttccgagagcttcatgcaactgtttccagaaccttgaggtgaactgagtgcctcggtctgacacgatcttcttgggacagccgaatctacatacgacatgggtcatgtagagttctgctagtttctttccatcaaaggtagttttcactgccacgaaatgagctgatttcgtgagtcgatccacgattacccagatggagtcgtacccgctaggggttcttggcaaaccggtgatgagatccattccgatttcttcccatttccactcgggaattggtaggggctgtagcagaccagctggcctctgatgctctgccttgactctttggcaaatgtcacacaaggctacgtattctgtgacatctcgcttcattccagcccaccagaagtatgccttgatatcttggtacatcttcgtacttcctggatgaatggagtaggcggactcatgagcttcctttaggatgagatctcttaattccttcttggccgggtacacagatgcgtggaccggcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtgataatgaattccaagatcgtaatccttgattagttccaaccatcttctctgcctcatatttaactcagtctgagtgaagatgtacttaagacttttgtgatcggtgtatacttcacatctgttcccgattaaatagtgcctccagatcttaagagcatgaaccacggctgccaactcgagatcatgggtgggatagttgacttcatgaggcctgagctggctggatgcataggccacaacctttcgttcttgcattaagacacatcctaagccttgttttgatgcatcacagaagatctcaaaatcttttcggatatctggcaaggtgagaactggggcagtggtcaaccttttttcatttcttgaaagctgccttcacatgctgcagaccattgaaatttcttttctttctttaaagctcgtcataggtctggctagctaagagaatccttcaatgaatcttcgataatatccagctaagccagggaagctgcggattctctgcccattcttggccgggttccaagcaagtacagccttacccttgctgggatctacttcgacaccgttggaggagatcatgtgtccaagaaatgctactcggtctaaccagaattcgcattttgagaatttagcgagtagttgatgatccctgagcttttccattatcagcctcaggtgttcagcatgttcttcctcattcttggagtatatcaggatgtcatcgatgaacaccacgacaaattggtccaggtattccatgaagattttgttcattaagttcatgaagaatgctggagcattggtgagtccgaaggacatcactgtgaactcatatagaccataacgcgttgagaaagtggtcttcggaatatcttcagatctgatttccagttggtggtaacctaatctcaagtcaattttggagaaaactcttgctccttttagttgatcgaacaaatcgtcaatccgtggcaatgggtacttgttatttatagttacttcattcagggctctacagtcgattaccattctctcagagccatccttctttttaaccagaagcactggggctccccaaggggatgagctaggtcgcacataacctttactctccaattcttcgatttgtcttttgacctctgctaactcattagctgccatttggtagggtctttttgcaattggtgcggtgcctggtgccagttctatcgcgaactcaatctctcggtctggtggcatactcgttaattcttctgggaatacgtcgggatattcacagactacgggcaccgactccaaggaggtgacttgtaaacaggttaggatagaccgacttgcggtaggggtgttagaggtaaagcggacttgctttcctccaggtccttgcaaggtgatggacttttcggcacaatctatctgtcctttgtgcttagctaaccaatccatccctaggatgatgtccaagttttgcgagtctaggactatcggtttggctaggaagtcaacttcctcagttctaaggttaacttccgggcatatttgagttgcccttatattcctcccaggggaatgtactatcataggtacacgtaaattttgggttttccaaccatttcttttcacaaaagcttgtgatatgaaagaatgagaagctcctgaatcaaatagaactattgcgggtatggagttgacagagaacatacccatcacaatgtctggagcatcctgagcggtctcagcaaaaaatgtggttcactcggcctcgacaaaagctgttggaagcacgagaaccttgtccacttgcct

SEQ ID NO: 22431 - DNA, 855 bp, Oryza sativa
atagaccgacttgcggtaggggtgttagaggtaaagcggacttgctttcctccaggtccttgcaaggtgatggacttttcggcacaatctatctgtcctttgtgcttagctaaccaatccatccctaggatgatgtccaagttttgcgagtctaggactatcggtttggctaggaagtcaacttcctcagttctaaggttaacttccgggcatatttgagttgcccttatattcctcccaggggaatgtactatcataggtacacgtaaattttgggttttccaaccatttcttttcacaaaagcttgtgatatgaaagaatgagaagctcctgaatcaaatagaactattgcgggtatggagttgacagagaacatacccatcacaatgtctggagcatcctgagcggtctcagcttgaatgtggttcactcggcctcgaccaaagctgttggaagcacgagaaccttgtccacttgcctgagagctaggacgagactgagctgccgctggagtaggagttctggcagtgctgccattagcatgcccggagttggtgttggtaggattctgagggcactctctggcatagtgacccatctggttgcaccggaaacactgaactgctgacggtccctgcggtgacttgaaagaggtaacactgtttggcgcagtagtgccactaggggcacgctgctgtggccgaggtgccggacggttcatctgaggacgaggggcgtagcctggctggcagttagcctgagtgaccgactggtggtattgcatgggttgaccgtagcgacggcgaggtgcgcctcgggaagaaattcatagatggttagacttgcgtttcttg

SEQ ID NO: 22432 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnntgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgttgtttactgcaaaacttaacccctattattatccccttgtacccccttgcattaatcatgcatctgccggtgtgacttgctgagtactgtggttgtactcatccttgctcaatctttcccccccttcagtaagagaagctttggagaagaagtcttaggtggagtcctggcttataccccagttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacgtgccgacatcgcaacccgagggggagcga

SEQ ID NO: 22433 - DNA, 585 bp, Oryza sativa
gtcgaaagtgagggcaacctccgaccaccgcgcccgccgcgtcgcctcatgggtaggggccgcggccagaagctctcgcttcatggccttgaggctccggcgagaaacgtgagcgcacgctcccccatcgacggtggcgacggtggccccgggctcctggaaccccaggtcatcgtcgccatcgtcgacgtcctcggcggtggccttctgcttggcctcacctcgccggttgccggcgggagccgccggggccttgccctcacggcgctcctgcttcctctcctcctcccacttcctcgtccgctcagccaaacttttgaccgcgcggcagtccgcgaggtcgtggagggaggtgttgtgcacagaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccaacctcttcttcctcctcctgtcccgccgccctgaccgagcggcggacccgtgggcggccggagctgccacaccggaaccgga

SEQ ID NO: 22434 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnnnttaccgcgtgtgcggggatgcatggtacggtgttgcggacttgacagaaccgctgaatgtaggagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctctcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgtcctccgttgcgtgggcagcacgacgaccattgcgccggcgctcgatattgaggcgggcatccggccccccacgcacatcttcttgggtcggaggcgttgacgagggaatgg

SEQ ID NO: 22435 - DNA, 593 bp, Oryza sativa
ctcttgcacttaaggaccgttccttggaatttcatccaaacataagacaagtacgaccacatgggtggaatgggacacccctggctgagtacctagcttatcagggaagccttgatgccgagagacatgtggattcgcgggggtggtgtcggggaggacccctgggcttcctggcacagtatggtctggaacctaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagctgttggccgggtgccaaccttgtttcaattc

SEQ ID NO: 22436 - DNA, 682 bp, Oryza sativa
ctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcgggg

SEQ ID NO: 22437 - DNA, 1497 bp, Oryza sativa
  unsure (1)..(1497): unsure at all n locations
nnnnnnnnnnnnnnnnnnnnnnnnnnnnnnnnnnnnnnnnnnnnnnnnnnnnnnnaagcaagatcaaaagcagggtagatttgacttgaaaagatgcaaatttgggccgaatttatctgtccctgctattaccagcactgataatttcattttcttttcttttttactgtaacgaacgagagagaacgaaagagctaggcgcgcgtccaggccaaggccggcggcggcggcgccgccgccgccgcgtcaccgggcggctgggtagtcgaacggcagcggccgcacctcgtcggagagcgggtccttgtggcggtacccgtagttccggagcacctggtcgtcggcgaagttgagcgcgcggttcatcccgtcggcgcagctcttcttggagtagatcttgttcggctcgccgccgcacggctggcacccggtgaagtgcgtcacgaacggccgccgccacccgctctgcccgccgccggcggggcccgggacggcgcccctcaccgcagagttcctcgccgccgcgtaccgctcgtgctcccgctccgcgtgccgccggcggagatgcgccgccgccgccgagggccgccgttccgccgcctcgtacctcgccgcgatgtcgtcgagccggtcgacgacctccacccagtacccctggaagaagtagcccttctcgaggtaggtcttggccccccatttctcctcgtgctcggagaggaggtagacgagcgccgactggtcgtcggactccttgtcggacttcccccggagcgtgtcgtggagcacgctcccccacctggcgtactccggcgaggcggggcccatgcgcgcccacgcgtccatgaagtcgagcgaccactggcagttgcggatgaggaacacgccggcgttgagcccgacccacgagcgctcgccgtacacctccttgttccagccatagacgacgaggttgtgatccttgtacttgtggagcgggagggagaagtccatgtcggtgaagacggcgtcggcgtcgacccaccagacccactcggcgtcggggtgggcgagcatggcggcgcgcacggcggggatcttggcccagtaggcgagcatcctgggctggagcagcgcgttgttgtagaggagctcgacgccgtggaggcggcagtagtcgaccttgttcttgaggaaccggaagaggaggtggtcgccgccctcgccgcggcagggcggcgcctgcgagccggacaccatcaccacccgctccctccccgccgccgtcgcgttgagcccgcgcgggtaccgcagtcgcatccacgccgcccgcctcgcgtcccacccggtgatccccccacgccgcccgacctccacggcgtacgacaccctcgagtcgtcgtagaacgtcctccccgccgcgcccggcccgccgcgtacgccgacatcggcgtcgatcgacgcggaggcggcggacgtggaggcgaccgaccccgggagggagcggaacgcgacgaggtt

SEQ ID NO: 22438 - DNA, 1179 bp, Oryza sativa
  unsure (1)..(1179): unsure at all n locations
nnnnnnnnnnnnnnnnnnnnnnnnnnnnnnnntgttgatcatatgctgaaaagtggggaagtcatgagcaagcaactggagtctcattccaactgcaattcccttcaagaacttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattttcccaccaatctgcagcaggtcctcttagctggtgagaggcgtagagtgtcttctcaacaggagtacactgtactaagttaagttttctatcaacatccttcagccaatcgtcagcctcgacgggctcgacggtctgagagaactctggcggacgagacctcagaaagtttgtcagcttggatctattgttgctcatgtgagggtggccatttccatgcgcattatgctgataaccagctacggctgcggctaatccttgcaagatttgtgtctgaactgccattaagtgctgcatgttattttccacatgaggtggggaagggaggcgttcttctccagaattgtgactggcggtgtggtgagagcggtgggactgttccatctctgcattacgggaagctgtgtgatgcgagcggttgctgcggcggggttgctcaacttctgcgttgcgggaagcagttcggtgcgaacggttgctgtggtgagactgctcattagctgactcatgatttgcttctgtcacaactctaccttcttcaaaaccgaagcgggctggcgcacgggctgcacggcgggggcggctagccatctaaactcccagaagagggcgaggtaagaatcaggtaagcacttaggagggcaaggagtaaagtaaatagcaactcagatagcacacactaggcataaactgaatttttcaaatcataaaatcacctagtacaacaggtgtggacaagtcacagagctacgccgagcttgactgtgcgcacaccacctaggagaaccagactaccaaacaacacccccaacaaacacacgcacgcattacctcgccatgact

SEQ ID NO: 22439 - DNA, 1614 bp, Oryza sativa
  unsure (1)..(1614): unsure at all n locations
gggtgtgggtagggggagtacactggtaagtacggcgcacgctagctgggggagcgcggcccactgggagtgctggcaaacccgcgggagctgtgggaggacaggtggctggcgtggcagaggctgcctgagtcccaagagacagtgtcaactgaggtgacaccctcctcggccagacgggcctccagagcggcgtaacggctgtcaagggagcggtaagcctcaaggagtaggtcgtgctgagtggactgagcctccgaaagctcaaccatgcgagtcagcactggctgagactcgctgtacggacaagggtacctggcgtctgcgtggccagaaggaaggcgtggaagctgccggaaggctgagcccccgagacggtggctgtagtcgtgggccaagcgacgaagcgcagtccaggagaggtcctggtacgcgatctggagagtgggcctggccacagtgaagtggtgtgggcgaaggccaactccgtgtatacctccacgagggtaaaggtacacagagagctcacagtgagggggaacacggtccacggagtaccccgtgtactcggggcacgagaagccaaggaagcgggcgaggtcacgaagctgagcgacgtggtgaccctcaccaaaaccgtgggaactgaagcaaactattgaaagagggagccatctacaattttgaaagagggagaaaagatcagtaaccattttagaaacaaactattgaaaataaggaaaccaaaagaagccttagcttttcgcaagtagttttgaacttagtatccttagggtcgtcctaaatgtcgggtttcgccctagggccaagcctgtgctcttataccatctcttgtcacgccccgaactagtaccgaccggaactagcccgtgacgctctaaattaacctgttaatcgataccagtcccaggaaacggtgctggtatcacaggaagacggattatcacagcaacagaggtctctttattatagagtagaggtacagtcatgttgggctgtggacagatcccgagctcacaactgcattacaaaagggaagcggaagccaagacatggaccaaacaacacaggcgcgacttgggaactaggccgaaaccctaaaactcatcgtagccggcttgctcctcgaagaactcctcatcagcaggatccgcttcatcttcttcagcaactggggggggggggattatttatatagagcaagggtgagtacgggagtactcagcaagccatgggaaataagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaacggccacccgggccaacaacttttcaaacggccacccgggcctagctgatcccatcagctacagatttttcaaacatcgaaccccttttcagcaannnnnnnnnnnnnnnnnnnnnnnnnnnnnnnnnnnnnnnnnnnnnnnnnnnnnnnnnnnnnn

SEQ ID NO: 22440 - DNA, 718 bp, Oryza sativa
taatacagtgtattataattagactgtaatgttgtttgtcaattgagtaatataaatatcaagcatcatataaaaatgcttaacatacaagttaggtgcagagtcttgtcataatctgataataaggaaaataagtaacatgaacaaaattaattaataagtcaatgtcgtaagcaattcaaaatattaaaaaaccttagcaaacatgataaacctatatgctatatcacacgtcatgaatataaatctaatatcttcctagtacaatgtgatttgtctctcggtaacaactaatctaataagaatgtattctacgtcactttcatagtcttttattgtcctttattgtagtcttgtagaatagtagtagctcatagcaaaacatggtatctccatatcaacatagcttgtcacctgctcaaatcaaaatttattcacaattttctcccttttgctaggttatgcacctagttaattatcccaaagctaggtataagatttcattctttgctagattgggcctgttcggccgtctgttctgcggctgcttgataaaacaacttttccggcaatgtaacagatattaacacaacatttggctggttaccacttccaactatatcgaagtttcacgccgcggcaaatcttatagtaagaaaaatagcaaaaaaaacacatgttagacatcacacggaaccaaaatgtatccatagtaatt

SEQ ID NO: 22441 - DNA, 568 bp, Oryza sativa
ctcgcccgtttgcggcgcacgaggtggatgtgcggccgtggcagtcgagatgggacatatcgtgcgcgcgttaactacgctcgccgaccgacgcgccatcatcatgtctccaggcgaaacgaaccggctcgtcccgattcgcgtgctactcgagtaatgtagcggtcttgaagaaggccgctcattattgtcggtcggttttcccttgctgatgcgcgcgatttgcgaccgctgggttcctgcccgcctgtagagaccggccccacctgtcaccaggcctaaggagtggcgtcacgcccgagcgcttccctcgaggggggcgatcgccctggcatgacgccgggggctactgtcggtgacatgggaccgagagtatcgtgactagaggcttgggcagccgcggtcacccatgtggcctgaccccctcggggggggggggggcgggccccagggtgacgtggcctcccctccctctgtattcccgaggggtcgggctgctcccctttaggccccgagggctggggctcccccaccccctgtggtattggcgccacgtgtgtgggttaag

SEQ ID NO: 22442 - DNA, 6185 bp, Oryza sativa
  unsure (1)..(6185): unsure at all n locations
tcccgcttagattaatccaggtttcatcgcacccattcaaggaagtcattgtatgaaaaaggcaaaacgtgcggcatgataaactgacgcgtggtgaacaagaatgcccggtttgtgactggtctcacgccggtcacgtcatcggcaggcacccgtgctcccacgttgcatctgcttccggcggagtgaaggtaggtatgacccatcccatcggagggtcattcggacagtggccattgcaaatctctgcccattaatgaaggaatgacagggtgatcccctgtgtcgggcgagtgacggcgctgggcctcactcaaggacaagctatcatttagcttccaggcgaagatgcgagccaagttttggtcaagatagggtgggtccccaccaaaaaaaagagtaggtagaagtggtgcatgtggtatccccttgagatataaaaggaggaccttgcccaccgaggatgggaggccagaaccagaagagaggggttcgagagtttgaactctcttgctctccggctctttgtaactccttcacacacagatccatcagaacacaggagtagggtattatgcttctcagcggcccgaacctgtctacatcgcccgtgtcttgtgcatttgctctctcgcgaacattccacagaccaagggctaagaacctcacttagcgcccccagccgaactggcaaaggggggcctgcgcggtctcccggtgaggagcgccatgctccgtcacacatacccaatagtaatcgactaagctcggcggggcccaccataataccaattcttatacggaatcatacctcgtactccctccgtactcgtaaagaaattcgttttggacagcgacacggtctccaaaacacaactttaacttcttgtttctataaaaatatttattgaaaagtgatatatgtatacttttataaaagtatttttcaagacaaatttattcatataacttttacattttcaaactcaacaacttgagagttattcataatttatattttcaaggtttgatttaaacattgtcctaaatgacttcctttatgagtatgaagggagtatatagaaggagttcaggataaggaaggacaggtagagttctatatggaaacgacaaggactactcggattgtatccatattggctccctagttctagttggacaaagggatgtctatggatataaatacaaggccccctaggaggatagaggacacaataagacacgacagatccacacacaagccagaacaaaccaatacgccaaacatcaacatcagagataagcctagacagacccaatccagtgcctacgaaggccaacaagagggatctagtgctatctctgatctcgatgagttcgtactcgaggaggaagactactctgtcgtcgactacgtgttggttatctatgccgccaagtcgatggcagttagataggttatcccaattattgtacttgtgtgatccagatgaataaagagcaacaccggctccggccaacaggagtagggctattacctgtcagataaagagtccgaacctgtataaaaatccttgtctccatctcttttatttcaatctcgcatataccctggtaccaataatctccatatcatgcaaataccgtagttgtgacctcctgttgacaacagctcaagacagagttcagaagcaatctcaagcttgaagcgttgtgattcaggtggggtgtttagatatttgttagtgtttttgcatgagaaatgaaactattcaacatttgtttgtagagtgtcactatgcaaaatttctttggaaagctctacagtttactactggtttatatactcctcatagtatatctcataattttgagaattgtcttgtgggagttgataaaaaaatctaccaaacttattcttgttggagcatccgctatatgttgggctatatggttgtgtagaaatgatatggtttttgataaatcaccatctatgtcctatatacaagttcttttcaggacaacatactggctccggtcctaggctcaactactaaatggctccggtcctaggctcaactactaaaatgtgatgaagaaatcaagtcagtgaaaactgcatgtcgtaatcttgagtcaatggttatgcagctgttcgctaactatgaatggagattcacaaatagaattcaataatttttgtgatctttttatgttgtgtgagtttttattagtttgtgtgtacttttgtttattcaggtgtgagtttttgttgaattggtgtaataattggctgtatctctttgagcaaaggtcgggattatattctattattaaaaaaagatatttgttagtgataaggcttagtagttacaatgtaatctagatagcagataagataagatagaatatgttcagagtttgatgtataatattatcaccttgtaaaccacggtaggggtatttcctacctatataaatgaaatcacgggccgggcaccgtttccgccattctttgatatcagatagtaacccaaatcaaaatgaagaaactaaattgctgctatatttacgctaacttctctcaaagacatgttatggcaccctttatacttcaacattagcaaggtattcttgcgaagatcatgatcaagaattcaagatattcaataataaatttatgaggctattttgtttaccaattttactacacccttatttcaaattatagattcgttcgaagtttaacatgtctatctttgaccgctaattttaaaaaatccatgtagtttaacaacatgtaaataatatattgtaaaataaaatataaatcttacgatgttaaactataacaccgtatatcactaattgatggctaaagattagaatatatgatttaaagaagacatagaaagaaaaatgtaatttgaaacagatgaagtatatatatatgaattgtaaaagactcgatcgttcgtaccaggtaccgggacatcaagaatctgcccctgggtgaggtttttgggatcggtgatcccgttgatcttcagcagcgtagattccttgaccccaaacctcgcggcgatcttcgatacgttgtccgcggcacggactttgtaggcaaagtgcgtcacattgttcccctccacctggtcgcagctgcagggaagtgggatccagagctcctgcccgacttccaggaagtcaggattggagatgttgctcgcggcggcgatctcctggtaggtcacgaagtcgtcaaattgagcggcgatataggacatattgtcgtttatctgtatgatgtggaagggctggctctcaggccggttggcaccggcgacgcaggagcagcggaacgggacgataacggtggcgttggtggggatgcctgtgtgggacggggtgctcggcgggaggccgttggcgtcgaagaggtcgcggagagtggtggtctcgaagctggagaggagctcgatgtaggtggtggcggcggggggcgtgtagacgatggctgactggcatgttgtcggccaggtgcaggtgaagttagtggccgatgcggacgacgcgaggatgaggaagaggaggaggatagccgccgcggaggaggagaatgatggcaccatggtaacgatagctatgctatatgcaagaggtaattaagtgtttgagatgcccggtaagtttgcggaggtgagcgtttgcttcttcatgagagaggagtgcgcgcggacacaacacgtcaaaaaccatagggcaagtgtaatgtgcctgtggcgggatgaccggtagtagtgtgacgtgtgacggtgggtggcggtcaaaaacaacacaagccgtgttctgcggtttgatgtgtacagaggtcagcctcagaaagatcgagaaaatttgcgatttgttcgtcttttccgtcgtctcatcgagtccattaattctacgatcgaagagccccgatatgattgcttaaatccaagctaaaattttaattttaaaacttacctttgaaatttatttaatatattgtagacaaactttctttttcagcgtaggaatttaaatcacactaacagtacatatataaaaagataataagtcgtaatggtttataataagctttttgataaccgaggtctgatgttaccatccactggacgtctggatctgatggtttttatttcgaaaaattgtttcccaaagtcagtggtcaaaatagtgcagcgtgcaatataaaattgaccaacttttcctagactatactttattcatttattggctctagctattaggctgtgttcgataccatgggttgggaacccaaatcctgtgcacggaaaacggagcggtctattagcacgtgattaattatgtattagcaattttttttaaaaatggatcaatatgattttttaagcacctttcgtatagaaactttttacaaaaaacacaccatttagcagtttgaaaagcgtgcgcgcggaatacgagggaaaggggctgggaacctcctcatccgaacgcagcctgtctaattttgactacttttgagttggggctatctatttgtcaagtggctgatttttcttatctatcagtaacttttttagcactagctcaaatcaacaactcacacttcgcatattatttcccatgcggtgaagccaatatatagtgttctaacctaaaggtagaaaatatatattcttaggtgtaaattcttataaatatgaaatatataagtgtagcgcccgttccgtcgtggcgcctaacgggaaaactatctcttaaaaaccctaattgcgaaatttgtatcttcgcttgttgtctagtgtccgtgccatctcagatctcaaatccccgatctatcgtcgagttcaatcccgaatccaaatccttcccaaatcaattcctccgcaaaagtctaatttgcctcccccgggttcgatgggccgaatctctctcggcccatctcctcctccctccccagctctctctctctctctgtccccctcccccttcgttccgcccgcgcgccgcgcgcgcgtgcgcgcgagagcctcgccgagcgcccctccctcgctctgcccgcgcgccgttgttcgcgcgcgcccgcgtggtcgtcgcccgcgtcgcgcctgcgccgtctgcgccgcccggccccgctgccctgccgcgcctgcagccgctcggccccgcagacagcgcgcgtgcccgagccgcgccgctcaaaccgccgcgccgcccgttgcttcccgcgcgcgcgagccggggtggccgaccgcctggtcgccgccgccgtaagcctttgccactcctgcccgcgcctgccgcccgtgtcgtcgcgccgctccaaaccgtcccgccgttgtcatagcctcggccccgccactccgcgcgcaagccgccaagggacggaggcagagccctcctccctctgccgcgacgcccccgctccccttctccttttcccaaagaagcaaggggcgagccccctttctctccccctttctcctcctttttccctctcgccggcgtcacctcctgtcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgtcatcgccgttcgtcgttgcgcgtgtcagaggagccggcacgagcaaagacgcaaaaggggactccgggcgcgccctctccttcctcttccccagcccgaggccggagagattactcccgcgccgtcggcctctcgtcactgcgcccgccagcacggtagagcatctccccgttctccctcctcgctccatctcctccccttagactcgggtagtagcacgagtagcctccccgtagctagccggcgccgccctggccgttgccgtcgctcgccgtgtgctcgccgccatcgccgcccgagctcggaagcgccgctcgtcgccggcctcgctcggcatagctccgcccaatccgacgctagcaacggattcccgtagccgcgtagatgctctcgccgacaggaattggccccccgtgacctcgtcgacggtttcccctttccttgccggcggttgccgctaccgaatccggcgncgacgc

SEQ ID NO: 22443 - DNA, 1631 bp, Oryza sativa
  unsure (1)..(1631): unsure at all n locations
nnnnnnnnnnnnnnnnnnnnnnnnnnnnnnnnnnnnnnnnnncctcctttttccctctcgccggcgtcacctcttgtcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgtcgtcaccgttcgtcgttgcgcgtgtcagaggagccggcacgagcaaagacgcaaaaggggactccgggcgcgccctctccttcctcttccccagcccgaggccggagagattactcccgcgccgtcggcctctcgtcactgcgcccgccagcacggtagagcatctccccgttctccctcctcgctccatctcctccccttagactcgggtagtagcacgagtagcctccccgtagctagccggcgccgccctggccgttgccgtcgctcgccgtgtgctcgccgccgtcgccgcccgagctcggaagcaccgctcgtcgccggccttgctcggcatagctccgcccaatccgacgctagcaatggattcctatagccacgtagatgctctcgccgccgggaattggcccctcgtgacctcgtcgccgtttcccccttccctcgccgccggttgccaccgccgcaatccgccgccgacgcactccctccggcgaatccgagccgttggctcgtctccccttgtcctgtgcaaccacctggtgtgctcgctctcgcctgtatcgccgtggtttgctccgtcgctcgccgctgtcgtccgccgtccgttccggccggcgtcgtcgtctacctcccgccggcccgcgtggcagccacgtaggcgccacgtaggcaccacgtcagcgccagctcggccaaggccgggtcgagccgaccccggtcagcccctccccgtgcgcgcgttccaccgcgagccgtgaggctgcgcgtgggcccgccgcatccgcatccaccgcgaaccgcgcgcgtgcaccgcgtccctcccccaccctagcaccgcgccgcgtgctccctctgcacggtgagccgagccgctgacaagcgggtcccacccgggaccacgcgtggtgagcccggtccaccggccctctctctcctcccccttgcgcgcgcacgcttgggccgccttgggccggccggcccatttagctcagccggaccgctccgtttctctcgggccgcgccctagccgcccgaggaaaagtctatattccctccctcttttcttttcttttcttttcttttccaaaaaggatttaattaaatcctttttcctttagaccaaaaatccaataatcttagaaattcaatatcttcccaaccgtaaatccgtttgactccgttcaacttccaaaattcctcgaatctcgagatctatctaatggcacgcttagaggtcattaatagggctttattattcgccgtttgttgagttgtcccgtttcgcgtgtagtttcggagcccgaagacccacagtgcgaggatttcgaggatcaagctccagatctcgagcaaggcaagccacctttgaacatcttgagcctatatttgaacttaa

SEQ ID NO: 22444 - DNA, 4268 bp, Oryza sativa
  unsure (1)..(4268): unsure at all n locations
nnnnnnnnnnnnnnnnnnnnnnnnnnnnnnnnnnnnnnnnnnnnnnnnnnnnnnntttaaaaaggatttaattaaatcctttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattattcgccgtttgttgagttgtcccgtttcgcgtgtagtttcggagcccgaagacccacagtgcgaggatttcgaggatcaagctccagatctcgagcaaggcaagccacctttgaacatcttgagcctatatttgaacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgccttggtattcgtgcactctgtgcgagtatcgatggtcgccttcaaacttaaaatatgataaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagttgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatcccccccagttgctgaagaagataaagcggatcctgctgatgaggagttcttccaggagcaagccggctacgatgagttttagggtttcggcctagttcccaagtcgcgcctgtgttgtttggtccaagtcttggcttccgcttcccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcgggacgtgacaataaacatactaattctagtctagaaaattaaaaaaataagcaaactaaaaattaagttgtacttaggtagtttctatattgtataagtttagtatatagctcgtgcaagattaggtgactgatgatggataagatacaaaactaggcaactgataaatagaaaagttattttgagtttgtgttgtaatagcatccacaatgtatgttttacagggattaagagttttttttttcctttcaactagcactgtacactgtgcattggtcttcaggtctccactggcactatcctgatacagcaacatgaaccccttccagtgcttaactgatcggtggtgtttagggttttagtgttatcagaagcgaattgagcgtcctctctcctctgatttcccttatatatatagcactgtggggctcgggagcttttctccaattaggattcaaaatggagttttaccgaacacaaaaccaatctatctcttattttgttttcttgttagaatcgggctgtgggatttatccttttctaacttaccggacttagccaataaatcaaccaacattctccccttaattaagactaactgacaaatatactaagtaaacatagctccccaaaacaatctatcacaacaacattaagccttattgagacgacaagatttatagtttactgtagtacttaaataaacttaactttacttaatgggtgttgattgatgcttatcctctctatttctaggatattaatcaaaggcagtgacttaatcctatgccgactacatgttatttgaataagttgggaggtaaggcccggtttagtgtccaattttttttcccaaagatatcacatcgaatctttggatacatgcatagagcattaaatatagataaaaataaaaactaattgcataattagaggggaatcgcgagataaatcttttgagcctaattagtccatgattagccataagtgctgcagtaacccacatgtgctaatgacgggtttattaggctaaaaagattcgtctcgcggtttctaggcgagttatgaaattagttttttcattcgtatccgaaaaccccttccgacatccggttaaacatccgatgtgacactcaaaaattttcttttcgcgaactaaacaaggcctaagtctttggttaatggatccacgagcattaatttagtactaatgtactcaactttattttttttatcctggactctatctttcacaacatgaaatttaatgccaatgtgtttaaccgcttcacttgacttcaacctcattattgtagtatattactaattgtttggttatgctatcaaccactcttaatttcaggataaaattcttaagccatacagcttgccctgttgcatgattgcatgacacaaattccgtttgcattgttgacgatgcaatgagcatcggttttgagcttttccatgaaataactccctccacgagagtgaaaatataacccaaagtggatttcttagtgtctaagcaccctgcaaagtcagcgtctgaataacctacgacctcaagtttatctgaccttttatatatgtgagcatgtaatgcttagttccttgcaaataacgtaatactttcataattactttctagtggtccatacctagattagatagaaatataccaagcatcccaataacaaataccaaatttgattgcgtgaagacttgtgcatacattaagccctccctgcgcagccatcgccctccggcgccacctccgtagatccggtcccctcttcctctccctctctgtcggccagatctagggagggggtggtcggggtggtgggttggcggcgacgtgcggtggctttggccaatggaggcggcaggtggcctccgcacgggcgaccttttcctctccctctccgtcggcctccaaccggtggcgcgcaaatccggtcggggtgagttggcggcggtggccaagggaggcagcggcgggcggccaagggtttccggcggcgacatcaccgataagttcgtgcacggattgttcctactcgtgtagttcttgatggattgtttattcctgatggatctatgatggattgttgttgttgacctgtgattggtctacgttgatttgtgattgttgttgaccacggaatgggttgaatgggttggctcgaaagcatcggctcgacttggagacggcttctctttttttttagcacaacaccaatgacaaattggtgccggctggaaaaccggcacaacgggatccatagctcctgcccgattttcacgaggtcagggttggagatgttgctcacggcggcgatctcctggtaggtcaccaagttatcaaactgcacggtgatagaagtcatgttgtcatttggttgaatgatg

SEQ ID NO: 22445 - DNA, 12511 bp, Oryza sativa
  unsure (1)..(12511): unsure at all n locations
caaccatgccttaggccttgtttctttcagcttgggattattataattagtttattataatctggagtccaacatattataatctgataagctcatttaggtaagctttttccagattattggatgaaaaattacccaccatgccaccccactccttttttagacatgcaaacccaataatctaggctctaataatctagaaaagaaacaactaaccacttattctaatacagattataacaatctagtttatagtaatctgactcaataatctgaattataataatcccaagctgaaagaaacagggccttaattatggcatcgacatgtagaattcggacctgagagagatagaggggggcagtacgtagtacgagactaatctctgtaacaaaatactccctccttccttaaatgtttgacaccgttgattttttaaaacatgtttgaccgttcgtcttattcaaaaactttagtgaaatatgtaaaattatatgcatacataaaagtatatttaacaataaatcaaatgataggaaaaaaattaataattacttaaattttttaaataagacataaggtcaaagatttttaaaaaaaagtcaacggcgttaaatattttgggatagagggagtagcattttcatattagatggacgatgcattgagaccggtgcgtcgaggttctactacgacagcagccggaagcgcctgaggccggcgcgccagaggcggcgagaggaagagaaggagaggatgaagaagatgataaatgcctctagcaaccacgccgaggagaccagcacaaagcgcccgcagctgccaccgcccgaacttcccacgcgtgccatgcactcgtgcctccgccctccggtgagacgtcacgcactcaccattgttgtagttgtcatcttgtcgatgcttttgcctgacggcggcgatgcccgatgcatcccatgaagaagatggcttggacgtcgtcttcgtgctgctgcttgtcggcggtgatgaggatcatgctccggatgcggcggccgatcgagcatggtgatctcggcccgacgcgcgcgaagccagagcgcggcgagcgctcgggcgatgtcctctcatccgggcgggcctcgcagcacagcgatgcccgcacaagagcatcccttccgcatccaccgtcgtgtctactgccagttgtccggctccatcggcagcagctgctacgcagccgaggtcccggcagtggcggctcccgtcggaccgaggtcccctaccctcccccaccccgtggctcgtcggacaccggcctagcggctggccgccggatgcctagaaggaggagaagcaaaaaagagaaggaaagaaggaaggtgggacccactacatattttttatttttaacttgataccgacttacatttgggtcccacagtttttccttgaatataagtaccacgtagatgttacgttagcttaaaccatcatccaaatcattttgggaccttatttatactggttttagaagtggttttagaagttgagggacgcatcatatgaaattttacactttacgacaatttgagggacttggagtgaacttattcctttttcgtgtggccttgttctgtcgaccagttggttgggttttaagcccactacatgaagctgacaaaagtttatttaacaacgccacgtcacaagcctcaaacctgaggccattgttttccaatttccaagacgcgagatcgagtgatcaaccgactggtctgtgcgctttttcatttttttttaattacacagtagacccacacctatacataatatcatactcataaacatgtcccataaaacatgctataagagataaaaaccaactgtaaatctctaatctcactaaaattatattgagagtttgtatatgcgtaatatttgtggacaccaaaattcatacacctaagaccactggttgttttgctttgcaccttttttttttgcgttagtaacaaaaatcagtgtgtatatgtatcgtatcttgcttctttctttgctgactatgtttggctacttttttcaatgtgctttcaggcacccacccattgttgcgcaagttcttgtcaaataaatttggaggctaaatattgttgttttgattttcaatgcaaccttctcagagttttgagtctctggaatcaagataggcaagtttttggggtttgagtactttttctttttcataatttaacgacaattctcaatgccgcaggaaaacgcatacagtaaagttatcgagggttctttgtaacatatgattcttaaaacataaaaatagtaaagttgtagggtttagggtaacccctgttaaaacgcaagaatcctagacctgctaaaccaaggaatgtaacccctgttttaatcattaataaagctctctctttcatgtaaaaaaaaaagaatgtctgaatcctaatgaacgaaaaatagtaggaaaaccgtttgaatggagtaatttcaaagaatcaaagggatctaatccttcgatccaaataatctcatatattcttttttattcttatgcgatctaaatccttagggcattcacaatgcgtcccaattttattctgtttctcgtgtgccacgtagacaaagaacctcataagcttctcaccacagtgcaagttaccttgtaatgggtctcactagtacctactttatcactttagcattttctttcctttcctctccctcctcttttcctttccccaacgcagagaaatcgccggagatggcgatggcgctgggccgagcggcgaaatctccggcggagcagcggcggggtgccggcgctcgccagcgcagcatcggcgaggtccgcggtgcgggagcggcggacgggcggcgacggcggtagggcggccagatccgcctccttcgagctccccccaagcggcgccggcgtcagcggtgtaggagcggcagacgggcggcgatgaccatgggacggccagatccaccctctccttcgagcggcggggcggcccgacggcgatggcggcgggcggcagggcgccacaaacgccgacggagctgggcagggggcgcgccacgagcaccgacggcagcaagcgacagggcggcggtgctgcccgacggcgacggcctctggcggcgggagcgagggagtgcgagctcggcggtcggcgcggaagcgggggacggcgggcggcgcggatcgacctgccccgtgacggctggttctctccccgcgtcggtggctctcgcctctcccttctccggcgcctcctctctccgacagcgttgggtggaggaagccggcgagattctccagccccatcgctttccccatcgacccgacgagcgtccggcagccctcctcccctggcggtccgacggcgacggcctctcggcggcgtggagcgcatagatggtcaagtgtggtctctctcctccctctccatgatagcgccgagcaggagtatgggccctggcgcctgcaaacttgacgaggaacgcgtagctcaaattggctccgcggacctgaggttgttgcgcggattgaggacgtgtcgtcgaatattcgttttctgggagcgaggctgaatgccacgtcctcccactgtgaatgcccttaaaagttctccggtttttctaccaaaggggcctgatcggcgaacggcgagcgcgagtgatgacgtggcgacgccgcagatcttttctcgcgcgccgcaagcccgcaactgaacagcgcgtgtgcgcgtggaggaggacggcagcggcgcacgatattattgttccccgtcacagcgcgtggactgatttgcccctgggttaggcgtcttatttacggacccctgccatcctggatattttgctgcctaaccagtacccactggcctttggaaggttctggtcactcgtccttctctttttctttttttttctttttttttcttttttttttttgcgtttcaggggtttggtgttgggcagcagacagctgcagccacgtgagatgccttttattagcaaaggttggcaggttgatggtacatgataataggaatagtttttgataattgatactttatgtgatgcttttcaaaagctacgtgaagaaattgttaggaattactatggatacattttggttccgtgtgatgtctaacatgtgttttttttgctatttttcttactataagatttgccgcggcgtgaaacttcgatatagttggaagtggtaaccagccaaatgttgtgttaatatctgttacattgccggaaaagttgttttatcaagcagccgcagaacagacggccgaacaggcccaatctagcaaagaatgaaatcttatacctagctttgggataattaactaggtgcataacctagcaaaagggagaaaattgtgaataaattttgatttgagcaggtgacaagctatgttgatatggagataccatgttttgctatgagctactactattctacaagactacaataaaggacaataaaagactatgaaagtgacgtagaatacattcttattagattagttgttaccgagagacaaatcacattgtactaggaagatattagatttatattcatgacgtgtgatatagcatataggtttatcatgtttgctaaggttttttaatattttgaattgcttacgacattgacttattaattaattttgttcatgttacttattttccttattatcagattatgacaagactctgcacctaacttgtatgttaagcatttttatatgatgcttgatatttatattactcaattgacaaacaacattacagtctaattataatacactgtattacctttaataactttacgcgatatatagtgatcacaacgacaacaacaaaaaaaaactttttaattaaaatttaaggtagccatccacatgtacataagatctggggtttggctgacctctcgttaggcgtttaggtgcacaagtggacgccacagaatgaatgatatataaatgatttctcccaacagtgactccgatgtagacttggaaatctaattgggaaaaaagagagagaggatattttggttgctgacaagactagcgctattggtacatgatattttccaaagtttggatgagtagctttcagattggatggctgagatattctgcattagttctggctggaatgcgtacagatgtatctgcatggaatcaggatcaaaatgttccatcttaaaagaaacatccacacaataaacttatattcgatgaatcaaactacgaaaataagtgtgcatgttataaacttaatatttaggtattgtgttgtattttcgatgctgaattagtcgtgtccaataaacgtcaatgagaatacttcttttatcacattttctctgcatgtgtaaaaaacataattgagattcaatcaagtggcatataaccgctagctacttctggaatctttggcttaaaccgttcaaattttcacttagattctaaaaatttgtagatattaaatcataagctaataaatctattttttaattctaactattagttatccaccatttgcttcgaaattgcttcccagaatttcgagcttcccaaacaaaccctaagtcttttatttagcgtacgcaattattagattctactatttttttgaggggtaattaaatgctctatgcagtactctagtacaagaagaaaccaaattttcactaatccctctagagcaagttcaatagtagactataaaccaactatatacttatgtaaaggagagagaacaagggaaacgatgagtcccagctcttatgcaagagataactatacacattctcgtaaacaaataaattaattacatatagagaggagaagaacataagatacaacctggtaactaacggtcccgtcatcgtttggcttttccactaataagccaaaacagtttattagagaataaaaataaatctgtagacaaaatttttatatatatgttttttctgacttaaaagccaatgctgaaaaagaaactacattgaaaatatctcaaaattaaatttaaaaatttaaattttgactttttcttgactaattaggccatccgatgggagcctaatatattatatatatgttaactcttagattaatttatagatagtggtttgctctacttttaggctccgttcggtagtataagttcccaactcctcctcgttttccacccgcacgcttttcaaactgctaaacggtgtatttttttgtagaaagtttttatacaaaagttgcttaaaaatcatattaatctatttttttaaaaaaaatagctaaaacttaattaatcacgcactaaaacgctgcttcgttcccaaccctcgcttccgatcagagcctaaacttgctcttagatttttacacccctaatatctggtcttttcctataaaaaaaagagagaggtggagagggaaagaacaaaaaaaataattacgctagtgaagctgacaatctgaagatactctcccttccactccacgtctccacctctctcacgagtggaaaaagcaaaacaaggtgcgccgttggatgcttccccctcccccccaagtggcccccatccgtgcgccgtccttttgccgcccgcgcgggccccacccccaccaccaccccccgcgagatattttggtggcagatcacgtaattaacccccaactccctgccccttctcccccacccaccccgcgcggatataaaccccgccgcgaaaatatctcccccaccgtctcatcccagctcagctcagctctgcctccgccatttcgaagcacatcgaggagagagaaagttctagagagagaggagagaggagagatgtttgatgcgggggatcgcggcggagccggcggggtggtggcggtgaagaggatgaaactgtgcgaggaggaggaggaggaggaggaggggatggaggggatgagnagnaggagnaggtggggtgggtgtgnaggccgccgggggggctagcgggggaggataaggcggcggcgtggaaggggagggcgccggcgatcgtggtgtcggacgcggtggaggtggatttcccggtcatctacgtcaacgccgccttcgaggccgccacggggtaccgcgccgacgaggtcctcggccgcaactggtgagccctcgtgcgcgccctgctcttagctgttccccgatcgatgccgctctgctctgatctggtgtggttggatggggatggcgaaatgctgcttgttttttttttttggtgctctcgattcgattccagctcgatatgttggcgagattgatggtggttgtggatggctgtgttgttgaatttaatgagcttttgccgtgcagtcaaaccttgagattttaatgcgcatttgttagaattagggggttcctgtacaggcgtacggtgcagagtgcgcaccactctgtctctgccttaatgcttgcaattgcggcgatgatgcgtgattcctgactagttgctgtaaattttagcattttatcctcacttttgattggttgttttttttttttttgaaatttatagatgggtatcatgccagtatgagatttagccagaatttgaagtgtactgtttctgttagaccatctgtattttagagccaatctctgagtaatggtgacattgttgatttttaatctacacattaagcacagcacgagcaagccaacaatcgaagtaaattgtagataatgttgttcaagtacagtaaaagcctgaaaggtgcttacgcgatctagtttggatatattcatgttattgctaaatttatgaaatggcttttgaaacaaattttgtgtatggaagttctatatcgcatatttgcattggaccttagaggcgaacaacgaaatgttcatatattctttctggctctgggtcatttttgttttctggtgggaagaggctgggcaagcaagggtgatggctacccgttagatattttcccctgatatatcttctcttctcttgctctactaaagtagccacttgcacatagaaaaagggatgatggaagaataaactgtagcatatattgtgaatataaaatgagatgggtaggccattaattggaatatagcacagttgtctgtagcatgtgggtacaaaaatttacaacagggagcatcacggttttagccaggcctttttattttttaccaccgggctaccaattaatacttagtaactttagtcttccattggcatatatcatatttagtggtcgcctgctagtgctctaggaggatatattatactggattagtaagactttttcctcctctcttggatggtactggaaaataattaactatgaatgtattcacatgacaaattaacattgaatttggacaccaactgtgaaatttgatccgtattaacaatatggaaagctattattggtgacaaccttataagtgtactacagtactacacctgcaagggttttcagttgacaagtagctgattatggtcagtttcagaattcggaactcaattttgagcataaatggaagttctggatgtaatatgaagataaactttgagaaatttgacttgggttgtaaatgtttgaacttgattttcgtgctgtactgcttaaggctgtcttcaggaggcaaggtttacctcctgacacggaaaacaatgtaagcgattagagcgagattagttaagtactagcctaaaaaaaattaaaaaatggattaatatgattttttttaaagcaactttcctataggaaaattttgcaaagaacacaccgtttagcagtttgaaaagcgtgcgcgcagaaaacgagagatgtgagttgggaaagaaggggaaagtcttttagggactcattccgtaaatgtcgttttaccattttgtggtgatttgctctaatcgtccacgtcgaatggtaaatattcttgtgtgcagtctgcacaattagcctctcttttgtcagattatgaaaattcttgaaaaacaatttattgaattgcttacatgatgcaagaacttgtctcttatattacattttgacatatcatgccatcacaaacaattccaaacatattaattttatttccaaaagattcattggatgagtttagttaaacctgtgttccatcataagtactccctccttccctaaatgtttgacacggttgacttttttaaacatgtttgaccgttcgtcttattcaaaaacttttgtgaaatgtgtaaaactatatgtatacataaaagtatatttaacaataaatcaaatgataggaaaagaattaataattacttaaattttttgaataagacgaacggtcaaacatttttaaaaaagtcaacggcgtcaaacattttgggatggagggagtagtttggacattcagcaatcagcataagctctaggcattggctaacataattaagtattcaatgtagggttttttttttttttttgcatttcgactaaagtccaacaaagcataaaaaaaatagctggactagtttctgcctaatgtttagcaatgttagcaattagcactaggttaacagaatacatttgaaaccaaccaaaaagccacattttttttcgttgtctgcgccaaagctaatagacaaatgcatgttctctatgcttgaattgctgttattctactatcatttttcatttatacgagttgttcaactgtatcatatttgcatcaagctaacagtgacataacttgacagagggcctaaagaagcttctcacattactctgttgactcaaacttgtttcagccgattcttacaattccgggatccacgtgcccaaagacgacatccgcttgttgatcccatggttgtttcagagatccggcgatgcttgaatgagggaattgagttccaaggtgagctattgaattttcggaaggacggtgctccactgtacaacaggctaaggctcattccaatgcatggggatgatggttttgtgactcacgtcattggaatccagttgttctctgaagctaacattgatcttagcaatgtatcatatccagtgtataaacaacagtccaaccacagacccaacattcaagagatcaaccctgcttctcatgaacatattcctaagattcaaagttccgagtactgctgcatcctccagctctcagatgaagttctggcgcacaacatattgtctcgcttatcgccaagagatgttgcatccatcggatcagtctgcactagaatgcatgagttgaccaagaatgatcacctgagaaagatggtatgtcaaaacgcgtgaaaaaaagacgtcactgtgaggcttgagatgagcaccaagatgttaggatggggtcgtcttgcaagagagcttacaacccttgaggcagcttcatggaggaagtttacagttggaggtcgtgttgagccttcccgttgcaacttcagtgcctgtgctgttggtaatcgccttgtcctgtttggaggtgaaggagtcaacatgcagccaatggatgatacctttgtgctcaacctggaatctgcaaagcctgaatggcgccgtgtcaaagtttcagcttctccacccggccggtgggggcacactctctcatggctgaatggctcatggctagtggtctttggaggctgtggacagcaaggtttgctcaatgatgtctttgtccttgaccttgatgccaagcagcccacctggagggaggttgcaagcgagggcccaccattgccgaggtcatggcacagttcatgtaccctggatggatcaaagcttgttgtctcaggggggtgcactgaatccggtgtgctcctcagtgacacattcctgcttgacctcaccaaggaaaaaccagcatggaaggagatcccaacatcctggtcaccaccatcccgcctcggccacaccttgtccgtctttggtaagaccaaactcttcatgtttggtgggttggcaaagagcggctctctccggctacgctcctgtgatgcctacactatggacgctggtgaagacagcccacaatggaggcaactggcgacaaccgggttcccgagcatcggtccacctccgaggctcgatcatgtcgcggtcagcctcccctgtggacggataatcatattcggtggctccatcgctgggctgcactcgccctcacagctgttcctcctcgacccagcggaggagaagccgacatggaggattttgaacgtccctggccagccacccaagttcgcctggggtcatagcacatgcgtggttggcggcaccagggttcttgtcctgggtggccacactggggaggagtggattctcaatgagctccatgagctgtgcctcgcgagcaggcccgacgaagatgagtgattcccaactccattgcttgttcttatttatttagatcctatgattattactgatatctgttgttgtcacaaccctatgtaatagtagtaaaaaagaaacaaaaagaggattactggtagttttcatccttagaagttaggaaaaagatctgaaaaaaaagttatgaaataaaggtttgttctagtttttttttttgttttcttcagtttgcgcatatctctgctccatatgttctgatgcaatttgtgtcaatgcatgtactacccattagtacatgttccattgttccaaagcacacatattcttggacggttatagataaaaataatctctcttcaagtacaagttagcgaggacttttgtaggacaaaacctgcttggagatatgccacacgtgtggtaatcttgttcttataaatcttaaggtttgtgtacactctgtgctgctacctgtagtaattaaacatctataccagcatctctgggcgcttgtcgaggcggcccgaaaagcaggtaccaaaggagaaggcagaggtatgaggtatccgatgtgcagattatatatttgcggcgtttgctatctcggtctccgattcaaatgcagcgaatcacgggggacaccagagtccgcgtgcggcatgcaagcttgcgcccccagattgtgggcatcagattctattgctaaccagaagcctgcatatgtgtgctgctttcaatgaagagggacatctttttttgaccacaccccaccgacgtccagcttcatcagatcctgtgattctctctgagcaagaagaaaagaggagaaaatcagatcatgttatctcaagtctctgaaagaagaaaaagaagagagaatcggtgattcggtgcacaacgcgccccgagctttcctccgggtcatgatgctctttggtgttcaagggcttaacgatttgtaaatgttgttagggacaaaatcgaaagaattaactactataatttataaagttgataatcagatttaaaacagtatttaaaaatattatatatannnnnnnnnnnnnnnnnnnnnnnnnnnnnnnnnnnnnnnnnn

SEQ ID NO: 22446 - DNA, 2070 bp, Oryza sativa
tcaaatggctcagaaaactcacattggcatctgaagtccacagagtcaagttgtcacgcagaagctgcatgatcaaagtgctgtccttgtaggattcttcaccaaggctgtccagttctgatatggcctcatcaaacgcctacaagaaacatggattcattcaaatcatatgttccgtgttctgatttttaagtgaatgtcaaataaaatatgatcacactattacttaagaacagaaacaaccttcgcatcttatatagctaattctacttatttgaagcaactagaaatgtatcagcacttagaacgagttagtcacaagaattctatcagcacacagaaatggcataattctcacttctttaccgttccaagctccaaaacaaaggtacactactttaaccatttggtttaagattgtgaaggttcaacatgatgcaaagtctaaatggaacatgcgaaatttctgtcaaaattataacatgggtatatggcaaatgaaaattatatagacacaaattacaagaaggaacatcaggagaatcaagaaaataaaaatatcaaccatttgatcaacatcaccttgaaagtttacagtcaaaatgtaacatataagttatacatcattcataaactgtatctcgtcatgaaaatcagccaaaaaatgcatccaacaggtgccaagggatttgaatagtacgttttgggatttcagctacagaaacaacctgattgcagcttaagtttctagtataaattaatttatcattcatgcactcacaaagtagcatatatcttcagaatgagcaacatggatgccttttcgataaaaagaaatgcaagtacaacttccactagaaaaagtcagctttcatgcttatcaaaagcaaagaaaaaaagctccattcatccaccatgatatctccagtataccagtattccagtagaaagcaggtccttaatggtacaaaatcaatagtggataaatacttggcatgaaaatatatcatcaaagaaatgtacattgaagatgcatgatgcaactaacagaatagaaaattaaaggggaaaatgaaagtggatgtaaaagtagagtaagcagacctgcttcgcgaggttgcaggcacggtcaggggagttcaagatttcatagtagaacactgaaaagttgagtgcaagcccaagccttatggggtgggtcggagccaaatctgcgagagcaatgtcctgccaacacacgcaaaacaaaaaactaaattcaaaccacaagactaaccaattaaccattgcatccacatgtacaaaaaaaaaacatattatcacaaatccaacctgagcagccttgtatgcattcatggtgctctccgcagcctgcttcctctcgtcgccagacttaaactccgcaaggtaccttcacaaatcgtcaccaagagaaatcatacatccatcaagatgaaaaattttcacacctttaatcggtaccaaactcctaggcagcgccaagatccccaagaatatgaagaaaactagcattcaaccgctccattaacagacatcacatctaattctgactttttcaccgccaagaggaaatgttaacatcatatataaagaccacgacttaaacatagacctgtacagtaacaagggatctcatacacctatcaacccataaaaaaaactaccattagatcttaaatttggacctgcacaactcaaatcaaatcctaccgtacaaccttaattaacccagagaccaatcatataataaacaaaggaaaaaagaatatcctagaagttaatcacacccccaataactccctacatgttaccttcaccgacctaacaaatcctcctatctcgaattcttggtcgattcgccgcgcgcacatactagatcaaggccatcgaatcttacctgtggtagtcgcccttcatcttgaggtagaagaccttggactcggcggcgccggcggaggggacgaggtgggagtcgagcagggccaggatgccgtcgcagatgcgggcgagctcggcctcgatcttgcccctgtaggagcggatggtggc

SEQ ID NO: 22447 - DNA, 19609 bp, Oryza sativa
gtttttgctatctctctttttttaaaaaaaagataatattgtagttctggttagctggaagtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgataattataatttgtcagtttctcttgctgtaatttgtgttgtgagcaagtgttaattgttgtgaaatttgcgtgttgcgtgtgcagaggcgccgttgatgcggtacggcaagtactgcggcgtgtcgtacaccgggtgccccggcgaggccccctgagacgccctcgacgcctgctgcatgctccacgacgcatgtgtccaggccaccgacagtacgtatccacaccaggtttaaactaccaggtaaatgtttggtgtgctcgtttgtatcggggtgggcgaaatactgaaattttgaaaattttggttcgaaattatatgaatttttgaataaaatttgacaaattttgaacataatattatcaaattcaaaaataaaaataaaaatttcggccgaaataatatcgtatcaggggttccgatagaaccgaaattttgaaccctgaattccacaccaatctttttcacttatcattttgatcattttgaacatctacacattgggacaaattcaaatccaatataagattagagagagggagcttgtctcctcctttctccctcagcttcctattgtttctccctccctcttttcttctatcaacggtgatccaatagaatagagccggaaaactcgatcgagttctcctgcactcatgttggatccgcacctatcgacatacggtgtaggggtgaaaacggtcacggaaattcccgatcgaccgggcgccgtttccgtttaaggggtaccgtttctaaccgtatcgtttttgactattttttaattttgttttttctaatttcttttcgcatcgtattaatatcgatactaagtagtttaaatgataaatatggtcaattaccggctgatcgagcatcgtttcagaagagatgctaccgattccgaccgtttccgatcgttttcacaccctaatacggtgtacactgataacgggatgtgtctgtcgaaattaatgcatgtgtgcagatgactacctcaacatgctgtgcaaccagagcctgctggactgcgtggcggcggtgaggtcgccggcggcgaggatcaggacgttcgaggggaaccagtgcaacgtgacggacgtcgccgacgagatcacgtcgctcgtcgaggccgccgtcttcgccaagaggatcctgcataggccgtagctttaattagctagcttgtagccgccacatgtaattaattgttgtttttgctaattaagctgctactgtgcatgttgtctggcatcatagatcgatgcacattgattaattaattccagtcgtccccggatgctacaaaaatcgaagctagagagtacacgtaagtgtagttggagttggtgatctccctacacgtgtctagtttgcgtaagcaaggcttttttgttttctcttctttttttttttgtcatatcctcgatcgtcaacttgttcatgcacatcaatctcagatgtgctcgcagttagcacgtgcgtccgaatcatgattctgctcggaattcatttttgtgaaggcccatgagaacggtatttacaagctagtatattttcaaataaaccttttgtctttcgtgtttacaccaagctagcttgcgtgtaaacaagcgtagcatagcaccatgcgtacgtttgattcgaaaaagaagccaaaagtaaaaatggttaattaaatccatataattatagatttgctcgttttgaaaaaataatattactagtcatctatttgaaataatgccatatattacaatcttatatatattcaagatatatcccctcttgcgaagtgagtatacctcaactgattaggttattgtggtgaaaccagcccactcaagtttaaatcagtcgcacctaacggtgcttgtgctagatccgtcaagcccagggcaagttggtcatgctcaacagtaacaccgttgctgctagatcctcaagaacatgcctcgttggttggattattgcgtggtcgtggaatcgttgtcgattgccagcagtgggagatagagaggagagaggggcatggaagaaataagaataaggtaatttcattaaaaaaatttttgataaacacatcaaaaggataataagtagtgacatataactaataggtgtgaaatcatgacgaaatggctccaaatagataaagaataataatatattttttttaaatgtaggaaacttataatgacacttctccaatgaatgtaggaaattttatgttctccatccttggaacaatgtaatagtcaaatgtaatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatcaaactctttaaaccaaaactacatcgaatcaagcattaaattaccataattgtatattaatttattccatccactcctaaggaatactacttcctccatcccttaaaaaaccaacctaggataagatggaatgtttcccatctgaagttagcttttttttttttgacgaagtattgactagtagaaaattataacccattggactatgcaagtcaaaatcaaatcagaatccattggatttctataaatcaaagatcaaatcatacatggttacaagtattaactactgcaataacattcatatcaaaacttcactttgtagcatcaatgcgaaggcattcaaatccaagtcaaaaattaataggggtgtataaccccctgaaaacagtggtagaggtaggaggacgaccagtagcctcgtctcctccaacagttcctttttttatataatcctctaattaattagataattaacctaagcaatgatatattaagctttatctaagacttttaacaaagtattatccatcaaatccttctcaatcctagctccgcctccgcctaaaacgagaactatagcaacatctaaaaacactgtagcaagtactcgtactatagcatccttaataactgacaacgaaccctctgcaacttgcacgtctcagctctcaaccggacaacccccgatccatcaagtacaccgacgaatgcctacgtgcgcagcacggggaaacagtccggttgaacgtgcatgagtgcatcacctcgccccataggtagggcccgtttagttcctgaaaagaaaagtttttttttttgtcacatcggacgtttgaccggatgtcggaaggggttttcggacacgaataaaaaaactaatttcataactcgtatgaaaaccgtgagacgaatcttttaagcctaattaatccgtcattagcaaatgtgggttattgtagcacttatggctaatcatagactaattagactcaaaagattcgtctcacgatttcccctctaactgtgcaattagttttttaatttatctatatttaatactccatacatacgtccaaagattcgatgtgatatttttggcaaaaagtttttgggaaataaatagggccgtagtaggccgggtgaaaacagtcgtgaaaatttccgatcgaccgagagccgtttttaataggaggtaccgttctcaaccatatcatttttagctattgataaattttatgttttttaattttctttttcatcgtattaatattgatgtagattagtttaaatgatatatataatcaattaccaaccgatcaaacatcgttttcgaagagattgtaccgattccgaaccgttttcacccagccgcatcactgcatccgcagttcaccggccaaacccaaccggctgtgttcgttcagtggagttggtaacacattctctccacacgaaaaacagagcgacgtattttcttatgattaattaagtattattattttttaaaaaagataaattaatatgatttttaaagcaactaggaaggtagcccgcgcatatgcgcgggcatgtgcgtgaaatttactgtgaatgttcatgtgtgggtggtttctataaaaaatattcttttgctttatcataaactaaaaatgaacttatttaacatgctttgagcactggtagtttttaaattgtgaactaaaattactttaaaccgtgtagtttttaatttatgagtgggacatcgaaaaaattagtaattagctgttcaatatctgtgatattattttataatatcaaaaggaattggacagaaaaacaatcacaaaagtatgatttttcccctccctaccaagtctgcctcacattcacctccaacgctgccaccgcacccgcagccggtgaggtggctctctgggggcggggtatcgaggagggcccgtgcgcctaggcccatgggtccgtattgttcccaaactcgtcgccgctgcagcgcgaaggccatgccggcgccgatgctccgccacacaccgcagttaaggggagcacaacgtgggccaccgcctggttcatgttgagcagggcgccgcagagcacatgctattgcagtcggtctcgcagtggcgtgctgtgctaccgtaccctccgctgccgatgtcgtggcgtcgacggcgtcagagctatatgcgagccgcacatggcagaaaggggcaaaatcatactttcgcaattgtttctatctccttttcctttggataacaaaataatatcgtgggtatacaggcagcttattaccattttttgcagtgtcttgtggcagatatacattcttgtagtgtctcccagctaatcacacgtttttttaatgtcccgtagaaatttttgcctttattaagtggaggcctcaatatgcatgtgggtccataatgtaattttttgttagcaattaaatatagtcaatatgggtattaagttattgatttgacttaaaaaaaaaagttggctagacctaataggtggagatttgtttgtggtcttttctttgcccataaaaataattttaattttaattatcatagagataggaaaaacaaagaaaagtaaggaaaaatagagagggtttggatgttttctttattaaaaaaagagtgatctgatgacctaaaataatgtgttaatgtttaagtaaaaaaaaccgatggttggaatttttttttaatttaagtgagacaagtaacagcttagcaaaacgttcatgtactttaatgcccatagggatgagaggaagggaatatggtttgggatgatttttttttaaaaaaagatcgaataacgatgtaaaataatgtgtctattgatttaagtgaaaaccaatggatgaatgtttctctaatttaagagtgtcacacaatagtttagaaatgtttataagatgtttaaaggactttaatgcctatttgtgatttttttccataaagacaattttaattttaattgtgatagggatataaaaagagaaaggaacagaaggagcgtacaaattgatcagtatgtgcgtggtgcacgatatgcggacgtgggaggtttttgtttttaagatatatctaacgatctagatccaccgatttaaataaaaatcgaatgtaagatttttttttattttattagggttccatgtggcgacttgggattacttgtattttggggggtgtttttacgagcaatacttacgagaatgggagattaaaagaagggagttttttaaatagatataatctaccagttgaaaataacgggtatgtgaaaatcaagactacatgttttgcttttatcttagaatttataggaatttcttttatttattatagtgccacatgacggcttaatagtatttgtagaaagtttaattaacttttagtatataatagataatatatagattttatatacaagatatagtttaactgcatatatttatagagtactatattttatttttaaatagtagaaaatcctattttaaagcccatcgattttttttcaatgacactacgatgtatgctttttgtttctttactttatcgcttttatcgtataagtccgtacataggtttttcttgaacgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtattctggtggatctgtgtgtgaaggagttacagagagccggagagcaagagagttcaggctctagaacccctcttcctctttctctcctctatgagctcaggtattctccgagtcgtcccccctttctcttctccgtcctttacttcggtgggcaaggtcctccttttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcccttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctgcgctgcattaaatgcggcgtggcgcgctcgtccaacccgcaataaatgcggttaggtgggccccgctgtgcttacctaacccatacacgtggcgccaaaaccacagggggtcggggcgccccagccctcggggccgaaacgggagctgcccgacccctcggggagacagagggaggggaggccacgtcaccctcgggcccgacccccccgagggggtcaggccacgtgggtgaccgcggctacccaagcctctagtcacgataccctcggccccatgtcaccgacagtagcccccggcgttacgccagggcgattgccccttcgtgggaagcgctcgggcgtgacgccactccttaggcccagtgacaggtggggccggtccctacaggcgggtaggaacccagcggtcgcaagtcgcgcgcatcggcaagggaaaaccgaccgacaataatgagcggcctctttaagaccgctacatcactcaagcagcgcgcgaatcgggacgagccggttcgtttcgcctggagacgtgatgatggcgcttttcacgtttggcgtgcgtgtttaatgcgcgcacgatctgtcccatctcaactgctacggccgcacatctgcctcgtgcgccgcaaacgggcgagttgggttagtggaggcgtgggcgcgagaaacgagggggcgaggtagtgggcgcgggaaacgaggagccgggaatagcgttggcaagggtataaagacgccgaggaagagatttgtttccttcctctcgccattcttccccttgccttcgccacttgagctctaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccgacgccacactacctggggcggtccgtcttcttcctctctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctctggctgttccggtggttcttcaccgtacagccggtgtcgccgccgtcggtagttggtggctgctacttccagccgcgggggcaggtgctgcaccgctacattccctgcgtcctccgcaaaaagtgggacgactggaagagcgattggttctacacccccctcgccgacgaagcgcgcctccgacttccgagccagcccccggcgcaggcctccagctggcgggcgacggtagatctgggaaacggctacgacgccgttcttgaccgcctggcgggtctgcgatcccaggggcttacgggggccatggtgttcggcgactaccttcgtcgccggatcgcgccgctccaacggcgcgcccggggcgcctgggagtacaccgggcccgaggactccatgaggacccatcaggggcgcaagtgggactgggtccctgaagacttcaagatggtggtccaacgggtgctgaatctcagctccgtggaggcatccctcatcccccaaggtgtcctccccctctgctgcgattcagagcgcgccaacatcctgaccacatgcaggcggtcggggcgtcgggggagcgggctcctcgaggccacgatggcgcgggcgggagccgtaggggggaacaatctaccccgggagggggtcgtgcttctgggccccgcgacgggggcccggggggcagccgccttgccgacgcccgggggaagaggaagcaggagggtaccccttccccatctcctccccgagggggcggggcggtgcgtgccggcagcaggcgcccggagggtgccgtgctgtcacgtcctgataaattcatcccaaaataaaaattattttctaaaaggaataatagaattaattaaaattcgaaaagaaattggcaaacactaaaatgcgtacaagaaaaattcgaatgtggcccggggaatttttgttaaattctccttggtctaaaaggagccctcaaattttacttgaattttcagagcaccggaaataattattaagcaacaaaaacaattattagagtttattaaaaagaaaaacctaaaaataatctctctccccccctttaggccaagtctggcccaaagtcctcattctctcccctcggaccacggcagaagtctccctctcctccctctccttctctccctcctcctcttgggcccctcttccccttccggcccactccctcctcctccctctttctcccaggccgcctccccctcctctcctcctgggccggccgcccggcccaagccgcgcccaagccaggccgagccgagccggccgtgcacacgcgcaccgagcgtgcgctgaccgcgcgtccggccgcgtggggcccgcgcgtcaggcgggtcatcgtcctcctcccggccggctgtcctctctccctctcccgtaacccagcgccattcctccctcaaatccgcgcgattcaagcatgggattcccaaattgattagggggaattaaacccctttccctcctctctctttcccccttaattcccccttgaatggcgcccccaatcgccgggaacggacgcgccaagtccggccgccttcctttgccgccgaccgccattcccgtcgccgttccgccctctcccgtgctcggctcgcttccctccgctataaaatgcaaccccctcgctccgttctatcgttttagccccctcccgtgatctcccgtggtccctagccctctccccgccatcctcctctctctcccgtgccgccggccgcctccagccgcctctccctcctcaccggagcgtcgtccggtcgcgccgtcgcctcctccagcatcgcagctgcctccccttccccggcttgccctccgtttcccgcggagacccccggagctgcgttcccgccgtcgcccttccctttcctccgcgtcggccgccttcagccgcctctatctccctgcctgagcgccggtcgacgtcgccaccacctccctcggctccgcgacgccgccctcatccccggcatcacctcctcctcgcccgaatttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggtcacacctacaccacctacggcatcgcagcggcaaggtcgtcctcggcatcgtttcccctccatccaaacccctccggggtccatcagcgtcgtctccgatcgttctcgtcgtcgacgtcccatcggtcgcccggctcgtcgtctcgcggcgccgcctccgtcgtcggcatcgcagcggcgtggtccgcgccatcctcgactacgtgcagccgctgacggcagccctcatcgcctactcgccggccccggacgatgtcgacgtagacgtcctctcgtcgcttccggtcgacgtggcgttcagccctccgacaggccgctctcgtacgtctagtgcgcgtccgacaagtgtgccgctgcagccccgtcatcgtcttcgtcctcggctccgcgtcgtcaagcctcgtgccggccgagtctcgccttcgtccaaggatggctgccgaagccgtcccctcgccgttcgtcttcgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccggtacccgtgtaccggtgtcggtagtcgttcgcttgtacgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagaccttattattgctattgttattattaccttgttcaccctaggaaaacaaaaccccaactagtgggtactctattcatggttccactagtatgaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggtcgtaggtggggttgggtcggtactcttgtttatggctaggatgggttgggaactatgtcacgtcttccgtccgtataccgtggtggtatgtggcacgtggttacacgtgaggaaaatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtctttacaaaatagctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatagagccgtaggcccgttagtccgctgctgtttattttttattgtcaggccttaagtgcctttgtaataatgtaaatattatcgatataataaagatgtgccttttgtaccatatttgtgtggtgtaccccggcttttcctgggacggggattaatacactagcgttcgggaaaatgtatttttctcggtcgcgacaagctggtatcagagccatctcgactgtaggataagccaagtggataaaacctaaggacatattttataaatgaaactatttgcgaaagcccctttttcctcctttcccctgtgctatttgcaaaatatttactccttccttcttcaaatttcaactagtactagatggttagttttgcgaagaagaagatgtcgccaattgtttgccgaagctccggaagactgcaggatctgctagcgaagtggaggaagcagtgaagatcttggagaacccgtcgcagaacctaagccaccctctagggtagaatcgttagttgtgtgtttccttgcttgtgtgtgtagcgcgtggtttgcatcagtgggttgtgatgtaaccgcgctaggttgtttgcttaatcaacttgcagaataagcaaaacaaacaacacatcaacaaaaagagttagttcctttaaggtcttgcccctagttctggtctattctttccttatatgctccccctctcaacctctaccttgtgacagatggataacactggtaacaaaggctatgggaatgatggatccgatgactcaagaacccaagccaatgggaatgagaaaagcatcaacgaaacctcatcagtgctaatccaaattgtggttaaccaaaccaacatgttggcaacagcctttcaactattacagaattggaacaacccagcaggggcaaccaacgttcaagtacctacagtccagcaacaatgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctgggacgagttttcatctgtattcaagagatcacatgttcccgtaggaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgccaacgtcccagtatttccatgtggtaaccaaagacagcgcactgagccacttcagatcaccggagcttctgttgcgcatcaagagttcctaccccaagaagatggacacattgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgacactgagaaagactccaatggtgatagcaactatggtaccactgatgccaatattagcaaggatttccaaccaccaattccaactccaagtcagaatgatcgttcctagatggacaactcagtaaagaagacattgatttgttacaactgcaaagaactaggtcatttctccagagattgtccacagccgaagcgtaacctgcgtcatcactctggccattatgcaagaagaagacaagtcactcgccttgtggtcactggagcaaacgccatacctttgaggcctcgtgtcaatcataacccatagtagaaacaatgtaccgatgttaagcatcttccctttttgtttaaggtagtgccttgtattcatgtaataagggagaaatgtgtaatacagacaagtcctattaggattcttttggaagatgtggatatgggattatgtgtgtaattgtttactgacaaaggagaaatagggtctcatttcagaggaactatattctaaccttgagttaataaccaacctgatgatggaaaagaaaatcaagcgattaaccaaagagacatttgtttggactaggagtttcagatgtgtcttattcggatcaaaggcaacgacagtcagcacagcttttgacgaactacttcaaggtttcaccgaaaggcagtaggccaaaggacctcatcgccaccagaagtgtccgctacccaccttaaagagtaccacctgttagagatagcccgaaagatgattgatcaaagagattggcaaagatgttctctagcaggaaaagaagtaggccgaaaggtgattgataaaggataaatagaaacatgctttgcatcgctcgaggaagacctctgatcaccctgcaacagtcaccttgacattgaggaaaaaaaaaatttatgagtaagcaagatgacctaggtaaaagtgtttctatgaaagcaaggagtgaaatcttcaactcggtatcagatgctacacggagtgaaaagtgcaggcaccggttaccaggcaatgccatgtcttggaagatgatccaatgggaaggaactcatcaaggtcgaaggtgtaaaggaagacgttgaatgctaaaagatgacaacatgaagagaatagtggaaagtaaactgaacataaagaaagtgaatccgagttgtttgttcgtgagagctattcccagttatgaaccaagtgatatgttcgaagataatctacagatgttagattaaaatcacatctaacaacgaagcttcagatttggcaggatcacgatcagaccataactagtccaacagtaaagccatttgggaagacgtcaaagcacgtcaagtgggataagttggttctgttgagaaacataattcaaaggcaaagttatcgacccttgcatcaaatagcagaagtagctagcacccggagaccaggaaagctaatatgaggcagttggtggcaagttagaagtaaatgacaaacatggtatcctagtaatgacaagctagtgttgacgcatgacatgaattggtaacttgtatgaggttgactccaaagatatgagttataagaagttctggaactgaagccccatccttcaatgccgcagcccagtcgaagtcagctagaggtgcaaccagggaaaagtcaggtgaagagaagattccatctgcaacaggagatcgagccaagcggtccagagtggagaagttgtgctaggcaagtttgttatagaagacggagcggaagaagtcaggcaagaagagaagaccacccaacctatcttcttgctagcctcctcgaatctcggggacgagattcttgtaagggggtggatttgtcacgtcctgataaattcatcccgaaataaaaatcattttctaaaaggaataatagaattaattaaaattcgaaaagaatttggcaaacattaaaatacgtacaagaaaaattcaaatgtggcccggagaatttttgttaaattctccttggtctaaaaggagccctcaaattttagtggaattttcagagcacatataataattgttaagaaataaacaaagttaaaatgattttataaaaagaaaaactctaaaaagtcccctttccctccctctccctcttgggccggctcggcccatctccctccccctctctcctctcccccgcggcccatccggcctctccccgcgcgcgcgccgctgacgggcgggcccgcccgccaccctcgctgacgggtggggcccacccgtcatccccttcctcccgccgctcccgccgcctcgcccgcgccctagcgccgccgccgccgagaatcccgccggcttcccgccgtccccgcgcgcaataaagtggggggaattattccccgggatcccctccccctttccccccatttttccctctctctctccctcggattcgtttggaaacccctcccctaaccttgccggcgccattaatggcggccgggtctcccgcgcccactttcccctc

SEQ ID NO: 22448 - DNA, 2535 bp, Oryza sativa
  unsure (1)..(2535): unsure at all n locations
cagcgggccgctgagctcgaggcgcgggcgaagaagctggacgcgagagcgcatagcggcgggggggccgcgggcgacggcgacctagccgcccgcctcgcagccgccgaacacaccatcgccaagctgcagggcgcgctggactcgtccgccggggaggtcgaggccctccgcctggcgggcgaggtagggcccggcatgcttcgggacgccgtctcccatctagaccgcgccgggcggcaagcgggcctctgggcgggcggaccgcgaaatacgccgccaaccaggggggcctcgcccagcgcctctcagagatggccgggaccctccagcggctccccgaggagctcgaggagacgatcaagtcatcctcgagggaccttgcccgaggggcggtggagctcgtactggcaagctaccaggccaaggaccctgacttctccccgtgggcagcgctggaagagttccctccaggaaccgaggacagcgcacgcgcgcaggtccgggacgccgccgaccacatcgtccacaacttcgagggtacgtgtcacgtcctgataaattcatcccgaaataaaaatcattttctaaaaggaataatagaattaattaaaattcgaaaagaatttggcaaacattaaaatacgtacaagaaaaattcaaatgtgacccggagaatttttgttaaattctccttggtctaaaaggagccctcaaattttagtggaattttcagagcacaaataataattgttaagaaataaacaaagttaaaatgattttataaaaagaaaaactctaaaaagtcccctttccctccctctccctcttgggccggctcggcccatctccctccccctctctcctctcccccgcggcccatccggcctctccccgcgcgcgcgccgctgacgggcgggcccgcccgccaccctcgctgacgggtggggcccacccgtcatcccctttctcccgccgatcccgccgactcgcccgcgccctatcgccgccgccgccgcgaatcccgccgcctcccgccgtccccgcgcgcaataaagaggggggaattattccccgggatcccctccccctttccccccattttttcctctctctctccctcggattcgtttggaaacccctcccctaacctcgccggcggcattaatggcggccgggtctcccgcgcccacttctccctcctccggccgccctctctcactcccaaccctatataaaccctccccgagctcccgaccaccgtttccgccactcaccgccctctctccccgctggaatatagctcgcgccgtcgctctctctctccgccgtcgccgtcgagctccggtccgccgccgtcgtcgccccggaccacctcccacctcggcgccgcctccttcggcttcgccgcatcctcgccgacctcgtccacccctccgtttcgctcgccgaccgccggaacgccgtcgaccccgtccacccgagccgcgccgccgccttcctccgctccggtcgccgtttccgtcgtcgccgtcgacccgaggtgagccgtggaccgccgcttcctttccccctttccttcccctctctcggcctccgctccgccgtgcctatggccgccgccggcgaccataggggcgcgggcgcgccgcctcccgccgctacgccggcgtggccgcctccgggcgtgcctagcagctgccgtgtggggcccggccgtcagccgcccgcgccctcgggtgcggctgacgcgtgggacccacggcgccggccggtgtgagccgggtgcacccggtccaccgtggaccgtgagactgccgcgtgggccccactcccatggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagggtaaaagccttttctttttcgttggtcgtgtagacgctgcagcatcggaagatccgcccttcgtggaagttgaagccgacgtttgggaaagcgagcaaggcaagtcacatcatccttgagcatattgaatcccagtttataaaattattttgatttaaattaatgcattaccgctttatttacattcccgcgttatcactgttttatttagccatgcctatttacctttgttaagacattattattgctattgttattattaccttgttcaccctagaataaacaaaaccccaactggtgggtactctattcatggttccactagtatgaatataggtagatgcttcgctgattaatagggcaacattaggtggttttttataaaaatagactttgggaatattcatatcatctggacacnnnnnnnnnnnnnnnnnnnnnnnnnnnnnnnnnnnnnnnnnnnnnn

SEQ ID NO: 22449 - DNA, 674 bp, Oryza sativa
atagggcaacattaggtggttttttataactttagactttgggaatattcatatcatctggacactatggaatggttggcttatgttggaattggacatacccctctcttcctctttcaaagcccctaaaacctgtttttcggtggggtttgggtgcatgccagttgtgggaagtagcaccccggccaatataaggattaagctcgggcctctgttggaaagcactaccgtacttccacatgtctagtgggtaaggcttagtttgtggctcagtctggttataaacaaaagtacacggatggagatggacgaagtcgggggtcgatggacatctttagggcaaatgaaggctacacgagctgcggcccggtagtcgagatgtcatggcacagggccggtgtcctgctgctgggggctcagtcctgcctacctgtcccgggggttccgcccgtaggtggggttgggtcggtactcttgtttatggctaggatgggttgggaactatgtcacgtcttccgttcgtataccatggtgatatgtggcacgtggttacacgtgaggaagatgtgtcttgtgggtaaaaatgtacacctctgatcagagtataatctattcgaatagccgcgccctcggttatgggcacccccagcaatgtacccaagttagtgttttaa

SEQ ID NO: 22450 - DNA, 895 bp, Oryza sativa
  unsure (1)..(895): unsure at all n locations
nnnnnnnnnnnnnnnnnnnnnnnnnnnnnnnnnnnnnnnnnnnnnnnnnnnnnnnnnnnnnttcactatatcgatttagggcttttgatcggaggtcaccgaaatcccgaaatttcgaaaatttcggtctaaaattttgaacaaaatttagttgaatttgaacaaatattaccaaatttatgaaaagattgaaaaattgaaaaattttgacagaagtaatatcatatcggaggggaccgaaatttccgaaattcctgcggcgcagtagctaccgtcgacggagacggactagctggcagtggacgcagtggtgccgggtgcgggcgtcgctgtcctgcgaggaccgcccggacatcgcccggacatttgctgcgcttcagctccacgcgcgccgggccgagatcaccacgctctttggccacgcctggagcgtgctcctcatcatcgccgacgagcagcagcgcaacgtacgacgacgtccaggcctcgtccatgccatcttcttcgctggatgcatgattggtcagtgctgtaattctcgtgcaaaataccttcgtttcctacagaaaattccatcgtgttaactcagacaaagtgacaaactaccgcaatgccatgatagtaggattatgataacaaccatgccttaggccttgtttctttcagcttgggattattataattagtttattataatctggagtccaacatattataatctgataagctcatttaggtaagctttttccagattattggatgaaaaattacccaccatgccaccccactccttttttagacatgcaaacccaataatctaggctctaataatctagaaaagaaacaactaaccacttattctaatacagattataacaatctagtttatagtaat

SEQ ID NO: 22451 - DNA, 993 bp, Oryza sativa
ccttaatacctttaaaactttgctatgtggagttaccatcatttatattagaaaatatgagaccttcttaaattttaataccttctaaaaatgataaaattgcccaattaattaaatgtaggtcatttcgtccagattttattatattatgatgataccttataaaccataccaaaaccaccttccctgagcctatttcgctcgtcgaagttatttgttgctgtctgcaaagttcggagatcaagactgaagtcatcttgattaaatgaccctgttgaataaaaataagtacatgacagcagtcagcagcccaggatatatatgcctgatcagatcggctgattttacagcctccagtttatcagccctaaaataataataaatgtggtggggagtgcaatattacgtacttagcttgttgcgatccatgtgtgttaatagtctcttcatcacaaattataataactatattttttatatatttttatcggtattcaatgacatactatgatcattaatgtattccatattatgttcccaacaaatatgaaattagtatcatatgaaagtactttaaaatataaatatagtgatataacatatatatatatatatatatatatatatatatatataatacttagcatatactacctccatctcaaaatgtaacaatgtccagattcatagctaaaaatacttatattttgggacgaaagggagtatgattagtctaattattagacaaaagttaccgagtttgatttttcttaaaaagatgtcgccctatgatttgggatggaggacgtacatcttactttgatcgaatcaattaattaattaattgactgatccattctaaagtaaatacaatcactcacaacctggaaaaagaaatgcagaggcaagaggagttacatggcattagtggcccttttgctggtctcctccagatgtgaatgacaaaaactgcaattgctaatatagcaacag

SEQ ID NO: 22452 - DNA, 731 bp, Oryza sativa
  unsure (1)..(731): unsure at all n locations
nnnnnnnnnnnnnnnnnnnnnnnnnnnnnnnnnnnnnntcgccattattccccttgccttcgccgcttgcgctctaactcctcgtttcctgtgccctaccctcgccgcactcgctcgctctcaagctcctccgccggcgtcatggcacggggctccgcaccgctcgacggtagcgtgctgccgccttctcgcatcgtgagcgagaggcaggccgggctgccgcgccgattcatgccggaatctaccaccggccgggaggtggtcgcgctgggtgagggacgcccggcgccacactacccggggcggtccgtcttcttcctctctttcgcaatggtagggctggtcctgccattctcttctttcttcatggatgttttggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgttactttcagccgcgggggccggtgctgaaccgctacattccctgcgttcttcacaagaagtgggacgactggaagagcgactggttctacacccccctcgccgacgaagtgcgccttcgactttcgagccaagccccggcgcaggccttcagctggcgggcgccggtagatctgggagacggcta

SEQ ID NO: 22453 - DNA, 11541 bp, Oryza sativa
ccgcctgacgggtctgcgatcccaggggctcccgggggccatggtgtacggcgactactttcgtcgccggatcgcgccgctccagcggcgcgccaggggcgcctggaagtacaccaagtccgaggactacatgaggacccaccagggggtcaaatgggactgggtccctgaagacttcaagatggtgatccaacgggtgctgaatctcagctccgtggaggcatccctcatcccccaaggtgtcctccccctctgcagtgatccagagcgcgccaacatcctgatcatcatgcaggcggtcggggcgtcgggggagcaggcccctcgaggccacgatggcgcgggcgggagccgcaggggggaacaatctaccccgggagggggtcatgcttctgggccccgcgacgggggtccagggggcagccgccctgccgacgcccggggaaagaggaagcaggagggtacctcttccccatctcctccccaagggggcggggcggtacgtgccagcagcaggcgcccagagggtaccgcgccgacgtcgcagcccgagggggagcgaaagaagaagcggctccgcaagatgggggggaccgaaccatgccggggaaacctcatctcccccccaaggtggtcgtttagcctacctcctcgcaggttcgtccccgcgcccactgcggccgtattcattctcccatctcccaaggcaagttttcactcacccgttttttgtcttctggtttttcttctgcctcagcgagatcccgtcgcgcccccaccccccccccccccgccattccaagtccggccggtctgaggccggggagacggcgaccgcggaggccaggaggcgggaagctgaccagcgagaagccgcggaccgccttcgggaagccgaggaagctgcccaggaggccgtccgggctcgccaggctgaggaagccgctcgggaggaggccagactccgccgggccgaggagtccgtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacatccccgagtccggcacgtcgatcggcgggccgagccgtgcggcaccctcaccgaggcggctctcccccatgccttccgctaccccaccgagcgcggagcccctcctgcaggccttggccgccgcgaacaccacggtgttggacgggttaagtgcccagatggaggtcctgcaggcggagcgggcggagctcgacgcggcgtgggcgcgcgtcgaaaaggggcgacgctcggtggaggccatggtggaggcgggccgcaaggcacaccgccggcacacctcagagctcgaggcccgtcgtagggacctggcggaggtcgccagggaggtggaggaggagcgggagactgccctcatcgccaccgccgtgttcaacgcggcgcgggacgacctctgcctccaatacgggagccgggcggcggagctagagaagaagctcgacgccgcccggggagtccttgatgctgccgttgcccgggaacggcgggcggcggagatcaaggcggcgtcccggcagcgcgaagaggcccttgaggctcgcgccacggtgctggaggagcgcgcccgcgcgaaggagagggacctggcggaccgcgaggccgccgtcgccatccgggaggcaacactggcggcgcacgaggccgcctgcgccgaagaggagtccgcactccgcctccgtgaggacgcgctcaccaagcgggagcgagctctcgaggaggctgaggccgcggcgcagcggctggcggacagcctgtccctccgcgaggcaacgcgggaggagcaggcgcgccgcaatctggaaggcgcccgcgccgagagggccgcactggatcagcgggccgctgagctcgaggcgcaggcaaaggagctggacgcgagggcgcgcagcggcggggcagccgcgggcgacagcgacctagtcgcccgcctcgcagctgccgagcacaccatcgccaagctgcagggcgcgctggactcgtccgccggggaggtcgaggccctccgtttggcaggcaagggagggcccggcatgcttcgggacgccgtctcccgtctagaccgcgccgggcggcaggcgggcctctggggcgggcggaccgcgaaatacgccgccaaccaggggggcctcgcccagcgcctctcagagatggccaggaccctccagcggctccccgaggagctcgaggagacgatcaagtcatcctcgagagaccttgcccggggggcagtggagctcgtactggcaagctaccaggccagggaccccgacttctccccgtgggcagcgctggacgagttccctcccggaaccgagaaaggcgcgcgcgcgcaggtccgggacgccgccgaccacatcgtccacagcttcgagggtacggcccctcggctcgcgttcgccctcgactccgacgaggaggttggtgacggtggtgcggacgacagcgacgacgaggcttgcgacccgggcgcgtcgaagtgagcccccaggcccccgccaatcttaaatagctttttcttcttcttccgaggccttcgggcccccttcttgtatagactaatttaatctgcaatcaaataaagaggaaatttttgtgtcaatttcatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagtcaagattcttcaaaaggaaacaatggcacagacacagtccttaggaaatcgaaaatgcttttattgaaatatggaagagaaaaaagataagtatatgcatgtggtagcccccggccaaccctgcacgcccgggggggtgcggggttggcccgagcccgagacctgacacccgacccccactaggggtagaagcgacgaaggtgttcgatgttccacgggttaggcagctctgtgccgtcgcccatggccagccgaacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggacctcagggtgagctcagatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaacggccacgaaagaggtatggtctgcaaggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcggaggccgttcaggcgcgtccgtctcccctagggggtcgggtcgcgccgacggctgggcaagcctttcttcaaaggcgcccggtgggatctgggctcgcgaggaagcgagccttgagagttcgtcggcgaccgcgttatcccgtctaggcacgtgccgaagctctatcccgtcgaaatggcgctccatacgccgcacctggcgcacgtaagcgtccatctgcgggtcagagcaccggtactccttacagacctggttaacgaccagctgggagacgcctaacaccaggaggcggcggatccccagtccagctgccaccctgagtcccgcaaggagtccctcgtactccgccatattattggtcgcccgaaagtcgaggcgaaccaggtatctgaggacgtctccgttcagcgaggtcaacgtgacccccgcaccggcgccctgaagagatagggagccgtcgaactgcatcacccagtaggcggtgtgaggcagctgcgaggggcccgagctggcctcgaggacggagacgggctcgggagctggggtccactctgccacaaagtcggcgagggcctggctcttgatcgcgtggcgtggttcaaagtgcaaatcgaactcagagagtttgattgcccatttcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacaaagtagatgggccgctgcacctttcggcggggccgatcctcttcgccaggggccgcatctccagggcgctcttcatccgagaggccacgcggggcgcactcggcttctgtgccgacaacctcggggtcagagggcgacaggcgcggccttcccgcagtggccccggggccatcctgggggtcgggggcgcctggcaccgtcggacaagcaggcggagggccagctccggccgtcgggggcctcgggccaccattcggctcgggggcctctcctccctgctctctcccgggtcgagtcgacacagggtggggatgcgcggagtgagggttgtcctcgttgcgctccacgaccaacgccacgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagcgccttctctcccagcctcgatatgaaccgacttagggcggccatgcagccagtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgcaagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggctacctgcttgaccgggacctcgtcgcacgtgatcatccgctgcctcggggcggctgggacggaggtgctgagcctctcgtcgccacccgcggacttggacgccgcggcgaggtggtccgcgcgctgctccatacaagcaagcgcgactttgaggtcgccatggacagtgatggggccaccggggcccgacatcttcatctggagataggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgatgatcggctgggacggccggagcaccatccccggagccttgatggcatcaaaggctgcgggggaaaggatgttgagggctgcacccccgtctatgaggacacgccccaacttcacattgcaaacggtgggggaaaccaccatcgcgatctgtcctccccgggcaatgcacggcaggtggtcggtctggtcgaaagtgggggtaacctccgaccaccgcgcccaccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggccttgccctcacggcgctcctgcctcctctcctcctcccacttcctcgtccgctcagccaaacttttgaccgcgcggcagtccgcgaggtcgtggagggaggtgttgtgcacagaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccaacctcttcttcctcctcctgtcccgccgccctgaccgagcggcggacccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgagcggggatgcatggtatggtgttgcggacttgacagaaccgctgaatgtatgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcactgccaaccggggacacgggggggctggcccccgtgcccggaccgaagtggcgctccggacgaggaagcgtcctccgttgcgtgggcagcacgacgaccattacgccggcgctcgatattgaggcgggcatccggccccccacgcacatcttcttgggtcggaggcgttgacgagggaatggcggacgaacggcgggtaacggccgccgctcgccgcgccctccgccttgacgacgcggagccggcggtagcagcgccagaggccttggtggcggaggaccgcccgccggtgcctaggcgctgctgcgccgtcatgaccaagtcggccacgtcatccagccaacgtcgggctggagtctctggatcggggacgacaggcgggtgacgcaggagcgcgcccgcagcctggagcgcgccctggggcgtgctgccatcgccatagacgaggagacgacgctccccgtctcgctgtccttctccatcgcccgtgggcggcgaagtcgcggatctttcgaccccctcgagcacctcctcccgcccaagacatcggcgagagggggacggtggagtacgagctcgacgacgcgggttctgctccccgtcgtcaccgctagcgctcggagagaggttgtgcgccactgcccgttcgaccattgggctgagtgggagaagcttggcgcacacgaaagaggatgagggcttagaaagacacacgcgccccctacctggcgcgccagatgacggagcatggggctcctcaccgggagaccgcgcaggcccccctttgccggttcggccgggggcgctaagtgaggttcttagcccttggtatgtggaatgttcgcgagagagcaaatgcacaagacacgggcgatgtagacaggttcgggccgctgagaagcgtaataccctactcctgtgttctgatggatctgtgtgtgaaggagttacaaagagccggagagcaagagagttcaaactctcgaacccctctcttctggttctggcctcccatcctcggtgggcaaggtcctccttttatatctcaaggggataccacatgcaccacttctacctactctttttttgggtggggacccaccctatcttgaccaaaacttggctcgcatcttcgcctaaaagctaaatgatagcttgtccttgagtgaggcccagcgccgtcactcgcccgacacaggggatcaccctgtcattccttcattaatgggcagagatttgcaatggccactgtccgaatgaccctccgatgggatgggtcatacctacctccactccgccggaagcagatgcaacgtgggagcacggttgcctgccgatgacgtgaccggcgtgagaccagtcacagaccggtcattcttgtccaccacgcgtcagtttagcatgccgcacgtctgcccttcttcatacaatgacttccttgtaatggttgcgatgaagcctggtatgaatctagccgggactgacgtgctaactccaggagttagcacaccggctccggctagggacgagtgcctagaggctctcatcattccgacgggacggggcgaggcgtgtgacaggccgcctgttgccacctaacccgcgatctgaccggtctgtgaccggtcacacactgcgaccggtcacggaccggataagcgtgcgctgcgctgcattaaatgcggcgtggcgcgctcgtccatcccgcaataaatgcggttaggtgagtgccgctgtgctcacctaacccacacacgtggcgccaataccacagggggtcggggcgccccagccctcggggccgaaacgggagcagcccgacccctcggggagacagagggaggggaggccacgtcaccctcgggcccgacccccccccccccccccgagggggtcaggccacatggttgaccgcggctgcccaagcctctagtcacgatactctcggtcccatgtcaccgacaatgtggtatccattaccatggtagtagcccccgacttcaactcaaatgaatccacgttttatccgttagcgttgtcatgctcacttggtcgttcttgacaacaattgagaagacgtgtagtactcaatatcattgaaaaaaattaacggtccacaagtgaatttgaattgaagtctacacaactaccataaacgggcctgaaatcaacgcaaatgaacgagttgatgttctcgaccgaaaaccttggaataacaatgtcgttctcgcttgatcattctcggacgagcgagaatgtacggagtatatgactaagtcttatgtcttaccgtaatcgagaatttgggttgaactcaagaattttcatctcggcgggtacaccatcggttcattccgtagtctttgtcgaactccaccaaccgttctcgagtaatcgagtagtcgtccaaccgttctcgagtaatcgagtagttgtccaaccgttctcgagtaatcaattacttatagaatctacgacaaagccctgaaatatgactttcctgaaatcaatacttagaacagattgttagatacaaatagttcccgagcgaacgctcaagggtaacacaatataatataaatttaaaaattgaaaataaattgaatttgcacatgccaataaaagaactgagaatttgctcaaagtttaccagtctgagaatttgttgagcagtgatgcacatgaactgagctataatgaacttggaccaaattgctccttaggtttgcacaagccaatctcttttcttttgaaattccctgtcgaccttctttgtacgcaagaaatttcatactaaaaaccatcatgaaaattcatgttttagaatagcaattttttgttgcaaaatttcctctttattctataattttagttagttattaggatcaccttcttccttttgataacttcaatattttggatttactatccctattgcttacttggcaggtaacagttcagtggttccgaatcatgacgg

SEQ ID NO: 22454 - DNA, 1760 bp, Oryza sativa
  unsure (1)..(1760): unsure at all n locations
nnnnnnnnnnnnnnnnnnnnnnnnnnnnnnnnnnnnnnnnnnnnnnnnnnnnnnnnnnnnnnnnnaaagaaattcgccatgaccctgtcgtcacccccggcggcctcgatcccagtcatgtagatctggagaaactcggcggggttgacgcttccgtcgtatttttcggtgatgggggccgaaccttgggggccaacggacgttccgaaggctcgccacaaaggctcgacagccggcaccgccaaccggggacacggggggctggcccctgtgcccgaaccgaagtggcgctccggacgaggaagcgccctccgttgcgtgggcagcacgacgaccattgcgccggcgctcgatactaaggcgggcatccggccccccacgcacatcttcttgggtcggaggcgttgacgagggaatggcggacgaacggcgggtaacggccgccgctcgccgcgccctccgcctcgacgacacggagccggcggtagcagcgccagaggccttggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgctgccatcgccgtagacgaggaggcgacgttccccgtctcgccgtccttctccatcacccgcgggcggcgaagtcgcggatctttcgacctcctcgagcgcctcctcccgcccaagacttcggcgagagggggacggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaagacacacgcgccccctacctggcgcgccagatgacggagcgtggggctcctcaccgggagaccgcgcaggtccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaggctctagaacccctcttcctctttctctcctctatgagctcaggtattctccgagtcgtcccccctttctcttttttttctctccgtcctttacttcggtgggcaaggtcctccttttatatctcaaggggataccacatgcaccacttctacctactcttcttttgggtggggactcaccctatcttgacccaaacttggctcgcaccttcgcctggaagctaaatcacagcttgtccttgagtgaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcctttcttcatacaatgacttccttgctatggttgcgatgaagcctggaacg

SEQ ID NO: 22455 - DNA, 3059 bp, Oryza sativa
ggtggcccgacccctcggggagacagagggaggggtggccacatcatcctcgggcccgacccccccgagggggtcaggccacgtgggtgaccgcggctacccaaacctctagtcacgataccctcggccccatgtcaccgacaggaggaaaagtattacttttaaaataatacatctaatctaatggtctaaaataccgggttcaccaatttaagtgaaaatcgacggtgagattaaacagtgccatggcgatctaggagtatttataggagcgccaagtggcggcttaagagcgtttgtaggaaggttaatggacttttagtatataactaggaaggaagcccgcgcaaatgcgcggccaacttatttataaaagattgctaaaagaagtcatacttcaccatattaattataagaaacgtttatttattatttataaaaataatgctaaagaaatcctatctcaccatattaattaattataaggaccatagatcacctataattatataaaaataaatgtctagacacaacaaaaagatcatctctacttcataccaaattgttcatgtctcgcttgtgtttaaatatatgcataaatattttgaaatattactcctaccaattcatgggataaaaccattaaatttgatctaaatgcccctctaatgggtgaagtcgactgtagccacgaaggctttcttctcttatactttgaaacatgtgtcccgtatcgacatagttgttctcctcaagattagtgtggagcacaattttaatacctaattcactatcagttaaagaatcacatcggtaagtaagccatttgaactttattgcgaatagtagcctctcactgggtcacctcaacttagtcatatgcatacccccaccatacgtatagtagtgtagcaaactatgttatcaatgcttggtgcccttcagggaatgacacatagataagatgaaagtgatacattttttttaaaagttttgagtccatttatggaatagagttgacatttgtttatggtgttaattggtctactaaattttagtggtacagatataattttctcttctgaaaataagcagagttgatcattcgatactacttcaaataatctaatagcttcaatggtgagaaacacgtggaaaaatatctgcttgagtagtaataattcatgaacatacgaggtaatatgagttttgatatttttcttttcttcgtattattgatctaattcatctatgcatgttcgtggggtaatatatgatggaacaatatatgttatcaagtttatttgtgctaattgttaatgctatgtataataatatgaaaagtgatagaatgtggttccatgtaatatttttcattcaaaagatagttaacatatttataatttttctatagaaaaagtgggttgtaaatgaatataatatccacaatcagttattaaaaaacatggagtaattgttgagattatttggataagaaagatataaaaattggctagaatattgttccatatgataactttttaatcagaatttgctatatatatgtcacaaattttactttgggccatattttattatgaatgttttattttagactaccctttaaccaatattttcattttggactgggtaagcatatcaacgatctcagatacgttggctcctaataataaattaactgtcacaaatataagatataagatatagcctagtcaacaacgaccctaggaaataaactggagagatcgaaaggagccacagcagagggtagactgatcatgtataaactttctaatttaagggttagaaggacatggttaatattttttttatgtacgtacatattcatgttttttttttgcaaataatagtctcctgtacatgcatataaacatacgtatattttctccgggagaatagtatatatttatttttctctcttgcaaatacgcatgagattaggagagagaaattaattactttagtatgatctaatctaatgattgaaaataatagttcacctgtatatgcgtaaatcaatggttcaatgtttaacttttatttttttcagaatattttggatttttattgatcttaagttatcagttactcccaatctaaattaaattgtgaccatttaactcaccatgtttatgttgaattgctagctataaaataggccaatagggtgttgagagaaaaggagatatatgtgggctgcacgtacgtatctgaagattttagatttttttttgacatggtacgtgacagagtatgtacaaaaggggagagagggttacgtgtgggaggagggaggtggatgtggaaagattttttttaaactaatctgacggcttgaaataatgggtccaccaatttaagtgaaaacggatggacagatgttttgcttttttcttagaatttctaggaatttctctaatttattagaacgccatatgacgacttagaagcgtttataggagaccacgtggcggcttgagagcgtttataagaagtttaatggacttttagtatataatagatagaagatatttgtatataaatattttttaaaaaatacaccgtttagcagtttgaaaaagcgtgtgtgcgaaaaaacgagtgaggtgactcggccggggggttagaggcgcacggcacaccccgcgacaccgtcacgtgcccacgcgcgcggccacggccgacacacacagccagatccatcgcctcgccgccgtgcctccgcgagccgcgtcctcacccgcacgcaatcaccgcgaaaacgcccaaaaaccccagcaaaaacacccaaaacaacaaccaaccccgcaccccgcgcagcagcacaagtccacaaccgcttccgctttccgctgcctccgctatactacaaaagagagagacgcctttggccttttccgctttaaaacaccacacagtgacacacacaccgcgagcgcgccgctcgcgagtagagtgggagttcggttcggcgaggcgagaccggccatggcggcatcggagaccgcgccgttcgg

SEQ ID NO: 22456 - DNA, 942 bp, Oryza sativa
tgtgaagtatatatgatcatcaaaactatagttggattcgaatgaaatcttcagttcaaagcaaaaacaaataaaaataaataaacttcagttgcttcttgttattgagagtgggaaacatgactgttgcattgccaatgcttttgattctgatctcatttcagagacttgtttgatcagaattgtcggtgagtcggtgctcattagaaaataaggcattgtttagcaggggaaatttttcggatatacggtcacacatttacaatattaaatatagtctaataacaaaacaaattacagatttcgtcaaaaaattacgagacaaattttttaagcctaattaatccatcattagtaaatgtttactgtagcaccacattgttaaattatgatgcaattaggcttaaaagattcgtctcgcaatttacacgcaatcatgtgtaattagtttttttctatatttaatattccgtccaaacatttaatatgatagtgtaaaaatttttgttttgtgaactaaacagggctaaactgtttctaatgcctccagcttcggatcacgggagcttccagaagaattactacaaaacacctccagcttcgagaagaattactacaaaacacccgatcccggatcaagccacaaattgctctgctgacaaaagattaaagatcaatcgaattgcagatctcgagatgcttaacatttatttcaaatattgcaatggtttttaaacttaaaacagccagtcagtttaggctttacggagtatgtggctgaactgagaagatgttgtagtgcagtgctgtactgacaaggtgcttaaagaaatactagtgtgttttaaggtttggagctctgaactgacagcatgctgtactgcctaagacaacatgctgtactgacgagtgacttcaagaaatgaaattaacattttttta

SEQ ID NO: 22457 - DNA, 5631 bp, Oryza sativa
  unsure (1)..(5631): unsure at all n locations
tttaatatgatagtgtaaaaatttttgttttgtgaactaaacagggctaaactgtttctaatgcctccagcttcggatcacgggagcttccagaagaattactacaaaacacctccagcttcgagaagaattactacaaaacacccgatcccggatcaagccacaaattgctctgctgacaaaagattaaagatcaatcgaattgcagatctcgagatgcttaacatttatttcaaatattgcaatggtttttaaacttaaaacagccagtcagtttaggctttacggagtatgtggctgaactgagaagatgttgtagtgcagtgctgtactgacaaggtgcttaaagaaatactagtgtgttttaaggtttggagctctgaactgacagcatgctgtactgcctaagacaacatgctgtactgacgagtgacttcaagaaatgaaattaacatttttttaggaacaaattgcgctgtttggcgtaaaatccgtactaccaaaatccagcgaaattccggttttccagaaaaggccacgaccgtgtgtttagtgtcctgacactgacaatcctgtagttagaggaacaaaaccctccaattctccagttgcaattttcttgccgacaaaatgtgagagatattattgtatactaatactagtacttgcattagttaaccaatgttgatggagggtttaatctaatgaaatgatcggttctttttttaagttttaagggcactgaaccgacaacagtggctgatcaagttgacgtcctaggggaatgaggcacgtccatttatttacctggaagctggagaaacgctgtcataggaagcctaatcttgatcggatccaggccaatcctcgagagagaattgacttgggacctgtagcaatttggcgacgatcccgatggggattggtctccaaagtgagacctctgggatggtggccaaatggtgaacgaattaaattttttcttgaacgaataccaaatgctgaatgagtttacacaagtcgaccaagagggctccaaattaagattggtgatctttcacaaagaaaaatcttttgcttcttcgtgtgtttgtatcgagagtctcactatgcattcgatcaagttgtgctatccacataagactgactgaagccgtataaccataaattaatcaaagggtagaggttcaaatcatggtaaccattgattaaacttagtcatatgcgtgttggacgattggatcgtgtacatagcaatctttatgtcgttggcaggccgctagcgaatgaaaatgtattgtcgctccagaatgagccacatcatgaaaaatatataaactgttggattgatatggtgaatgaagctggcacagtggcacataggattgaaagtgaagggaggaatggttgcatgaaaagaaaaaaaaaaaggatgaatcaagaaggttcacgtgccttcggctggaagttcagctgctagaagaaaaaaaaaagcactcatcaagaatgtaatttcatataatgtgtttttatttaacaaaaaataagataaaatgcaatttataatactaagtcgtacaatattatatacattaacaaattacttcataaaagtaagttaacttcagttgttatcatgaagatcatgcaactcaaggattaaaagatcgtctgagtgagcacaggagggagcatttgacatggttctggcttttgggttgcagaatttccagagggctgtacacatgcatattgtaggaattaaaaagaaaagtaagaacaatgacaacattaaatcatgcctttgctcaaaataacacatatggtcatttcaatgacacaaagggttctactatgccactgcctacaaaatcatccttgcaagtatatcttacaatagcaaactgtttaaaattttctgttattgattagcatttctattttttgcacaaactaatactcaaattctaaacattatagataagatttcatccacaccattaataacaggatggttatagtcatcataaactagtataacttattgtctttcacatacagtggtctttttattcttgccaggagacactataaggctcgggagggaagtgcatacggcatgttttttttttctaccgcatgtatgtcgttaatgatcggatggccatccattctcgatgcattcattcgatggccattatttttaacactacgtggcccaatgtgctttcgagaaagattgtttctttcattactttagatatagaaagtacgtacaataaagttttaaggcaaaattgtatttatagtaacaaaagttttcgtttttggctttatagcattgaaagttcatcattcactttattagcatctaaaatctctttccgttgccctatcgagcaattccgtcaatttcatcatgtcaggcgtcctgcggcggtggatcgaaagttcactatttagtttattggtcatcttttaccctttttatgagaagatcaacaagagctagacaaagagcacagatcaaagtcctcaccgaccagggcaggccacatctgaattgtcccggcctaggaattgtaaggggacggccactgggcctggtgctgggccggaacagcggcctgcttcatgggggaggtggtgggccggccttggttgtttgcgtaggtggtgttgccctagccacctccgttgtttccgccggagccatcggagttgctgtggccacagccgtggtttcgcgagttgtttttgccggagacggagccgttggtcgagttctggggaacgccaccagaaccgttgttgctgctagcgggacgagaggcgccgctgacggtgtctgcgacgaacacggaagcagtttctgccggttgagagcccttcatgatatcttcaagcgggagctgagagcgtgcatccatgaacgatgggaatggtttctacatggacaaaagtgaatgcatgttgccaaaacggggactaagcccggtgattagctggagaacgagtgcaccatcggagacgggtttgccgaggtcgctaagcgtgtcagccatggacttgaggcaacgacagtagtcggtgacggagagctcgccttgagagaagttgcggaactcggcgttgacattgatggtgcaacattcttggttgccgaggaattgatgggcgagatcacaccaaacagagcgagccgtagccgtggccaacatgacttcctgaagcaagtcggcggagatcgtgccttatagctagccgaggacgacgcagtccatctgtgcccaatccacgtggttgaggtgagagttgtcagcgaggacgtgatccgtgagcgcgtacttgccgaagacgacgaggaagagaccgcaccagccctttgacgttgaggacaatgacagcttgagcgtggagggcaacagcttcatcatcgaattagggtgtgatgtgcactagggttcccgatctttcaaaaggttatgataaacaacgatttggacggagtcgcgacacaaatcgatccagcttcttgaacgcgcaccacgtctcctctggttatcacctgtgccgattatattacgattatactataattatatctgtcaaatatttaggagaaaatttgtcgaaaaatatataggtgataccgaaactaaatactacttccgatcagagccataccaatgccacgacacgaaaaattcctgcatacggagttctactatccaaagctacgacgtacatcgacttgggcagcgacacgtgtcgtttcgtttgcccacggaaaataaaatcgaaaacaaaaggacagaaacaagaaaactacatcgattttttaattattttttccacgcacctaaacgaattaacgacgtagcagatgcttcgccgcgcgtgcacacgtgtcgtcgtcggcggccgccggcgagcccccatggcctcctccctcctctcctccgccgcctccggcctccctcccaagccgcagccaccttcctccacccctccctcctccgcctccgcgcggccgcggggcttccgtcgcttcatgctcgcccgcgccgccgcgggccgcgacccggagccgccgccgctgcccgaggggaccgagaagaggtcgctcgcggtgaggacgggggaggtgttcctggggctggcggcgctgctggtgcgcgcggggaggggcgggggggcggcggtggaggaggtggaggcgaaggacggggtggtgtgggagcagcggcccgaggacgtggaggcggagcggcggcggcgggagctgaccggccccgggttcagcttctccgccgccgggctgctcttcccctaccacatcggcgtcgcgcagtgcctcatcgacaggggctacctcacggtgcgcgtccaccccccatctctcttacctcttctacgcgaacgcgtacttgatttttgcagtaggagacaggagcttctgctcagatgaattgtgagatccgtgtgcctacgatagtggagattgtttctctctcgagatgaaattgtggccaacaacaatccaatttacgtttgtctgcttagctattggggcttgtttctttgagatgaaattatggctaacaacaatccaattcacattggtctctttagccaatgagcgggttactttcgagatgaaattgtggctaacaacagtcgaatttccgtgttggtctctttagcttagtaggagtagtaggagtagcttgttggtgccatggctggctagagctctcaatttttatgctactgtactgtctaggtggtaacattgcctgctatttttatgcatggaaattctgcattcctatgcttgtgattttaggacttacgtgtgatacattttgtatgtatgctgctgcttttttttttagcaagttttcttatagtggtttctttatctgggacttacattaggaaagaactccgttagctggttcatcagctggtgccataatctgtgcagtgattgcatctgggaacacgatgcgagatgctttgcaagtgaccaaggatctagctgataactgtcggagcaatgggacagcctttcgccttggggtaagttttctgtttccatttattgtttacttttaattatacttgcggccaacatgtgagtttgcttcctgtgtaaattatacccaactatatgtgtgatagatcattggtttatttatgaccaatttgccaactatgtttcaactttgcaataccttggtgtttagactgtaataattcgagaaaactgtgatgagtaacctggtgtatcctttaaaaaatacgctgaaggcgacagacatatatggcactcaagtcactaaatagttcatgtgctggctgattgaatgatatgtttttaaccttgtaatcttgtgcacttgagcaggctgtactcaaggatgttctagacaggtttctcccagatgatgtgcacattaggtgcaacggaaggatccgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22458 - DNA, 732 bp, Oryza sativa
  unsure (1)..(732): unsure at all n locations
nnnnnnnnnnnnnnnnnnnnnnnnnnnnnnnnnnnnnnnnnnnnnnnnnnnnnnnagcaaaccttgctgtccacagcctccaaagaccactagccatgagccattcagccatgagagagtgtgcccccaccggccgggtggagaagctgaaactttgacacggcgccattcaggctttgcagattccaggttgagcacaaaggtatcatccattggctgcatgttgactccttcacctccaaacaggacaaggcgattaccaacagcacaggcactgaagttgcaacgggaaggctcaacacgacctccaactgtaaacttcctccatgaagctgcctcaagggttgtaagctctcttgcaagacgaccccatcctaacatcttggtgctcatctcaagcctcacagtgacgtctctttcccacgcgttttgacataccatctttctcaggtgatcattcttggtcaactcatgcattctagtgcagactgatccgatggatgcaacatctcttggcgataagcgagacaatatgttgtgcgccagaacttcatctgagagctggaggatgcagcagtactcggaactttgaatcttaggaatatgttcatgagaagcagggttgatctcttgaatgttgggtctgtggttggactgttgtttatacactggatatgatacattgctaagatcaatgttagctttagagaacaactggatttcaatgacgtg

SEQ ID NO: 22459 - DNA, 989 bp, Oryza sativa
  unsure (1)..(989): unsure at all n locations
nnnnnnnnnnnnnnnnnnnnnnnnnnnnnnnnnnnnnnnnnnnnnnnnnnnnnnntaggatcgtgtttacaaaatagctttgggcaactaagtgacttttaaatgttgtttactgcaaaacttaacccctattattatccccttgtacccccttgcattaatcatgcatctgccggtgtgacttgctgagtactgtggttgtactcatccttgctcaatctttcccccccttcagtaagagaagctttggagaagaagtcttaggtggagtcctggcttataccccagttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacgtgccgacatcgcagcccgagggggagcgagagaagaaacggctccgcaagatggggggaccgagccatgccgggggaacctcatctcgcccccgaggtggtcgtttagccgacctcctcgcaggttcgtccccgagcacaccgcggccgtattcattctcccatctcccaaggcgagtttccactcacccgcttctttttgtcttctggtttttcttctgcctcagcgagatcccgtcgcgccccccccccccccccccggcattccaagtccggccggtctgaggccgaggagaccgcgaccgcggaggcccggaggcgggaagctgaccgacgagaagccgcggaccgccttcgggaagccgaggaagctgcccaggaggccgtccgggttcgccaggctgaggaagcccgctcgggaggaggccagactccgccgggccgaggagttcgtccgggaggcggaggcggcgcacgcacgccagg

SEQ ID NO: 22460 - DNA, 1089 bp, Oryza sativa
ggacttcaggatggtggtccaacgggtgctgaatctcagctccgtggaggcatccctcatcccccaaggagtcctccccctctgctgcgatccagagcgcgccaacatcctgaccatcatgctggcggtcggggcgtcgggggagcgggccctccgaggccacgatggcgcgggcgggagccgcaggggggaacaatctaccccgggagggggtcgtgcttctgggccccgcgacgggggcccggggggcagctgccctgccgacgcccgggggaagaggaagcaggagtgtaccccttccccatctcctccctgagggggcggggcggtgcgtgccagcagcaggcgcccggagggtgccgtgccgacgtcgcagcccgagggggagcgaaagaagaaacggctccgcaagatgggggggaccgagccatgccgggggaacctcatctcgcccccgaggtggtcgtttagccgacctcctcgcaggttcgtccctgcacccaccgcggccgtattcattctcccatctcccaaggcgagttttcactcacccgtttctttttgtcttctggttttttttttctgcctcagcgagatcccgtcgcgccccctccgccattcccagtccggccggtctgaggccgaggagacggcgaccgcagaggcccggaggcgggaagctgaccggcgagaagccgcggaccgcctccgggaagccgaggaagccgcccaggaggccgtccaggttcgccaggctgaggaagccgctcgggaggaggccagactccgccgggccgaggagtcagtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacgcccccgagtccggcacgtcgatcggcgggccgagccgtgcggcacccttaccgaggcggccctccccttggccttccggtaccccaccgagcgcggagcccctcctgcaggcctt

SEQ ID NO: 22461 - DNA, 670 bp, Oryza sativa
  unsure (1)..(670): unsure at all n locations
ccgttcaaccattgggctgagtgggaaaagcttggcgcacacgaaagagaatgagggcttagaaagacacacgggccccttacttggcgcgccagatgacgaagcatggggctcctcaccgggagaccgcgcaggcccccctttgccggttcggccgggggcgctaagtgaggttcttagcccttggtatgtggaatgttcgcgagagagcaaatgcacaagacacggcggatgtagacaggttcgggccgctgagaagcgtaataccctactcctgtgttctgatggatctgtgtgtgaaggagttacaaaaagccggagagcaagagagttcaaactctcgaacccctctcttctggttctggcctcccatcctcggtgggcaaggtcctccttttatatctcaaggggataccacatgcaccacttctacctactcttcttttgggtggggacccaccctatcttgaccaaaacttggctcgcatcttcgcctaaaagcaaaatcatagcttgtccttgagtgaggcccagcgccgtcactcgcctgacacaggggatcaccctgtcattccttcattaatgggtggagatttgcaatggccactgtccgaatgaccctccgatannnnnnnnnnnnnnnnnnnnnnnnnnnnnnnnnnnnnnnnnn

SEQ ID NO: 22462 - DNA, 905 bp, Oryza sativa
ccacgcatagatcagattgtcgactccaccgcggggtgcgaccttttgtgttttttagatgcatactctggttatcatcagattcgcatggctagggaggatgaggaaaaaattgcattcataacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcatcaccggctgcatggctaccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtagtcagcgcggcgttggtcgtggagcgcgatgaggacaaccctcactccgcgcatccccaccctgtgtcgactcgacccgggagagagcatggaggagaggcccccgagccgaacggcgggccgaggcccccgacggtcagagctggccctttgcccccttgtccgacggggccaggcgcccccgaacccccggatgg

SEQ ID NO: 22463 - DNA, 719 bp, Oryza sativa
cccaaaaatgaattccgagcagaatcatgattcggacgcacgtgctaactgcgagcacatctgagattgatgtgcatgaacaagttgacgatcgaggatatgacaaaaaaaaaaagaagagaaaacaaaaaagccttgcttacgcaaactagacacgtgtagggagatcaccaactccaactacacttacgtgtactctctagcttcgatttttgtagcatccggagacgactggaattaattaatcaatgtgcatcgatctatgatgccagacaacatgcacagtagcagcttaattagcaaaaacaacaattaattacatgtggcggctacaagctagctaattaaagctacggcctatgcaggatcctcttggcgaagacggcggtctcgacgagcgacgtgatctcgtcggcgacgtccgtcacgttggactggttcccctcgaacgttctgatacttggcggcggggacctcaccggcggcacgcagttcaacaagctctggttgcacagcatgttgaggtagtcatctgcacacatgcattaatttcgacagacacatcccgttatcagtgtacaccgtattagggtgtgaaaacgatcggaaacggtcggaatcggttgcatctattttgaaacgatgctcgatcagccggaaattgaccatatttatcaataaaactacttagtatcgatattaatacgatgcgaaaagaa

SEQ ID NO: 22464 - DNA, 721 bp, Oryza sativa
catgaacttaccaacgcgggccttcccaggaccgggttgtagggcagactgaggtccgccacatcgaagttcacccgctccgtgcggaagttggcggatccaccgaaggtgaccgggaggttgatatgacctagcggccaagtgtgccccggcgtcacaccgatgatcggctgggacggccggagcaccatccccggagccttgatggcgtcaaaggccgcgggggaaaggatgttgagggctgcacccccgtctatgaggacacgccccaacttcacattgcaaacggtgggggaaaccaccatcgcgatctgtcctccccgggcaatgcacggcgggtggtcggtctggtcgatggtgagggcaacctacgaccaccgcgcccgccgcgtcgcctcatgggtaggggccgcggccagaagctctcgcttcatggccttgaggctccggcgagaagtgtgagcgcacgctcccccatcgacggtggcgatggtggcctcaggctcctggaaccccaggtcatcgtcgccatcatcgatgtcatcggcgggggccttctgcttggcctcacctcgccggttgccggcgggagccgccggggccttgccctcacggcgctcctgcctcctctcctcctcccacttcctcgtccgctcagccaaacttttgaccgcgcggcagtccgcgaggtcgtggagggaggtgttgtgcacagaacacc

SEQ ID NO: 22465 - DNA, 704 bp, Oryza sativa
  unsure (1)..(704): unsure at all n locations
nnnnnnnnnnnnnnnnnnnnnnnnnnnnnnnnnnnnnnaaaagcattttcgatttcctaaggactgtgtctgtgccattgtttccttttgaagaatcttggcttgaattagcacgctcgtgctcgatcctgccctcggtggcccgggccggctaaaatcgccaaaaggggcccagaaccgagccgtgccccggggcgtagtgaactccgggggggaatcggcaaaggcccacaatcgggtcatccataaccctcggtcaccacgctcccggcctggccagtctcgacacgtggatctccccaggcactagccccgacccgcgccatttgaggctgagacctgggcacgagcccttgttcaagccaagacacagaaggaccgcggcacagaccatcctcgtctcatgcacacaacaaacagaattgacgcagaaatttcctctttatttgattgcagattaaattagtctatacaagaagggggcccgaaggcctcggaagaagaaggaaaagctattaagattggagggggcctgggggctcactccgacgcgcccgggtcgccagcctcgtcgtcgttgtcgtccgcaccgtcgtcaccggcctcctcgtcggagtcgagggcgaacgcgagccgaggggccgtaccctcgaagctgtggacgatgtggtcggcggccttccagacctgcgcgcgcgcgccgt

SEQ ID NO: 22466 - DNA, 7982 bp, Oryza sativa
  unsure (1)..(7982): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagccttttcagccttcatattgtccaaaaccctcttataatctcttgggaataccttgacaaattttggaagaagagtatcaaaattagagagtatatctctagcaacaacactcccagtgttaagtcgatgttgttctatcatcattttcaatgtggtaatgtcttcctcttcctccacatgatagagatcaactaactcatggttacagcggacgctgaatttcccatcaatatcataaacataagcaatgcctccactcatcccagcagcaaagtttcttcctgttttaccaaggataaccacagtaccccctgtcatgtactcacacccatgatcaccaattccttcaaccacagcttgagcacctgaattgcgcacgcaaaacctttctgcagccattccattgaaatatgcctctcctatagtagcaccatatagagccacattaccaattacaatattgtcttctggaataaatgtactatctcttggtgggtagacaacaatttttccgccagacaatcctttgccaacataatcattgctgtctccttcaagctcaagggtgattccaggacagagaaaagcgccaagactttgaccagcacttccagtgagcttcacatgaatcgtacctgcaggtaatcccttcatgtgataacgctttgtgacttcatgactaagcatagtgcctactgctcggttagtattctggattggagtctcaatgaaaacacgaacttccttctcaagtgcagcttttgataaagctatgagtttgttatctaatgccatgtcaagaccatgatcttgcttttcaacacagtactgagcagccccagggcgaatctctgcagctggtttcaaaatcaatgagagatcaatgttctcaagtttctcgttgctcttcactacttctggatcaacctcaagcatgtcagagcgcccaaccatttcagtaatggtacggaagccaagctgagacatgatttctcttagctcctcagcaagcatgaagaagaagttgataacatgctctggttctccagcaaacttttctcgtagcactggatcttgagtagctataccaacagggcaagtgttggtatgacatttccgcatcatgatgcaaccaagtgtgatcaacggagcagtactgaaaccaaattcttctgcgccaagtaagcaagcaacagctacatctttgccagtttttaactgcccgtcagtttgcagaatagctcggccacgaagcccatttgccactagagtttgatgtgtctcagccaatccaagttcccatggaaggccagcatttttaatacctgtccacctagaagctcccgtccctccatcatggccagatataaggacatggtctgcatgtccttttacaacaccactagcaacaactcctacaccagcctcagaaactagcttgacgcttatgcgagctctaggatttgaattctgaagagtacaagcaacaagaatgtcaccatatatcaggaagcaacatttgcaaattgcatgcatgtgttcaagttcaattgtaaaatgttgcatggcaaatgagcgatcatgagttggtatgatatctcagaaataaatctagtactaacaactatacaaaaataacaacaaatcgcttggtttcaagaaatagcaatgcagtatcacattaagttaccttaaggtcgtggataagttgtgcaagatcctcaatagaatatatgtcatggtgaggaggtgggctaatcagtcctacaccagcagtagagtgtcttgtaaccgcaatgtcaccaataaccttgtggcctggaagctcaccaccttcaccaggcttagcaccctacatacataaagaagttataccaaaaggtaaatttctgcaacatggtaggtgctttcaatagactgctgcaatcattttaatgattttgtagtgcacaatgttgacaagtacctgagccatttttatctgcagttcatcagcgttagtcagataatagcttgaaactccaaatcttccactggcaacttgcttgattgcacttctttttggattcattgaaccattagcaagtggttccatacgagaaggctgttcccctccctcaccttcacagatgtattagagttagtgcataatggtttagaggttatggattctactcaaaatagcaaaagggtaaaaggagatattttagacctgggaataaaagtaatattaagttctagaaatatgttaaacaagaaagaaacagttaaataaaataaaacacaaaaaataaagtctcaaatagtgcaatatgcttcttgcaggaaagaattttctgtatagcaaggaaaaaactcaatcccactaaaaatagtgatattttgtcttcagaaggcactctccacaccaacagaagattttttaaaaaaaatagcaaggtaccgtataagtttctttgagtgaaatgcagtaaatacctttttgtttgatagaatcaaaataagttcatttgtaagtacaagtatgtctaaaatagtggctcagaacagaaggcttgttttgaaaggtaattccataaagtgttcttactgcagattgtgcaaatggtagcaacaaagggacaaatgctacatagtatttcagtgtacctgtattagatttccctccaagtttgttcatggccatagcaagggcagtatgtgcttccaaagaaatggatccataactcattgcaccagtaacaaagcgtttaacgatctcacttgcaggttcaacctcgtccacagaaatcatgtcagcagtgtctttaaatttaagcataccacgcaggttgcaggttttgttgagctcctgaatacgcctagaatattctttgtatgctgcccggctgtttactctagcagcttcttgtagttttgccattgcaaggggatcattgaggtggacttcaccatttttcctccagtggtagtcccctggattgggaagggcctttgcatctgcacttcctggtggaggtgctcttgatggaaatgccaactcatgaagacgtagagcatctcgtgcaagcatttcaaaagtggcgccttcaattcggctaggtgtaccatcaaaacacttacggatgacttcagaggaaaggccaagagcttcaaaaatctgtgcacctttgtaagatgcaagggtggaaattcccatctttgcaagaactttcatcattccatagttagaagcatagaaatatttcttgacaagttcttcctttgagtagggtttcccatcaccattaggaggaatcttcccatcattctgcaagcaccaaattgcttcgatagccaaataagggcatacagcatcagcaccaaacccaacaagggtgcagaagtggtgcacttcacgaggttcagcagactccaccaacaaacctacgcgcgtcctctcaagattggccacaagatgctgatgtaccgcgccaactgctaagagcgaactgacagcaacacggtctgaggaaaatcctgcatcaagaatttaaacaaaacagtaagtttcatgcgagaaaggtcaaatgttgaagaatgtcgtagacacggaaatgcataaggtaaacgaatgttataactttgttgataataacagcgctacacctacttaattgataatattcgacctattatattccaaaattatatgcttggagctacatttaaataaaaataaatttgttgaatgcgtttgactaccgcaggaatgattacaaaattatgagtaatgagtaatgaaacatcagtagtatatattgaatatttcactgacctctatctgagagaactaaaacagtgtagcccttctttatagctccccgagcttctgtgcaaattctgtccaaagtttcttccaagcccttccttccagacttctttggataagttatgtcgagcaccttgcttcgccaaccacggtagttcatcttcttaatagcctccatttcatcaatcgacaccaaaggaccctcaagtgcaaggcggttgcattgcttttcagttgtttccaacaagtcaccttctggcccaatcatacactccatagatgtaacaattttctccctaattgggtcgattggcgggtttgtaacttgtgcaaacatctgtttgaagtactcaaaagtcaacttctctctgtttgacatgactgccaagggtgtgtcatttcccatggatccaagagcttcaactccatctttagccatcgggagaagcagcatttcaagggcttcaactgtgtatctgcagtaaaaataaatttgataaataaaccaaaaaggaactcaaaacagcaaagatagtcaacaaagtcgaaaccttgcttacccaaaggcttttagtgagtcacaatcccattgacgcctgcatgttcctttttctcattcttttgctacaccaaagtgtaaaaaaaaagataagtaattatagtgtaaccaaattctcataaataccagctaaaattgtagccagtgaaaaaataaaataaaatgttaaaacactgtaacagacttactgtgagtgaaccagaaattccaggagcaactctctcagtttctggcacagattctacaatgtctttgaggtatattttttgtctcttgagccactccccatatgggtgagctttcgagtactgtgccttcaatgcttcatcatccactacagtatggttctcaaaatcaaccaacagcatcattccagggtttagtctaccctttctcaatacatctttggaaggaacatcaacaacaccaacttcacttcccatgactacacgtccactgtgtgtcacataaaatcgaccaggcctcaacccattgcgatccagggtggctccaaggtaacggccatcagtaactgcagatgaaagcaaagtaaccacaaatagtacatgggaaatgtgtgatcaggaaggaaaaggtcttccgtatcttcttacaagatattagagcaggtccatcccaaggctccataagggcagacaagaactcatagagagctttcttctcaggttccatgttcacatcgttctgccatgcctcaggtatcatcatcatcacagcttctggcaggcttcttccaccacggataagaagttcaagaacaccatcgaaagcacctagaattgaaatgattctatctaattaacaaatctctaaaaataaggaaaatcccattttctaagtgtacttgatgtttcactgcatgaaacaattagctcttacctgaatcagacgaggtagcatccacaattggtagaatttttgaaaactgatcctttgttaggccaagcttctcacactctaagagaccttctcgtgctttcatcctgccatgcatgcaaaagcagttataaaaccaagaatcataaacaaaaatggcatagccatgtggagatgattacatacaacctagaaatggacattgtatggagcattccaaaaaaaaaaagcaagattaccaattcttgttccctttgagggtattgatctctccattatgacctaatacacgcatcggctgtgcacggtcccagctggggaaggtgttcgtggagaaccttgagtgaacctgtttggatgcatgaaacttagtaactgtattatactcaactcttgtaattttacaatgttgaacaaaacttctaaatgaaacaccaacacactgaaaaaactgaagcatcagttgcatagaatttcatgcaaaacagttggaagccctaagctacctcaaaccaaacacaatttcttcccaccacctaattggaggtcacatccagaagagtcggcatagcagtcggccatagcagaactgcagctggactctgcaacatggttatcgggtatcaactaataaagatttctaatacttcacttaaaggcatcaagaaccaggactgaaatatcatatgaatagagcagtgatggtaagacaattcaaagtttgatgcctgcacaggagtcttgatcttacaactgccttgctattattggttcccatccgccgactatggtcatgactttttttgtataagaggatcaaggtattgtatttaccagagccatataacttgtgaagttttcatgacctagatctgcatagtagtaccccttaagttggcatggcttaagctggcccttgtagacaatagtcctggaaatcacaagaaagcaaacattgaattactcacatgaatagaacacaattagaaagttattacactacaggatccttaagagagagctcattgttttttctttctttagtcccatttgaaatagaaaatatttgctgatgatccccccccccaaaaaaaaaaaagaaatgtgaacttgattgggatttgggtatcatcatcgctttcatccttcaacgtaatcaaacacaggaaacatgaaatttggaaaatatttgctgatgatctcttccaaaaaatgaaatgtgtacttgattgggatttgggaatcatcatcctttccatccttcaactcaatcaaacatagagaacttgaaatatggaagaagagagaaaagaggaagaagtaccttgaggagagagaacacatgtagaagtccctctttcctccacgacggagattcagagctgcacggatagatagaatcgagagcctcctcaggatatacaactgtaataattcattacaaatgagttaaatacacagtctactacatacgcattcataaattcaaaatgtaaactcgtggaatgacctgctgctcaaaatcagcctccgaacttgaacttttggtgaggaaaacctgctcaataactggctcagtctggagcgcagattcacctaagtctgagttgtcagtgggaacccggcgccacccaagtattacatgtcccagcgattccgctacctggataaatgaaagtaacagaaaacattagtgtaaatatcacggccatgaattgaaaaaacaaaagaaatgaaaacaactaaccttctgaaactcagctttgctccgctcacggcgcttctcatcgattggcaggaagaccataccgacagcatactcgcctggctgcggtagctcaaacccagcatcctttgtcacctgcaggagtacaaacggtaacagctaagatgaattaactgttaaaacgagctgcctttgccttaaaattttattgagtttctagctcgcctctctgaaaaagttatgcggtagagccacaaggatgccggcaccatcgccagtgttcttctcacagccgcaggcaccacggtgcgccattctctcaagcatctcgagggcgtcattgacctgcagagaagtgaaatcagatcgatatcgcaaaggtgatgttcagaagagagaacctgcagagctaccacctaccgtcgcgcgcttgtaatcgcccgacagctcggcgacgaaaccaacgccgcacgagtcgcgctcgcgcgaggggtcgtacagcccaatgctgctctcggggagcgtcgaaagtggcctgaccggctcggcgtcgcgcgcggcggcgcggggcggccgtgcggcgacgcgctcctcggtgagctggcatccgccgaccaaaccgcctcgatggacacgc

SEQ ID NO: 22467 - DNA, 7191 bp, Oryza sativa
ccaccaccaaccacaacgcacaacccaaccaaacaaagccaaaccgaaccccaaaagccgagcaacttgttttttttttcttttttggaaaaccgtctcccgatcctgtcaagttgggaggacgacgatgaggaagggtgcgtgcggccgagcgggtacctctcgctcttgtagcccggaggtgagaccgacgccgacgccgcgtcccgatcctccccacaccttcgcctcgcggctctcgtccccgagcgcggtttgtgcttcccccttctctcccgcacgcacggcggccttctctaccggcgacgcggcggacggcgtggttggcgaatgaatggatcggttttggggacgaaacggggcgccgcctctctcgcgggtctcttcccgtttcctcctccgagttgagcggcgactagggcactcggcgcctctgcatttatagacaggggaggggggggcaggccaacccatcctctctcctctttcgtcgctcgcgtcgcgtccccacacccgcactatattttagccaccgttttttctcctccgaattcgcctctttttttttccctttgttttcttaacattcgttggttgtaggttgtgacggtatctgcatctctacgggagtattttcgtacgggtccccgacaagatcagaatttggggtccaaagcttaagcccattgtgctgtgctagctggagtacgattgtaagtacaatggaatgaaagaaacacaagattgacgacaaccctactgtaccatggatcagttattacttcaaacattttcttttgttgtctactggagtaataaattggataggagtacttcaaacatttttttgtttggttatatatgcacgtatgactagcaaaagaaaagagaacgtctacatgagaatggtatatcgtaattagttttgtggttcattttactcatggtatattcttactgcatatacactagtagtacaaagaaaaaattaaggagattatcttttacaagcaaggacctacgcgcaatacaacaatggcacggggaccccgacgaaagaatctttttgatcccgaattaaaaacaggaaagcagttgcaattttgcaatcttccgtttccgctgtttttgcaatctctgcccccgcgggccgcggcccccgctactgtccaccgagagaaagagagtgaaaaaaaaaaaacaccgcgagcacgggaccaccgccaggtcagccgcgaccgcgacctgtggtggtggccatggtgggcccaccccgctccgaggagcaaacgacagccgcccgtggcgcgtggggcccaggacgacgcccgatccgacggccagggttcggccggcgcgccgccgccgcgccgacgccgacgcggggagccacagccgattcggagataaccacgccgcgccgttagcttttttaactcgatctccttatctggtactcctacgtaattaaattaaatcaaattaaatctctaatgcgggatttggtttgtaacaaaattccaaaaatcgcgatggattttttgtgtttggcgagtcctacgtgtcgctatcacgtcgggcggccgcggcggaggcggagagagaggcgcgaggcggcgagcgggtgggggcgtgacagtgtgcagaaggcggacgggcccaggcgcagcgagggtagggccccgcgtgccagtctgccagacggcgaggcggtgaggtgctttctggggaaagcttcttctgcacgtgttcgtcgcccacgccaacgagggacggattcgatagatcctggattaaaatgctacacgcacaggtttaacttttaacggtagagaaggaatactattatcggtaaggattactcttatttctttttacattcttatccttgcaatacccttctttacctatatcaaaatttcatatattagaggactactccctccatctacttttgatagtcatatttccaaatctgaaaattttatttttgatagacatatttcaatccaacaacttatcatcttaatgactttcttggatttaatgcatgactcttcattcttctacacatgattggctacatgggcattgagaaatataaatattaatgaatcgcttgtttacgaggaatgactagtagcatatttaaatagatgataagtagaattacttatcattggcctgtgtgccaagatgaaatatgattatcaaaagtagatggagggagtagtacattagtattactttagtacaactgttacagtatgtgcagcaacttatattttgtaataaagggaatattaattagttgttttgtttctatactaatgtgttactgatattataataatcattttattttgagataaagaaactatatcagtatatcaatctttaattaacatgttttatataaaagacacgaacattagaaaaggacctaatatcaaataactagaaggtgtggggcttcgaacctaagtcatttagcacaccaccttgtgaagctagctggaagacccctgggtgtttctcattaacatgttttattatagtttgttattatcggtccatgttttatttaccgaggacatttttagttattttatatgaacaatatttatagctagtattgtcatgagaattatacacaccccaccacctaagttagaggtatttattgaactcaaactattaaacttgcccagccatcgtactccttctgtcccataaaaagttaaattctaaggatgaatctagacatatacaatatccatattcatcttaaagatttgttttctatgggagagggagtgtatatgataataaaactactactcgtagtcaatatgaccatgctatgtcatgcgatcagaacattatgttatagctagcatgctcatatccacttctaaaatggtgaaagtcaaatgatagttttccaccatcagcgtttgatggatcaagagaagttatagtatattcaaggtaaactagtgaatatggatgtgaagaccatataaataagttactagtgctagtaatatatttaacatcactggcctcgtcgccatggccaaaagaaatctgagaaaccaatcgttgaagtgttgcgcactgcatacctcatcaattaagattagaatcttgtccaccatccctattttagtggattacttctcgttcaaaattagcttatcctgacaagctgtaaaccaagattagcaccgctaaaagtaaaagatccaagtggaaagctgtcccaagttaaaaggacaacatattaatgcaagtgtggaaattggtgcatatatattctattgcaaaatactcctagtactccctccatatccctaatcatcttcattttttcgagccatcgaaaccagtactccctccatctacttttaatagtcatattttatctcggcacacagaccaaggataagtaattttacttatcatctatttaaacatgctactagtcattccttgtaaacaagcgatttattaatatttacatttctcaatgctcatatagtcaatcatgtgtagaagaatggagagtcatgcattaaattcgagaaagtcattaagatgataggttgttgaattgaaatatgcctatcaaaaataaaattttcagatttggaaatatgactatcaaaagtagacggagggagtactacttagtgttattcttcttttttttctgtattaataaaaaataaaagtagctttgtacaagataggactataggagtgtcttgcttaatttgccttttgctagtactcctatttttttaggactgtaggagtagttcccttgtctgtattttcatagaagtttaattttcgatgaatctgcttgaactgttgaacatgaatcccgttgctaacatccaaggtttccttgggagatgtatcacatggtcgtcgtatattagttgcatgactctttagagcaggtataatagtactgactcagccggcgatagtaatcaccacatcagcattatcatacgttgaggagggaaaaagcatgagagagagagaagcgagcgcttctccaagcaccagacgatagcacgataaattaggcaagataaaatattttattcgctttgtgggtctatagttcagttacttgatcttatgtgcatatgcatactgtgtggtttcaagtactaatttagtttcatgctgaagcaggacgggctacagagatggagtttagttttgatcacctgtacatgcaacaattaaacctattcttgtatccgtaaagaccatctagaaccaatcttttatataaacaatctacaatattaactttagatgacctagacatatactaccgccgactactactttcactattagccttgctcttatcagaccgtccaaaactttacactactgtatctgattggctcttgagctgtgacttgggggcgttggcaaggggaacatggcatggcatggacctcctgggcccacaaatagctgggtcccacgtagtaacgcggcagcttgctgcattgccacggatttgcacttccctgcagtcctccaccaccatggggcccatgccgacgcgacgcatgagcattttgggaaaaaagggcacatagttgaccacggaagcgatgcgcacagtggcaccgggagatgcgctcacacgtgacgccctcctgccttgtctgatccccttttcccttcttcctctcggtttcttcacgaggctctgtccatctgcctacaagcccaggcgccacgtccagatgcaaatatactcatgtcgtattaatcatttatttcttttacccaaactgaactacagttctaaccatcccttatttaattgaaatacatataggacctgttctgctatgtttagcagctgcgcagttgcagctagctaaaaaaaatactctagatgttggctgcaacacagtaaaaatgagtgcagtcgaatctatatagactatttgccctctctactaatttatgttttatgtgctaaaaatatactaaaagagtaaatgatttcaacgctatctaaaactaaccagagtagattggactgatgaaaaaatgaattcgaaagatggagtagggttggagccattccgcaactctccttgagacttcgctagttagattcaagtgtttgagttattggtggaaaatatttttcgttttactttgtgaagctctcgtcgaaattttcataggagtacgttttctcggggaactccaaacaaacggggctgaacacttgttcgacagatccaatgagcagtttgtagatttatttgtagggaggtgtcattactgattgagcattcccatgcttatcaagcaattctctaattcctcgggtatttccaaagtttgccgattttcaaggcgagtgctcagcctaggcttcacatggcatcgtggggcatcccgcatcccattagccaaatggagcggccatcaaactattttaactccacggtcggagtaacacatgttgcgtggcacgcttggtgaatactacgtccatctcgtatctaccacacgggttagaaaaatgtattgtaccggctcatgtctaacaagttaaaataagtaactctactcattctttttcaagtaaaattatgtgtaaaaagctctaacattggtcgctaattttagtaatacacttttatattttttttaactatcgtggtaaagaaaaaattacgaatacataaaacataataatacttccttacacacccacaattatttatatttttaaaatagagagagtatatgacatggagtaaattttgaagttatgactggttttatataaggcaaattttgctataggacactcaaaatttgtttattttgatggtagagatcgtaaaaatatgctagagatcgtaaaaatatgcgacggctgaaagatactctagaaaattggtaatttgctgaaggacacttctagctcaatcggagagacaaattcttcaaaaagacgggaatgacatttgggtctaaagctttttgagcccagactatagtgaaaatgaaacatgatgtatgctaatgatgtacttgaggctataacaaatttagagttgcataatttctaaattgttttactctaacaccatgctttaagcatgtggtcagaggggcattatcgtcttttttaagaatttatctctccaatagagtcgaaagtgtcctctatcaaattaccacctttttaaatgttttttagccgtgacacatttttcaatgtttgtcggcaaattacataaattttactcactccatctacttttgatagtcatatttcatcttgacacacagaccaagaataagtgattctacttattctccatttaaatatgctactagttattctacgtaaacaagcgatttattaatatttacatttctcgatgcccatgtagccaatctagtatagaagaatagagagtcacgcattaaatccaagattgttggattgaaatatgcctatcaaaaataaatttttcagatttagaaatatgactgaagaatagagagtcacacattaaatccaaaaaaaccattaagatgataatttgttggattaaaatatgcctatcaaaaataaatttttcagatttagaaatattactatcaaaagtaatcaaaagtaaatagtaaatagagggagtatgtgtcatgtaacaaaacttaacgtatactccacccactgtagtagtgggggacaaccgggaattcttgatggacccaccacagcacgtccaatcgcctccctccacatgcacctggggggaccaatcattgcgccctacaagttggtgagaaaaaaagaaatgcgaaaaagaaagcaaacacgcagcgtggggcccaggtgcttactcctacccctccctacgtgcttatataagcacacgtgtttatcagtatatatgccccccgctttatctatcctagtggaatcttatttcccgcgattacttatatatgcacaggaaaagagagaaattgatgcaggaaggaaggaaatacaggtttttgtttcattcatttgctgctgcatctgcctgcacggttgttcgttgcggagatggccgtgataaagattcttcaaacacctgtcactcccaccgcccgtgacgtgcaccg

SEQ ID NO: 22468 - DNA, 549 bp, Oryza sativa
gactatacctgcccacttaacttctctgaccatgcctgcagtaaagcagcattcttatgcatctcatgctcatcaataagagccttctcgatttcgtttatttgcctatcattcataatggttcgcttccttctcttaggttgtctctcatcatacatgtgagtgtctcctttctcatcatcctgaagaccactttcttttctatctggtgttttgaaatggtccatactgctggatgcaggatcaagatccattttgcagcgcagggatcctgtacttgtactggtacctccccctagaaagcctgaactagttctcgccacaccaagatggactaagtcctggccgactgaattctgcaggaacccaccatttaaagcgacagtgcttctaggagtctcatccctggcatttccctcttgctttgttgaaggtgttggtgcaagctcttccatgtttggtggtgtaagctcctccatgttctgcacatcatttttggtgggatcagatgaattaccaagtcaatggctaatatattatactcaacat

SEQ ID NO: 22469 - DNA, 13301 bp, Oryza sativa
cccacagccagatgaatccggattacgcatggacgcagccggtgggcctgcatgacaagtgggcccagtgacactgacaatggctgttcgagtgtcagtgtcaccgtcgtgggcctgattgtgagaagtgagaacacgtcggtgcggtgagccaccaacaggcaggcagcgcctcatccacctttttctcccaaaaaaattcgaatcaggcggagccacctcacctcgccgcggctgtttctcacgccgccttcccccgtcgacgcgcctcgccggaaccctaccacccggatctccgcggcggcggcggagatggtgagcgcgctcgcggggctgcaggaccacctcaagctcgcgcgggactacgcgctcgagggactctacgacacctccatcatcttcttcgacggcgccatcgcccagatcaacaagtgagctccctaccatcccccccccctccgcgaagccgccttccctactacccttctccctctctctcgattcagtcgcggttggggcgtgtgcggtgacccccgatttcgtgtgattcgcggcgtcctcccgcccccctgcggatctgcgcgtttggacgcacggctgtagatttgtgcgtggctgagccgtttgactgccgtagcttagtggattctattaaaatgtgctctgcggaaagaattgggggttgtggttgtgtcataagtttgtcgctagttcgctactttggggttgggggaaattgtcgccagttctcgttggtgaggtgtcatatgacttaggtaaaatcgagcggtttaactgggtttggtacattttgatgtacaagtgcccaaagcgacacagttaaactggggattatgattgggtgttagatatcatcaggcaatgtatgtaataacgttgaagttaggtgctccacatttgagtatctttggactttcttaagaaaaagcatccttgtttcttcaaaacatcaacaatgttcgcatcattgaacctattggacattgatgctttattcgtaggcatgtgctcacatcagaactcatacattgatgtgtaaatgtattttttaacaaaaaaaaaactgtgctgaagaaagatattcacatgcttgttcatttagtggttaaataaatgtttgaaggtaaaacactgagtatgacaaaatttgaacataacaaaaatgcatttatccttatattgatccatattatgatagataagattcgattgtgcaggcatctaactactttggatgacgctctgattcgcacaaaatggctgaactgtaagaaagctatctgtgatgaagtagaaatcgtgaaacagctggatgctcaattaaaggcgtttaaagaagctcctggggcaaggcggtcctcgtcaccccccattcgctctaataataaatcctttgttttccaaccactggatgagtatccaacatcatcaccagcgccctttgatgatcctgatgtctgggcgccaccaagagatacaccaaatcgtagaccaacacgaggtcaatctagtacaagaaaatcctcccaagatggagcttgggcccggggtccatcaaagactggaacacctagtcgtggtgcaaaacctaatggaagtaaaggaaactctggggcaagatcatccactgcctctagcactggtgggaggaaagggaagtcaagttcaagcaaggctgattcagtggtaatttctgtcaaacagttgttcttctcagttttcatttgagcaaatatgttgtgttcgtgttcttagttttctcctgtaaatgataggcaaaacacaactgttttttcttttggaatcatcaccgacttatctgcctagtgcaaaattatagattcgcaccaactagcatacaaacttcttttgtaatcagtacttctatgtatttatattgccaaacatgactgtattgttcgtttgagcatacttcttagtgtatacaaagtagagttaaccgtttttatgagatgcaagcacttgatgcaacttagtccaacttatctttctttgttcatagcacctattgttaaattgtaatttcgagttgtccctaaatctagtctagagatgttctattttaacttcaatgtaggaatattatcatgaccatctatccttagttcctactgtgctattgtattcatattgaactagcatggtggcccgcgcagattgcgcggctagcatcgttatattgtctctcatataatagcatatttgttttctcattatattattcaaatatattaaaatgacaatataattttaaattttgcagtaactttataaaactactaatgtgtaatattcatattgtattttatatacgtgttagttattaattatttttaatatcaaattttagttatttgtaaattataaatattcctatatggactctaaactcgtcttttaatatttcttttttttaattccgaattttttgtaaattatatttctatatagactctaggctctttttccaatattatttatttttatttctgaatttttattatttctaactgtatttctatgtggactctaaactcatctttcaatattctttaatttttaatttcgaatttcagttacttctaaattgtattcctatattgactttaaactcttcttcccatgtttttcttaatttcgaattttatttatttgtaaattgtatttttatacggactctaaactctacttttaattttattatgtttatttcaaattttagttagttttaaattcctatatggactttatactctacttctaatattccttactccctccgtcccaaaaaaagacaaatcctggtttccgtgtccaacgtttgaccgtccgtcttatttggaaaaattatgaaaaaaaattaaaaagacaagtcacgcataaaatattaatcatgttttatcatctaacaacaatgaaaatacgaattataaaaaaatttcatataagacggacagtcaaagttgaacacggaaacccaggatttgtctttttttgggacggagggagtattttttaatttcgaatttctattttttttcttaattcttaattgtatttctatatggattctatactctacttctaatattccttatttttaatttcaaatttctattatttcctaattgtatttctaacctggactatatactctacttctaatattccttatttttaattccgaatttcagttatttcctaattatatttctatatagactctatactctacttctaatattccttatttttaattccgaatttcagttatttcctaattatatttctatagcaattttacggtccttgaggagataccatgaggtaccatttttttctattgtaaatttggtatctcttggtacctaggtactatgaggtaccatgaggtaccaaattttacactaaaattttggtacctcatcaaggaccgtagaattgctcatatttctatatggactctatactctacttctaatattccttatttttaattccaaatttcagttattttctatttgtatttctatatggactctagtctcctcttctaatattccttgttttaaattccgaatttcagttatttcctaattgtatttctatatggactctagtctcctcttctaatattccttattttttaatttcgaatttcaactatttctaaattgtatttctatatggactctagtctcctcttttaatatttcttattttttaattccgaatttcatctatttctaaattgtatttctatatggactctgctttttctttttctccgattaatgtgagaatttctaggccattagaacgaatgtggaggctcctttttctattactttaataatataatagataggtacaaaatatgatgtactaatgataatggcattttcttaaaattaaccttctactgaagagggggaacctagagcctctatctgtttatcttcatattccaaatacaaataagggcattgaaagctttagttacataccatatacaattctttgcttatcttgtctcatccttctggataggttctacagtatgttcttctatatggtggtcaagtttcttgaaaaccatgtattttcttattattttcttacagagtagcgatgctgaagaaggcaagtccaagaaggggcaatatgaaggaccagatatggacttggctgccatgcttgaaagggatgtcctggattctaccccaggtgttagatgggatgatgtcgcaggtcttagtgaggccaaaagacttcttgaagaagcagttgtacttcctctctggatgcctgaatatttccaggtaatgatttttactgtgctattctatcagattctgtaaccttgcctgaatttatttttgatgctagccaatgttatggccatgcacatgatctggcatgtgcttgttgctgccttttacttggtagcttgaaagttagctggacttgcatacatgttatggccatggacatgatctggcatgttttggactcattcaaaacatgccactcaaatcaacatgcacccaaatcaccgtaccctcaattcagccttcaagttttgatcgtattcatttcagtcttttcttcttgcatgtgaccttgttattcagtttaaatttgttttgatcctcatcctatccatgctcactctatttctgaccagggtattcgccgaccttggaaaggggttctaatgtttggtccacctggtactggaaagactcttttagcgaaggcagtagctacagaatgtggcacaacatttttcaatgtttcttcagcaactctggcttctaaatggcggggagagagtgagcgcatggtccgctgtttatttgatcttgcaaggttctatgctccaagtacaatcttcattgatgaaattgactccctctgcacatctcgtgggtatgtgaatgctatctgtccatacatgttcatcttgtttaatgtctccaaagacaatcaaagttttctcaatactttttagcataatcatgggtgcattgttctgcccagtatataaattctttttgtttgcaagagaagctgagaagcaacatacttgtgcttctgtttctatttttctgaaaaacaaagctcaccaagaaaataaagtagagacctcattacttgcattttttaaagctactatcatcatagaagtactatgtcatcatttagaaaatactatgaccagatgtatgagctaatgtatttaccaagttttttaccaactttcagagcttctggtgagcatgagtcatcaaggagggtgaagtctgaacttctagttcaaatagacggtgtaaataatagttctaccactgaagatggtcaaccaaaaatagttatggttctggcagctaccaactttccatgggatattgatgaagcactgaggttgggaaaccctttccattcacatttgctttagaaatttattgagtctactaaataattggaaatttataagataaatcacataaattcaattatatttagtattggagcttgtttgcttgaggtgctgctattggaattagaatatcgatttcctcaaaaaaaaaaactgtggtttgggtccggtttaattttttttttgcatcacttcttatgggttaagagcgtagaatatttgaacttatggacaggcctcaaaagccttgttccaaatgtaaactccttttggggctagagtcatttatagtcaatagcacttaaacccattggtaccatcagaagtggcatgcaattatctgttactcctattagacttgacctggccatttctttatccgtcaatgcactagctacatgacattactgttaccacatactcccttcgtcccagaatatactatgtatctggacagggactaggtagctatgttttgggacagaggaagcacttttgttcttacttttaatcttccgaacggtgtccgtatacaacctctaactcttacattcttgattcactcagacggaggctggagaagcgtatttatattccacttccaaattttgaaagcagaaaggcactcatcaatattaaccttaaaactgttgaggtatgatattacttatcttttctgtgttgtaattccatcctagttccctttctgtttactccttcagcgttttatgattgcctccttaatcaaacagtgcagttcctgcacacaccataactgttgcacagcataggcagttatgtctctgaattgtgtttgctatgcatgcagtgcacatacctgtgtgatcgcatgcatatgtaatttctgtaaatgacaccttttgaccataagcttcatgcctactgtacaccataacctgttgactatcgaagttttctactcagagttgtaccttatacgtgaaaatgaccaaatactgttcgctacttgtcatctttgatgaaaaagtactgtgccatatcttctgttgtttgttaacgcctcttttatatcggcaggttgctaccgatgttgacatagatgaagttgcacggaggacagaaggctatagtggtgacgaccttacaaatgtttgccgtgatgcttcaatgaatggcatgagacgaaagattgcaggcaagacccgcgatgagattaagaacatgtcaaaagatgagatctcaaaagacccagtggccatgtgtgactttgaggaagctctggccaaggttcagaagagtgtatcacccgctgatatagaaaagcacgagaagtggcaggccgagtttgggtccgcttgaaatctccattctgttcccgttcaaatttctcagatcaatgtttctccttggttgcttgtgttcgcaagtatttcattcatttgtaccccttgttatgttgtttcaacggccttatgttgatcggttgtattgcctgcgccggtgttgtatcatagagacaaaccagacagtaaactaggaagtgagaggtctctgcccgtggaactgctttgttgatttagtttcagtgtcactggcactgccgaagccaaaggttgcgtcactctgtaaccatttcgaacagttgatatccagcttccatgtttcgcacgggcagttgcgacgtgcgcgttttaacagtatgcttcttgactcattgatctgctttacggagtacatcactgaatcaggctctgttcaggcttctgaacagagaaaaacaggtgcccagagctgaaacggtgcctgacgttctcaggtctgatgctggaagacccagatgccgtggcttttttacccatctggtgccatagccagaaaacctacttgtcctacacgcaatctggatgaaggcctgctgcagatgccagtcgtggacttgactttctttcatgtgacgtctcatggtactatgcatcaatagcttccgtggatctgaacttatacagtgatgctatccctgtactactatacttcgttaaaaaaaagtcagcaaaaactgagccatcggacatttggactgtccagatttatgtaaaaagaaaagtgaactaattttgagatgaaaaggaacatgcaatcgagctgctcgaggagatgtaactttagttgccaaaattttggtaggatttctaatatagttaccaaaatttggcagcatactaaatgtagccacttttttggcaactttaccaaaatttggtatgtttgaaaatggcatcaaagtgaatagacccataatgttaatgcaaaaaaaaggtacatatatcgccgttgccgttaaaatgatatgtaaaaataaaagtgaactaattttgggatgaaaagaacatgcaatcgagctgctcgaggagaggtaatgcaaaaaaaaaaattgatatgtaaaaataaaagtgaactaattttgggatgaaaaggaacatgcaatcgagctgctcgaggagatgtaatgcaaaaaaaaaaaagaagaagaaagagcaaaaatatttttgggatgaaaaggaacatgcaatcgagctgctcgaggagatgtaatgcaaaaaaaagaagaagaagaaagagtaaaaatatttttgggatgaaaaggaacatgcaatcgagctgctcgaggagatgtaatgcaaaacaaaaaaagaaaaagaagaagaagaagaaatgtaatgcaaaaaaaaaagaagaagaagaagaagaagaaaaaagagcaaaaatatttttgggatgaaaaggaacatgcaatcgagctgctcgaggagatgtaatgcaaaaaaagaagaagaagaagaagaagaagaagaagaagaaaaagaagaaaaaagagcaaaaatttcgccgttgccggggatcgaacccgggtcacccgcgtgacaggcgggaatactcaccactatactacaacgacttggttgttttcgggaaaacacaattttatctttatagagttagccctcttttgaatcgcatgcaagatagagttcagtcgcgcatacatccgtatatgtataatctagttatataagcacaagttacatcactcctaatacatgcatcaactgtacagaacgtagcccgtgttggcctgtacgtacacaacaacggcacattgccttgtcgcctctaggcctggtcgcgcgctgcaccaccagccccagcgaagtcaaaagcagcagcaaatgtagtagtaggaggaggaggaggagggtatacccctacctacgctcgcacagtagcaagtaacgtgtgcgctttacacgcctcacgcgcgccaggatcgatcgatcgagagagcgagcatgcatgcatgcccaagcccaaccaccgcgtggcgcgcattaaccagctgcagatgctttgccgttgcatgcagcgccgcgccgcgccggggcaacagcgcaacacagtagagagggcacgggagaaagcgctggtgtgaacagtgcagcggtcggagagatgagatgagatcgacgacccgatcgatgtcggggtagatgtactgtatacatagaaaggacagtggacagatcgacgtacatgcacacattgacacatactactgcgtatactagtctagttgctgtacgtagtagccgtagccacaaccagccaaccacgcctctgcccctgcactgcgcacgattgatctgtcgcatggattgatcgatcgtgtgtaccgctgcatcgataattcggtatacgactagtagcatgctctactactactccatccatccaaaaatatagcaatctagaatcggatggaatatatcctagtactagaatctagacgtgcccccgtctagattcatagtactataatacatctcatctgattttagattgttatattctagaacagacgatgtactatcttattaaatatgcgtgtcgatggatcgacctatcaatcgccaaaatacctgtgcgatcctctggtagtagtaatagctagcctgcgtaagtgcgtatgcttgcttgcttcaggcctgcagctgtggcatgcgttcgtgtaccggtcaccgcctcaccggtgtacgtacgtgcatttgcatccctctgtcaaaaaagaacgtgggcccttttgaatcaaaggatttatgtaggaattttataggatttaaatcctataggaaattttcctatttggccatttaattcaaaggattgaagctttccaaatcctatgaaatttctatggaatggcacattgcatgtggattttggaggaaatttagcaagagctccaacctcttgaaaaatttcgtttgagtctatctctctcatccgattcctgcgtttttcctgcgctccaattaaacgatcattcctgtgtttttcctatgttttgcaatcatctgttttacactttaattcctatcagaatactgtatttttactattcttctgttttttctgccctacgattcaaagggtccattaacatgtgatcctaagctgataagcattcaggccgcctgcttgccgcaccggtatgggtacgtgtttggggtctctttttatcgctttggagtttgcgcagagtcttcaaaagttggatgcttggagcagagcctatctatacacgcagagctagtttacgatttgtctcccacagccaagctagaggcattgccgatcgagccgtctagctagctgctagaggccaggataccctatactcgggtatagtctgggcttcagctggatgcacacagtgctagagagcccagcagcgtgcaagaaagattgtgctgtcagcgatggaattgaaatggtgcttcaccaacccattcttcattcttcaacctccctaaagacaaaacgaaaggcatgcttcaacggcagggaggataacatgcacggttaaagcatctcaaacaaccccttcaaatataactctccaaatatttatttgatcaactaaccaaaaaaattaggtagtgaaatatatccttcactccaatagtttttccattatacactccaatctaacagtggatcccacatatcaggctccctacttcctgtacactcccccctctttttctcttctctttcttcttctctaacgaactatcatttgaatccgcacaaggaaagaggcggtagagtggaggctggaatgtgatggtggaggccttcgatcgcgctcccacgcggtacccggcttgacatcccacgcaatgaaggcggtggcagatcgacgatgacgacgggcgcaggggatggggaactctagacaacagcaacgatgacgagtttacttgatttaggagagtgcagagagtcagggatggagagagttggggagagcctctctaggcgtgggcccatggttgacaagctaattttggcttgccaagtttgaccaacgagggagccagcttagctagtgagatggcttggtcatttagttgtgaggtagttggagcctgtttttattcataattgctaatttttatgtgaagagtgggatagtcgtactgttggatacgctcatacatatctatatatagctcatctacggttttagctatgaattaagagttcaaaccagcaggaatagtagccaacaacggaaataatcaggtgagatgcccggagcagatttagagtgggattgtagataagagcaaggataataatatagctcactttctactattagtccatcttaaaatcaacacatataatagattagctataaggttggctataatttttttctcctctctctatctctcacctatatattcaatgtatttgtcttggagcttgtgttaagctagctcttacatgagagccaacacccttctcttttgtttacctctctcctccacataggggggcctaatgggcgatcgtgcccagcgatcggtttgcccccccccttccccctatactcctccctcttctccccctttctcctccccttcttctctttctactacagtacactacacaattttttttaaaaaaacaaaagttaaaaaaatttatgtatagaaatactattatataaaaaatttgaattcaaattcaaatttgaatcgggtatgtaaacttttgacttataaactttgggtctataaactttagatgtatagaaatactatatatagaaaatatttgaattcaaattcaaatttgaatcgggtatgtaaacttttgacttataaacttttgatctaaaactttaggtgtataaactttagatgtatagaaatactatatatagaaaatatttgaattcaaattcaaatttgaatcagatataattcaaattcaaatttgaaatgggtatataaacttttaacttataaactttagatgtatagaaatactatatataaaaaaatatttgaattcaaattcaaatttgaatcagatatataaacttttgacttataaacttttggtctctaaactttagatgtgtaaacttaatgtgtataaactttaggtgtataaatttactaaaataggaaagtaatgcggtgccaaaaaaggaaaccaggtggagggagggaggggggaggggatcgatcgctgctccatccctaaggcgatcgatcgccgaacagcatttccgctccacataagcttataatagatttatagctcactattatacttgctctaaggtgtctataattcagtgactcgctctgttcacgaaatggtgttttttcaatgcgcatccaaacttgcattaattactttgggtagctattattgatcgatgagcgtgcatctcttttctcactactccatgtatgtgggggtagctgcattacacgtaataattgtcattatgtacactgacaaattagtagtagtcctgccattttagtttaagattgggaaaaaaaacatgcatgcagccgagctaaaatttacgcacgcatgtgtaatgtacgtgccccatagctcttgtacccgggaatccggatcttggtgccagggaaggtagcccaacatttgttcgcttcctcccagacactgcgtcgcaataaaatcgattaggtagtacgagttcttccctgacaaaatggaagtagtggtagcagaagtagtaaaaggggaaaatatgcaaatacaaaaaacctctggttgttgtctgctgctactacttcacatgaaaaacatatgccgatcgatgtgatccatcagtgaagaagcagcagcatggccacaactccctcctctccaattcgtcaccagtgccattatggtcaaaaataacaaggcatcatcgtatccgctgtccccctcttgctcaatctctgcatgcgcacacagttcagtcacactgtatcacctaacctttccagtagctccattgtactgtgttacagtagcatatgtaatcagtttaaacggcaaagcagattaaactcagctaagcccaaaatataacagagtgaccgtgcaagcaaaagagaggttaaaagaaaaacagagagagacaaggaattacagctggggccggcctggcccagaatgaattgatgagccgtggtgtcgtggtgtcgcgttgcgcgcccgacaagcgcagatccgccggacgagccgtcgtaggggggtgagagagcgcgaggtgcgcgtatgcatctgccgctgcacgtttctgccggcgcgctgccgcgttcgcgcgcgcgcgcgccctcgatctctatcggctaagggtgtgtcagttaacgctaaaattaaaagtttagttaaaattaaaataatgtaataaaaaagttagaagtttatgtgtataggaaagttttaa

SEQ ID NO: 22470 - DNA, 8674 bp, Oryza sativa
atgacgcctcaattccccacacgctcacaccggccgtttgcccccatcatgctccaaatgtagctagagcagaaggagagatcgtggtgagagctcgaatacaagatgctcgccagctcttctcctatctgtgaggctcatttccctccaacgtttcctctcttggattctcagatgctagccaggaggtcgtagcagcagcagcagtggctgcaccggcgccgagctccattggggcaggaagaaaagcagcaagatgaggcatttccatgagacgaaaggaggtctcactttgcaaagtttagtgtaagggggtgatgagaagtagaagaagaagacaatagagaaaagctagggcgatgtgtttatatactcacatggctacaagggagagagaaagaaaggggcttaaagagagaaggggtaaaattgctacagctacagaagagcctgacaaagtgtgtacacctttccgagcaaccgcaaagaattcattgtattgtaccattgcacagtacatatatgcctacatggtcatgttatgtgcattatggtcttgtcttagcttggtccatacgcggagacatattcattttatagcactcattatgtgggactggtagtattttttgtagaattgaattcacagcaattaattttggtgtctttctttgtgagctttggcattgcttgagcaattatataccgtgcatatagagtactaagattcacccggcctaatataaatgtggggacaggatgggacaagtttagtgttttaccagtaaatggaatgtttgttgtgtgagtgtgtgtgcagatatgcagattgataggcctaacattaaacaaagtatgatgggaggcatgtttgtggggaacgcgaaacgcacctacacggactccaaggcaccttggggtgagcaaggaaaataaacagctcattgttcgtatgatatactcttactatgatgcaagactggcatggggtggaccatttatcagtgagacgaaattatctaaggtacagtttattttcacctgttaattaacaacccacttgatcatctaggagaataacaaaattggtagcgttgttagtggatcattcaaccctaaaccagtctggaaactctcttactgatgtatcggtagaataaactgcctagatggatggagttaacaataagtaattaatcataagctttgtctagccagaaaaggaacttaaagagcaagtacaatatatagtatcttataaatcggctgtaaacacatgtaaaaaaagataattaaaagagaaaagaaaacagagatggactacaactttatagtcggttgcagtactgattataaaacgttttgtgtgttaaaggtatgactaggtattgtggtattgatgagtgtagtatatatttataggcaactattatataaattgagtattaaaatatgtatagataatttaattaggtcctttttgttggcccatattttttaataagccaaatcaacttattaaggaataaaaattagttagtaggtaaaatatacatgtgttcgtagcaacttaacaatcaatataaaaaagaaatcatgttgaaaatatcttaaattaactttaaaaacaaagttgcaattttgaattttgactttttcttttgtttattaaagcaaccaatggagcttttggagctggtagctaactgaactactccctccgtctcacaatataagggattttgagtttttgattgcaacgtttgaccactcgtcttattaaaaaaaatttataaatataaaaaatgaaaagttgtgcttaaagtactatagataataaagtaagtcacaaataaattaaataataattttaaaaaaaatttgaataagatgggtggtcaaacgttgtaagtaaaaactcaaaatcccttatattatatgacggagggagtatgtatatattaaacttgctgtaattaagatattaccatgcactgttttgtgtagtgggagctatagccatgaggtttgtcagttagtgtgattaggactagtttaattaagaacggtgttacggctagacaatcctttgcgtgtgcatgccactcactcacttaggaagtgatggaagcttcacccgttccttttatttgtctacatctctctctcctctttctgctttcagactgcacatagagggggggggggggtaatagtaatactctatcatatagctagatgccgatcagaggaacggtgtctcttgctttcctaaaggcgaacaatgtttcggtgtgtgtagaaaaagattcaccccatgatagaagagaaagctgcggtggtttgtttatcaccggtgattcaaatcatgtttgttatcattggaggtagcacccgtcatgtaattctactagtctactagtgttagaatagctaggttcgaatatactagttcaattataagttaaactcgttgaagttagaatatgtataggatagaattagagttgaactttatcattggctctctcttaaacagagagcatcataatataaccataacgactacaattaaacgtaaacacataggaagatgatgacggcgagaccataagactcgtaaagactagatgctatgttattggggagaagcgctcataatcagagcttcagagatgtaggcttcggttcaatttcattaacaaatatcgtgggctcccgtattgtcttctgatgtgtcttgggtgatcgatgattgaaacgatcggaaaagttagtcattatttcgctatatctactaaattttataacaaccaacgtgtactacagctctgcattttgcagtgttcaactgttcatcccatacatggtttaaagaaaagaagctagatagaaacgaacgcattgggcattgtgaatgaatccagtttacatttccttcccctatgaagcacgtgcattacattgcttgcagagcataatcccatgcatactacatgatgctgcacaaacattcagctagcatatgggtaattcacaggacaaatgaacaatagacagcaacgcgatcgaacagcgaaaggagaagaatttttctggcaatgcacacacaagacgcacgtacggcgcgcggcccagtagtgtcgactactagcgaatattctccgagacaaacgctacataaggcaaagcaaagcgaaggcacacacacgagctagtggagattcaggtgcagggccatgtcacttcgcagcaatcggccggacaacaggaggggccgatgcatccatgcatgcaaccacaaacaaagcacacgcgcacgcacgcgcacacatgctctcgcaggcggcagctagctagctagcgcatcgatgctcctatacttgcagctcgctgccgccggtcgcgccgtacgtgctgcacgcacgcagcacaattgcacatatatatggagctttgctttgctcagggattcccttgcacagttgcatctcgaactctcgacgcgacgaacatatatgcccaggcacgcacaatctcagcagtcagcaacgtgcatgcatgcatggatatatacagcacggcatgccatgcattgtgccaaaacgtacaggatcagtctgcgtctagcgtgcatgcctatgcacggatgcatctactctcgcgcaaaagcggtcaaaacgggcagattctctcgcgggggctccctctttgggaggcctctcttgctcgggcgcgcgcttggctggttggttggcgcatgcggatgccggccggctgcgcctgcgcgcgcgggcgcgtacgtgctcgcgaccgcgcgcgcagtgtgcccagtggtttgtgcgtgttttgggcagcgccgcgcgtgtgctgggctaagagcggtacaatagtaagctataagcgagctataactatatatcgagaaaaaaagagaagagagagaagaaaacgggctacagatttatagctgactgcaatacgaactccaagacgttatgtgtatatgagaggtgggaccggatattaatagtgtagtatatttttatagttaactattgtataaatggactgttagattagctataggtgttttatagccaacaattgactatactattaaacttgctctaatgcaaggacggtaggcgggcgagcgggcatcccggccggtctgttggatcatgagaatgatggccgctttaggacgaaggggaggagtcaaaaataaacgcagggcgcttttgcagcacaaaggccccatttcggaatatatgcgtacgtacttcctgtgtgtccagcttacctagccggagctcccttttctccttaccttttctgttgtaatttcttgttttgtgtggccaagcaatgcaatgcatgcatgcgacgccctccctctttaatcgtagactggaaacgagcaaacgatcgggtacgttcgcgacaaactcgcaagaaaataatgctgaagcgatgcatttcgtaagctctctcgttgaatcgtccggccgtgaatttcacgacaatatatatctatatctatatctataatattataaaaattgaagatgttttgccgatactttggtatactatccgtgtatgagtcggtttttaaattcgttcgcttttgaaaatacatatctatatttaagtcggtttttaaattcgttcgtttttaaaaatacagaaggagtcatataaaaaaatctcttttaaaaaaagaactcgcatgctaatttgagacgatcagactcctaaccacagctcatgacttaaaaaaaaaacatccaagcgaattgccacattgaatttcatcttagctaaaccatataataataataatattaaaataacctttacccattacaatgcacggatattttttctagtatgtatataaaagcaaaaataagccaagatcctacgattcgcgcgtcacgggagaaaaggtgaaaggcgcgcacggccggccggccattaacaccaaaagatcgcgcaagttgcttctaatccaagtactaaatgattgagcactcaaaccccctcatcgccaacggctcgtcgacacgacggctcagcgtgcggaatcacctggacccgcgcgagcggcgtgggggcaagctagcggagtagtaggcgctcctcccgcccttctttccccggccggcccattctccccttccctgttttggtaggcgtgcgcgccatgcgtcggcgtccacacgcccatgcgtggcccggctgcgctcgaccgcgcgcctcgttctcctcgcctctctcctcgtggtggccggtgggggcgttgccgttgccgtgcacaagggcggccgcgcgcccggtcgcgcgatcgattgccaacaaccgccgcgcgatgtgctgcgctagcaaactttacaacccagagacatcacgcacgcacatcgtaccggcgcgagcacgctgtaattatctcccccagcaacttattcatataagcaaagacaaggcatgcagttagtcagctagcgcgagacagggtccaaacaagcgccacagacggctcacagtagcgagttacatcagtcacaggagcagcagctagccgcgtgcgtgtaggccctgtgagctactacggcataaacagcagggatctatcgatacaatgagtcaaatccaagcgcatatgatctttccgcctgcgctgcgctgccctgccgcgcgtgactggtgtgacaaagcccccctccttgccttgccggctcagctcgcctttcctcgttggccgcaaagatgcagcaaaagcctcgaccgctgtcgatttacacgatgagacgaaactggctcgtgtcgtgtcgtgctcgtatcgtgctcgtggcccatgggaggcttggaaggggaatttaactatttgccacttgtccaaataagtgtcttaaattcacgcttaataatttatcaatgaagggaggggtcatttcttaactatttgtcacttttgcttacgtgacgagccatcatagcgtgcccacgtgaaaaacgacgtggacccacccgtcagcccctccactttccttcttctccacctcgccggagcttgaattgagcgtagccattacacggacacatctaaagcggagattttcgccctgagttggcctagctcggccacgagcgccgccgccaccatggtctcctcaagcgccacgtccccaagccccgcgtcctacgccaccaccgccccgacgacgagcgtgaacaacagcagcagcgccgccacggtagcgcgtctcgtgatctgcatcccgagatccgtgcgaacctgtctccctcgatccgtgcatcgccggagccactcccactcccccttcttcatctatcgttgaagccgctcccactccccgttccgcacatggctatcaccattctcatcgtctgttccggtgcacgcaagcctctgggcccgaggaagccgtagcggccctgtcaacatcgcggtcgtcgttgttctccgcttcctcattgtcgtcaagaaactcgcgcaagtggaggttctcgaaggatctcctccatcggagcaactccgaaagcggcaagaacccgtggccgcctttgcccaccccgcagcctcggtcgccagcgcctgtaagtggcgaggcgagccgaggtggagcagatacagcagccgtaggtggagaaaaaaagataggggagggcctgacgggtagggggtccatgtcgctttccacgcgagcacaccgcaatggctcgccacgtagaaaaaatgataaataattaagcacgaatctagaagaggcatttgaataagagcaagataataatagagctcacttcctactattagccaatcttaaagccaacacatataacagattagctataaggttggctacaattttcttctcatctctcaatctctcacttatacattaagagcaagttcaatagtatagtcaaatactagctccaattcatctatagccaatctaatagctcattcatacaatagttacatactacattattaatacctagtcccacctgtcatagacacactgcgtcttggagtccgtgctacagctggctacaaatctgtagctcgctgctcttctctctcctgatttatctccttaaaatatgtttgcagttaacttatagcctgctattgtacctgctctaattgtatttgtcttagagtttgtgttaagctagttcttgcatgagagccaacaccttaactttttattacatctcttctccacataagtttatagtaggcttacagcttactattatacttgctctaagtgatgtacttaacagtggtaaatagttaaattccccaggctggacccctccacccagagtccaatctccaaagcggtggaacaccagcccagccgctcagcctcgcagagtcgccccgcgcggctcggccgctcacccacccgtaacgccgtcacgagacggcgctagcccggtggggaggtggcgcgaatccgaggcgccgcctcctaatttttcccgcgccccaccccgcgctgtggcggctgttcctcctcctccttcccccgatccccaactccttccaactcacatggcggcggcggcggcggctgcgtccgtggcgagtcaagcgcaggccgtgctccgcggcaggctctgcgaccaggccgtcgtccactccgccctcaggtcctcgccggacaccaactacaggtcagccagagtcgctccccctcccgcgaaatcagcccgggagtcctcgcgactgacgcgctttgttctgggttgggcacagtaagctgaagtacctcgtcgccagctccgtctccgaagcctgcaacaactccgtcctactcctcggcccccgcggctgcggaaaagccgcggtgaggttttcctttctagtatactcttctgccccactttcaacggttttctcggatgcgggggtggtgttcgacgaaatgtgccagtgggcgatctacgactttacgctatgggttgtttcggcatggactgaggtggtgtttggatcagggacttaactttagtccatgtatttagatactaatttagagtattaaatatagactacttataaaactaattacataaatgaaagctaattcgcgagacaaattttttaagcctaattaatccataattagagaatgtttactgtagcatcacataggctaatcatggattaattaggctcaatagattcgtctcacgaattagtccaagattatagatgggttttattaatagtctacatttaatatttataattagtgtccaaacatccgatgtgatagggacttaaaagttttagtcccatctaaacagggtctgagatttcaattcttcgcaggtggtcgacatggttctagatgatctgaagaaggatcatcctgatgcaatatcagtggtatgtataaacgttatattttacttgttgctaaaaatgtatccatgtatttgcgtaatacacgatcgatgatttacctacgttggccgagaaataaacatacatgttaccagaaaatagtttgtttcagggcgctttagggcggaaggggacaaggataaatgtagaaactccttgcatatttttatgttctcaaatgcatgggctaaccaaaaggacaatatatcataatgc

SEQ ID NO: 22471 - DNA, 5839 bp, Oryza sativa
cggtaagtgaagtgttaagattatgttcatctgtacatcatagagacatactccgtgattcttgaaatttatgtccagtcatctgtatcctctcttctgcagggagtgtggactagctcacaagacaataatttttgtcctagaagagtttgacctctttgctcaggttgaaacaaatacatgcattctggtttaactatacttaattcatgctgaatgttagatgcatagaattgtagcacgtcatggtttatgggacatttgtcttacaggaatagcttgctttctacaattgctgctggcaattattagataacaggataacagatgattctatttatggtttcctattacaggggaagcagaggttactctatagcttacttgatgcaatgcaatctctcacctcacaagctgttgttattggtgtgagttgccgattggtatgaaatatatcctctcccatgtttctgcatcttagccgtttgtaatttgtgtgctagtacactgtcataagatcaccatctcccatgtttcagatgaccctcttaatcgtgtggtagttgatacacaatatgcattagtgcagtagcatgtcacatgcattgtggtaattaatgataccaacgctgtacttgggattgaagtggctaataactttagacattgatagttctacgaaaaatctactgtttcctttgtgagctgttttgtaatatcaattcatttttaggatgcagaccaactcctagagaaaagggttagatcccggttctctcataggaagcttctgtttgttccttcttcagtggatagtttacagaggttagccttgtgcatttttttttttcaggctaaaacattcactgtttctcaagatctctattcaatccatcttttgacatttgaatgattgcaggttaatggagcacttgctagcacttcctgaagattctcccttaccaacaaagtatgtcagggagtacaatgcacggattactgtatcctttgctcaatgtgacatgtcactttatgtgcttacaaaacctgcaggtcactgttcttgctttataatcctcacggcaatcatatttgaataggctgacaaatacccacagagtgttttgttaatgggcagtttttctgtttcttattccaagaatggatgctgaatgtgttcttttctatgctaaaaagaagccatggtggcaaactggcaatggcactgtttcttaggctaaatggaactgtatgtgatcatcccatcaagttctataatattgtttgtgttattgtgcaaaacaaaattgtaatccatataatcaactaggtaaggtagtgcagaaaattgcattaaaagcttgggatttccttgtatgctgctgaaagttcacattctcatgccactcattgtctcagtgacatgggcttggatccacctttgtcataacgacaatgagggattttagagttcaatgcaatataaggaactaatcccccccaaggtttatgttatcctatacacttcagagcattttcaatgacaaaaagttcaaaggaattctcagctccctcactgatgctgacgcaacaacaagccacatccttagatttctgtaagtatttcagcagcttcttttttttatcctcccttttcttcacatttccacactttttagtactcagttaaatataggagaacgaaaccttcagtttcagagtggtgtcatacatggacatagattctggacttctgtcaatgcaaagcttcatgaatgcgctatcttcgatgcagaggcagcctaagatggacagtttgcaaggtctattttgtttgttgtccctcatttacttatgtaggatggaattgttcgctgtattgatttatatgctaaaacaaagctaccttcattactccacaccataaaacagtggacatgaatggcaccatatttctgacactgaaatttcgatagcagatctctccattttggaactatacattcttgtatgcatgaacaggctagaagataaggagaaaagttcatacaactttatcactattatgaaaggtagaatctgttcctctccatttgtgttcagtcataggaaagactaagtaagttgatgaactggttgtctgtcagagtacaaatctgtgcaggatgcctacaaaacgtcggacaaatattcacacactgtttgttttagagtaagtattagcacaatcaagaattcatgaaccttccattatattgaaatttcaatataaaaaaattacaacttttttttccccttcgatataggcttttgagcatcttttggatcgcgagttgattagctttgcagacaacaaagggagaaatcaggcgcttgaatatcgtcctgtcaaacttctgatatcttcacgtgagcttgctgagtccctcaagttgaacacgacctgccctgtgagttaaacgtccacctgttttccaatttaacgatcatctgatccttaccccttttgtggcttgccgttctatctcaatacgctaacaggttgtcatgctttgtgaatgatggtgctctggtttactattgcaggctgttttgcagaagcttcttgaccgtgaaagatacatgtaaaagtttctatatgtttgctaagttgatactggttcagtgctggcatacttctttcttctttgtactccctaacaccgtgttggaacattctatctactgcaaagagatttaccttgaagatgaaaaaggtatatcggtctctggcaaggtaacaaactaacaacacaccatttcactcgatgccctccctcttgtgtgcatggatgatacttgagaagttcaacgcaaggtaaacgcactagtgcactactgtgctagtaaaactttaactggattaccatggaaaattgacaccatcagttttgtgctcatgacaagcgtctaggacgaacatttgttgtcctcagttctgtagatcatacacattcaaccaatcctgtcatcctatgcatgcgttgataccgagaatctagctcaggtttcataagtagctcaaacacatgttgcatagcaatgctattgtttttctcaaataaaattgttccaaatattataattatcttgaaactctcgcaatctcaggcctgtaatggcggaactattgtcaagtaaattttgcctaccttaaggtctagttaaagagactagctatgtatagttatcttgaaaacaaacaaatacaaggtaatagaaggtttggagcagaaacactgcgatgaagctattacagctgctttattgagcgtaagtgatcccttcgtgaccattccagcaagaaaagcgcaagagaaatccccacacaaatccaaagagtaatcaaccaagtaggcattggatcttgaaacaaacctggttatgttgattcatgttagcacaaagactgaccaagcatgtatcgacataaactgtatgcccttgttaatttgccaagaatatgctacatactataaaataactcaccgtgtccaaacttcatgcatataagcagctctaccatgcatatagctaacgaaagccaacaaaaagctcccaccttcttcactggttttctgagataattgatatattgaaaaaaatatttagttatccatcaatagaaagattgcacgcccataaacaaaagccgggatgggaactcatgattctagaaaaggtgtaggaggatattataatctatatgtcaagaagacctgtcttgcaagtaggtgttgtactcacgaattgccgggatagcaattaaccaccaaaggatcagccgatacacaaccaaggggttcctgggaggaatccagagacaaaatttcaggaagaaggtgttaagttccactgtcatgaaaccgacgcagagacagaacacttggatgaatctccttggctccatgaaaggatgccattgatccttatcccatttagcgggtgtgaactgacataatgacctttttacctgccacaatggaagtggttaaccaatgaacttaaagtgaacttgactagcttgcgcaggataaaccagctgataccaaaatcataattttgaggtcatgataaacatgcatatgctctggtttacgaatttgtctgtccaattcataaaatatcctaccaaatcagttccagactcctattcttatcctaatgtttctattctactccttccgtcccaaaatatagcaacttctggctagtatccctgtgcgtatggttggaggtattttgattagccaataccttccatgcagcccatagttcaattgctcaactctcaccctttaggcaggtagctttagcttggagccttagaagtgatcaattgtttttcataatctacgaggctttcttttttcttgaaaaaaaaacttatgagactatatatgaatatgacccacatgtagtcagagtatttaagtgatgtatattgtatagagaatggtataaagtggaataattacttgcttagaaattcagggattaaggataccaaactgcagacaagacagcctgacttctgcggcaacagaaattcattgtacagtcccactgggaaaatcccagattctgcctgggatctcccatgtatggagttaagatctttacacttgcatagtacatgcagttataggatgacttatcttttgttaatactctgccaagtccactagaggttgtctaacttgaacagtcttttgttgacaatgggaaaaaaacaacaacctctatatcaagatatacacagccttctaactcaacactcgaacagtctgcataacgtcaatcttatggcagcagcataatcaaacaaaaaatcttatggcagcagcattggcgcacataatcaagcattggtgaaagtatttgtgtcaggatgataaaatagcaggacaaaacagcaaaaacttggaccactggtcattttttttaggtatgcaataaccaaattaagagattaaaactgaaaaaaaaaaggaatatgccttctattaatgtgttttcgttgagcaattgagcataccttacccataatgcttggctgacggctcagtccaacccattcgtatgttttgccatcaaagtaacggactgtgtgcatccccgcccaaatacctgtatcaagattcaaaatactagttgaatggaaacatttcgatggaacaacagtaaaacttctgatgttcatacactgaattacgaccgtacatattcgttatttaaaaaagaaaatgataataacaaaacacagtgaaccttttcaaaggttctacatactcaggccaagacaaaacagtatcaaggcaatgacatcctagttagtgcattctgctacacatatcaaaagggaagttccgattgagaattgaaaatcacgaaaaatttatcttgcagacaagctgtcctaatcaaccaagcaagtctacatatgaaataacatgagaaacatcgacataacaaagcccatattcactgctaatctgtaccagtacctctaatgttttgcactgacaactcgatatccttaaatctagcactctatcagcatccagaaaagaaacagctatgtgagaacttttgatacttttaacttgtatgactataataacatttttttattcagaaatataacaaccagatggatgaattgtaaatttagatactgccttgaaagacagagatctcaccaaaccaattacatatcatgatatccaatataatactgtcccaccaacactcgttaaaatttggcagcatgtgcctaaatgtaagctgcagaagatat

SEQ ID NO: 22472 - DNA, 879 bp, Oryza sativa
gtaataaaaaagtataagggtaatattcatatataattagtaaaaataaataaaaatagatttttcacagttttttttaagatatatcaattataaaatattgataagattagaccattgtcatagtaagagaccatgattccttatcgaactcatgtgaagaggacatgaaagcattattcattgtcgtcgcatctacccttgcgatgccactccttcccttgtgtgcacctgacgtgactatgtgtgcgtctctgattgctctcaacttgctcacaccacccaagagttcgcaccgaggacgctcgtgaactcgcacaacattatgagtttgcacggtgaactcaaaaactcccacaatctcaaccgccgatgacatcacgaatttgtgtgttttggtggtatgaactcgtgcgcttctattgccatgtcaatgattgcgtatctttgcggatgcgatgaccgtataatgttactgttggttttgaaacgagtatatttctgtcacgccgataaaaaaaatatattttcactttttttcttttctataattgtcccgttttctttaagaaaaaaaaaggtaatgaaaggctaggtctcgtgttagtagaaaacgaaacatactggagggtatatatgcaaaatccacaatactggtttgtagcctgggagtctgggacgacttcgatttctgtcgcacatccgtctcccacctgactcgttctaatcggcgaagagaaacccacacaagaggaagatggcggcgccggcgaccggcggcgggatctccgccgacgtccccatcctccactcggagaccctcaccagcaacgtcaaatccatctactacaggttccgctcgttctcttcccccccccc

SEQ ID NO: 22473 - DNA, 21190 bp, Oryza sativa
ctgcgcccgcgccgtgccgctcccgccgccgccgcctgacgccgtcgccgccccccctccgaccccggcgccctaatccgagccgtggaatgagttcaacttctcctccttttgcctccggcgccgtcccctccctccggctcgccgccgctcgccggcgccgttgtgccgccgtgagccgtccgatctccggacgcgctcctcctctccccctgtctcctgccagcgtgacgaccacgtggccgccacctcagccacccggccccgcttgactcggtcagccgcctcctcttcctctcgctcgcgggcttggcccatcagccaacctccccttaggcctgatgacacggaaaaagttcacttttagtccctcctccgagtccagtgcccacacacccaagagctaaaagtccacaattactccctccaattgctcctctctctctcaccttcttgttggccccacgtgtcaatgagtcaaagatattcttgggaatatctttttcaatactccacacatatttctcttttctagaaattcaataaatcatttcctatattgcaaattccataaacccatcgtcttaatccagagattccaataattcgtcccctcgagcccgcatgtcagtggatgtcaataatattattgagaatattatttctataaattccataaaccatttctcgtattccagaaaattccgacaaatcatctccttgtccagaaaaattcatttaaacttccaaaattcatatcccttaatccgttcgtccgattgcctccgttccacttccagtaattccattaaattgtgatctatctaatggcactattaattagcctaaataggacattttatttggtctttgcttaggtttttgattgtttgcgcctagttgcggttatcggatatttttcttcaagcggatttctcgaagatttgtgaagcttcgtgaagaccctgagcaaggcaagccacctttgaacatattgagcctatatttgaacttaattatattgcttgcaaaatattatgcattgataggattgcacttaatctgtttgccccgtctgcaaggcagaccggtgggcctacctaacttgttgcatctgatccttccattgttaattgttatatcatgttcccttgtaaccacctagttgcgcctcggtattcgtgcactctgcacgagtatcgacggttgccttcaaacttaaaatctgagaaacatcttgggtaaaacttggtttacaaaagctttggaaaacccgacgcctgggtcggtgccttgtgaaagaaaatgagttttaaaaataaaactcgcgacacaaggccattcctgggcggaatacttgtgcggtctcatctaaggaccgattcctttggaattacatccgagcatacaatagtgcgaccacatgggtggaatgggacgcccctggctgagtaagtagctaatcaggggtgccttgatgccaagagacatgtggattcaacggggtggtgtcggggagaacccccgggcttcctggcacagtatggtctgggacctaacctgttgttggtctgggacccctctcgttggcatatggcaaccctgtgtcggctttggaaatgccttgtcgtgaaagcctcaaagtcgccagacgtggctgttctgcacgggttgggtgacccgggttagtaacgtcgtgtgggtaaagtgtaccccctctgcagaggttaacaaactgttcaaacagccgtgcccacggtcatgggcggatgtgaggtgattccttagcgtagtttttgttttaccctgttttatgaaaaggtgttaagttttggaaacctaatgcttgggaagcatttagctatccgggggacagtgggaccgggagtccctggaagtgattggtcgtttggggaccactattatcgggaagtttggaaaattggtttggtttgggaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcttgcattaaccacctaagttcccctagcttgctgagtacgtaagtactcacccttgctctctatataaatatagttctgccagctctgaagatgaagttgaagtgaagtgaatattaggatttcgtcctagttccctgccgttgcctgtggcgttgggtgttagtccgttggttggttccgctgctgctgttgttggtgtttgcctcgtccgtgtcgtcggttgcattctcgggctgtttgagctgcaatctaagttaaggtaaataagtcttctattaattataaggatttgtaatgattcatgtttgtcaccgtgggtaccagcgctatgtcctgggactggtactgagatcgcggtttcgtaggacacggttcatgccgttttcctacgacacgctcctgtcaggtgccgttgtacggcggtgccagattggggtgtgacaacaacccaatgttttcaatcctttggattgtttgcaacttaaccataggaaaatttcatatgttttttaatctataggtttgcacatgtattcccacattattcctatgtattttctattcctacggtttgaaaatcctacaaatcgaataagccctcaagctgaaccaaaaaaaaaaagattggggtgtgacaacaacccaatgttttcaatcctttggattgtttgcaacttaaccataggaaaatttcatatgttttttaatctataggtttgcacatgtattcccacattattcctatgtattttctattcctacggtttgaaaatcctacaaatcgaataagccctcaagctgaacaaaaaaaaaaaaatcaaaaatctgttcgccctctgaacaaaaaaaattccgttgccgggactcaaacccgggtctctcgggtgagagccgagtatcctaaccagctagactacaacggatcatgcatactataagattataaaattatatatattcctgtcgatagtatacaccaacctcatgtccaaattccaaaacacccaaatgcaacatcacatcacggtatcacagatgcactcagcaaaatgaattgggattccgatttccttataagtaatagcaagatttcgtatacatcaaagttttacacgtttagtacttgttcaagccacaagaaacaagaggccagtggtgcttgcttggaatatgtggtctcagaaagatcagatatcccaaactccaccattgggtcagaagatccattttctttcagcaatgtacattcagggctcatctaccccacataggattcctcttttcgtctatgtcaacgaccagcaggtggtctgggttcgacccgtttggtccctctttatatagagtgggcaaatatgcgtggtatgctggtaggtagcccgacacaaaatccatgacctgcaagaattaccagaagcatgttaacctagctcatcaaatgcattagaaagagaatccaagactcgaatgagcttcagtgaatagcataaaattgttcactgaagaatacatcagataattcaatactagtaacagttcttgttgctcaactttcaggtgaagtgatgcagtttttttctttttccaatcacgggaattccctgttttctttcaattttcaacacggaaaaccagtctgttacatgaataggtttttagaggtgattcactgagtagcaagtacttttgcgtccctgaagattttactcaaatgtactgatgtgagtggtgtacttactcagtttggccacaactgaattcagtgggagctattcctaattggtggcaatttgtctactttacttgacggttagtaacagcaaggcattagcaaattatcaaactaggacggaaaggaagccaataggatgttataatgaatgcatagctatgtgagaaacaaacctcctcatcagacattcctggtttcccatctgctctcatagctatctctgcctgtaaatccaaataacataagaaaattgcaattcatggttgtgcattttctgacaccattagttacttagataaatctggtaatgacctgcagtctccactggtacacgcaactaggttcctttatttttatgaccatccatgacccaatgaacctgtcccatgcatcgtagtatgcctcaaggttcttattaaccacctcaagctgaagatgaaaaaaggcaagtcatattaagtaaaagagaaacaaagaaatcagataatgtggtaatatcggaaacccgcctgagggtccactgcttttacaacttcatttggaagaggtttgaatccaagcatccatccttcaaaaagaacaacctaggacagagaaaacagacatagaaaatgttcaaaaattacaattttctcatctcaaaaagccctacagctcaacatgagcttacctctaagggcccttcaacctctggccatgttgaaggatcagcccgatcacctcttccaccaaaagcagactacatggacatgtgacatgtatcatgcagctactcaattataaaaatcatctaggcgacgataactgcaaccttttaccttgtcataccgtggaagcttcatcttcaaacctaaatatattgtaatatcagtgacaaactattttacattgaaactaggatgcatatcatttcaataaattctccaaaataaaaaatatactatgtgcaaggctgttcaaatataataaaattggtctgaagaggatatatatacttgtcaaaaatcagtaccttctttagttagtttaagcagcgattcaagtgtttcaactgagaacgggagatcatggcttccagcatttccacgaagctgtaaagttttggttatttactctcagttcacaatacaatacttgaaccaaaacagtgtatattggatctggggtgttctttgtacctccaaaagagcatttccaggatttctttccctcaatttaccctggaaatattcattaattgttttcactaatttgccaagtacttggagtagtaaaacagaacggataattgcacaatatttgaagactcacacctgttctgctgccgtcaagtagaagtcatcgatagataatgtagcggcattcctaaggcacggaaaagtcttgtcttttaaatttcattgatacgggtaaacataacatgactagaatgacaagaagaactcacctaccagcaacccgaaaaagataatcaagtgcgaaaacaagagttgtctttccactgccttggggagcgctgaccccaatctacatcacacaaagacgattcatttacaaaatgtgaattagaatcagataaagacttgtccgttcttgtgacttgatattcacagttcccatttcggtataattaatatatcccttcgtgataaaacgatccatgagtgcgtgtcatgctgattaaagcaatagatgcttcatgatgaaatattttgtgcgatgtactcataatgcagaggaatatgttctgctatgtccacctgatggaacatgccatgagaggtttggaatggatgctatcaggcactagtggacaaagctacatgtcagatttcatcagcttcttctatgataaagagaaaaatgtttcatgtgcataccactaatggagggatctcgtcgccgtccttgtacttggccctgtgctccgtgacctggtcctcgcaccagaggaagacggggatgtagaagtggtatatcctggccttctccgcctccgagaggtggagctcgttgaggcggaacagccgggccacctgcacaccgcagcgcagccaccggtcgatggagccggcgatcttctccttggtgtacccgatcctgtccacgagcgggccgctgcagatgaagtcgtacaggtcctggacggaggagatgagcgccggcgacgacgccggggcggagcgcggcggcgccgcccccgccgccgcctggccgtgatccgggcacgacaggaaagctggcgcaaagaaagaaacagggcgatcagttaaaatggcgagaggaatcgtgacttgcgcggcgatgcctttcttgatcctaccatccatgcggtgtcaagaacctgagaaatcgacgatctaaactatagcaaaaaggaccaaatctttgaaggaccgaactgtgtattgacctcttgaccccagcaagagagagaaaaacggatgcgcgagagttttatatggatgatcaaacattgctctctgcagctaaaaaaaaaaaggataaagaaacggctcgtcgagtcagacgcaggggcaggtgtacgcttgcaaaacaccatggcacacgacccttatccgcttacgcgagcacggaaaaggccaagcaagcaataaacaagagaagagaaacagtgcgcgcacagcggcacagaccagcgcagacgagccaaagtactcctagttggttgccacagtgcgccgccgtgacctctcgtcgtacgcacgcacgcagatattagatggttttttttttttctaatgatgtctgagttgctaacctttcctcgacggagtggtggcggtcacggtgaaggagcaagccgccgccttggggtggtaaggcttggcgcggaggaggagcggcgcggatgagggcgaggagacgaccgcggccgcggccgcggcatggtgcggggcggcgtggagcggcgtcatcgcgctctctctctctctcccggatcgacgtgcgtgcgcgggtgggactgctggggaggaggaggacgtggggtggaggcggggcgggcggaggggatttttcaggattgggcgcggagtgcagggagcctctcgatgcagctcctgcacggcggcacgcggccggtcgctttctcctcgcgaggctcgagagccgagacgcgggctgaggctgtcaagggtcaaaccgcgcgccgctcggtggcggtggccagatcattcgcaggtgcgccgtgcacgtacgcagccgagcagccggcggcacagttttggttggcttcgacttcgacgacatcttctcttctgcccattctgcgcgaccgtgcgatgctgctgtgagagtgtgagagacccttcggcaatcggcagttcgcctgactattatcgggcttctcctgggctacctttgaagtcaaagcgtaaaaaggcccatgttcatcccagtcttctttgccttttgttttcagcaaaatctaaaccgagtagtctctcgatttagtgctaaccagcgacgaaacaattatgagaaaaagtactgctacacgtgttagcgtatatgctgtttttcctcttagacatgcatgtctttttcttcctttttataaagttttatctcaaattacctatccgatctacaatccaattacactattgtcttcgttacaattaaatcttcacaataagatcttacacgattatattacaatgaaaaaatatttatatttgtaaattacttttattatatgtgtaagttacttttatcgtatatataagttacttttatatttgactaagttacttcttagacatataaaagtaaatttaataaagtctaaaaataatttacatatatattataaaaatatctaaaaacaaaacggaagtaactttgtcacgacattagaagtagattcgttgtagggataaaaatatgactttatctagatattaaatttaatcagcacagatcaacacacgtaagtttaacaattttaaaaagtaacttcaatgttaattggaattaacttttgcatagttctggtttagaagtaactctctatacatatgtttaatcaccgattgtttttttccttttatttttgtttttcatgtaggatgaaaaaagaagataaaaacctttgatggattgtaaataacactgatagaataaatcataagaattaaccatgtataagatataatcttataacatggaagttactttctaacatgtaataaattacttttaaattaataaaatgagaatatattcaatatgaatattattttgtcacatattttgagtggagtacaatgatgcaaatagatcttaaaaacaatatgtgatttaaaagatataagttattaaagagattaaaaaagatatatactattggagtacaaacaagcagtcatatccaatgaaaaaatacatgcattaaagttactttctttttttataagttacttctataatatatgtaaattacttttaagctttattgaatttacttttgtatatcgaagaagtaatttagtgaaatctaaaagtaatttagatatattataaaagtaatttataatttttcctcaaaatataatcatgtgagatcttgttataaagatttaattgttacgaacacaacggtgtaatcggatcgtagatcgtatgagtaatttaagataaaattttatttgaagtataggtggatatggtctctttataaatagagtggtagccactagctgtgtagtcacgtttgttttctcgtgcttggaaaattattattggccaatctagtcgtatatctttttttttggggggaatcttgttgtatatattatctaaacctcgaaaaaaaaacatatctgtatctcagttcatggatgaaattgtcaaatatcaagagacgagggatctaacacggagtaaaatttatttgatctcctatgcaaccaaacaacggacaaacgaacaaaaatgtcataggcacgtacaaaacacaacggacaaacttcatcacgatgagtacgactaggcacaatattctttttcaccatttagtttttttaattgatctgtgttcaaaatttgagctagctatagcaaaattcgaggagccaatataatgcacccattgattaacaatccatgcatcctacccgtttcatttatctataattaatactccctccatctatttgtgatagtcatatttccaaatctgaaaaatttatttttgataggcatatttcaatctaacaacttatcatcttaatgatttttttgaatttaatgcgtgactctccattcatccacacaagattggctacatgggtatcgagaaatgtactccctccatactcataaagtaagtcgtttaggacaatgtttaagtcaaaccttggaaatataaatcattaataactctcaagttgttgattttgaaaatacaaaaattatatgaatagatttgacttgaaaaatactttcataaaagtatacatatatcacttttcaataaatatttttatagaaacaagaagtcaaagttgtgttttgaagaccgtgtcgctgtcctaaacgacttcctttacgagtacggagggagtaaatattaataaatcgcttgtttatgaggaatgactagtagcatatttaaatggatgataagtagaatcacttatcgttggtctgtgcaccaagatgaaatatgactatcaaaattagatggagagagtagctacagcactcctcccttcgaaattgagagacataattatgagacgatgggttaaaagaagaggagaaataagccaatcagttaggagggaaagatgtcctgactcttttggctttctgtgggaaagtccagcgtgacacattgacaatagagagagcaagtgtcgatgaggtgacacaaactcttcaaggtctccgatagctcaacaaggccggcctccttggccaccacggagtcgtgtgtactccttatcctcctctactttgcacctcttctccatcattaacgaaaatccaacaacgagcaatcgtgaacgagaggtaaccattacaagcgtggaaaaacaatacagcaggtgaaaaattttcagtcgataaatattagtacccaaaattattttgtgggtttttgccagtcatgaaaactttaattttagaaaaaagaaggataaatatttcgcttgactcgtgggccttaggtgggccgagctgcccgtccacgagccggtttctctctggacccatttacttctgacggcccgcggccaggcctgcccctcccccatctccttcactcgccggttcgccgcgatctccagcgaggcggcgacccaccggcgaccactcgccggcaccccccgcccacctccggcgagcaggtaggacggagcagcttcccctcgccgcccgcttcgctcgccttctatcctcctccgcctccgacgccggggagccctggccacgccgcatccgctcgtcttgcccaccaagccacttcgccggagccgcatcccttccccagccgggagaaccgctggtggctcccgctcccgctgctctccatcggcatatctacttgtggaagctcacgcggaggcggaggtccagctctgtggcagtttttgatgggatcctgccccgcgcggcgagggtagacaggatctgtgccgctccaagattagtctcccggtctccagacctgaaccaagttgctgccatggcgtcgtcagctaaggaggaggcaaaaccgaagccgcgcctcattgtccgcctcggggtattcctcgcgtcgcaccacatactcttcaggttcgctctcatctcttcgtctttgatccaatcttgattctcctgtttctttctgtctgagacattgacattgttcaccctctgtgaccagcgctgtgtgttgtacggcgggcataatcgcgctcctcttcctcccttcgcttgccaagaacacgtacctatcagagaacgctcttatacccggtaagcttttttcttatactgctattccatgaaacaatcatctccgatgctgattgtcagacgcttctttctcattggtattagctgcaaattaagttgttttaaaatgtaggctctgcgaatacattattttctactgaggatgtccaggaagcaaacagatttgcgaagggaattgaagctgcaattggggaatcaagaggtggaacaacgtatgttattctgtatagagttcccttggttcatattctgcttccttcatagacaatgggctttaacaaaaattgcactgtgtacataatgtttaattatcatgtgatgctctattttgagtctactgttaaggggcttcctctgatgaaatacatccttaataccgcattttagttatactattgagcatagacatggtatccacataactctaaacgcaaagaagttttttcatgggtagtaacaaacgaatgataaaataaaagtcagagatatacaaagttcaggttttttatgagaaaacaatgtagatgcacaagcgcacaccatacatgcacttgagtggaaaccctagcacatgagtagaatggtggatgctgcgcataagttcagagcatcatcaagcaccgtcatgtcctttcctattgagacacacatgtaaatataacttctacatttttgcttatgaaatattaatctaaaagtaaattataagtttgtgcaatgatgatgatactctgcacattgaataagtgataataaattacaagaagtgaaggaacaagtggtataatcctatgttttccatagcttgtaagtttatatgattttctcaatgtctaattttatgcattattgtagggagatcccaaaattcatagcacaacaaacaaaaaatctgggagcagaagtgtattaccatgagttcctccctgacagcaaatgttttcatcctctgaagttctttacatccatgacaaataatatggcagccaaacccaatggaacctacaccaactttggcattaacacagttggcattatacgggctccacgaggtgatggcaaagaagcaattgtactggttactccttataattctcagaaagttacaccaaatgaattattatcacttgcacttggattctctgtcttctccctcctaagtcgagctgcatggctatcaaaggatattgtctggctgtctgcagactcacaatttggagagtactctgcggtctcttcatggttaaatcagtatcataatcctatgtttctgagtcacccagtgaatttggataccaagatctatggtgcaaatcaaattttatataaacctgatggcactgcagaaaaggcagaacttatggctttcaaacgtgctggaacaatggctgctgcactcatatttaaagttggagaaaccaggaaatatggtgatagagatagtgtcacgatgtatgcagaggcatctaatggccaaatgccaaacttggaccttctgaatgtggtgcactatttagctgttcatagacaaggttttcgcgtgaatgtcgagacatttaattccttgttgagctcttcatggcttagggttattgctgaagtatttcaaaatcttgggagtttgttgagaaaaataaatcctgactggaagcttgacgtgaccgttcctgattatgtggagggtactgcaaaccttgctagttctatgtataaccaggtaattgaaatatatattgttcattcatttccatttggtctataaaaatataagttttttcaactctgttaatcccttcttgtttggctttgcaactgcaggctcttggagtgcccacaggttctcatggtgctttccgtgactatcaagttgatgcagtttctttagaatttgcaccagcatttcatcttaaaaacgagaatgctaaatcttcatttcttctcaggggtggaaggtcagtttctattgtgttacgggtgtgttattttaagctgctcttttttagagcaagtaggtagggagcgtatcctatgcacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgttacggctaaaatataatgaatttgacgttaagattttaaccctaggtgtaatacaattgaaagtatgggtatgattttttctagattttttggtgacattttttagttggtatacacgtgtgtacacgtgagggcctgtgtgcataggatatgttgccaagtaggtattgttgacatgcattaagcagttcattacttaattagagtgcatgtttacctattcaaaagtgtttgattgtcagataccagaaaactgaatacatactgaaggttttaaacaaactctagcttgtgccatttgtatgtatgtatttctctctgataaccaaagtaattcagctttgtcaaacattacctaatttcatatatctaattgctttgtgatgctcaattaattttattgtcaaaatatactattagtgagcattaaagcacatgttcgatgctaaagctgtataatctcaggcaacaaaaggctgattataaaataattctgtaactgccttggcctgttaaccttgcatattcttgtgcggaattattctggtgagaggtctgattgcatgtcagcctcataacagtcaaaaatttgctaggtctgtccttatgtcagtatgtgtgtctggattattccatagtaggatttgctaatggcattagcatactgtgatcttatccaatgatagaacatacaatttaacttatttcaagaaaaaaaatggaaacgataagggaagggtactgttgcctttgcctgaatccaagtttgccaaaaacaccagtgtgtgtcaatgacatgccatacccgacatcacctgtcattgtcgcaacacacggtattttcatatagggcgataagggggcgggcaatggtatattggcgtttcccccaaattgatgaagttttggactgaacttaacaaaggagcaggatcacaagacctctgacttatcatattaaagggttcactttatttttgagtaaaatacacctgctgcattttgtagagcagatgcttagcacagcatttatgttgatctcaccacaagattatctaaacatgtttgagaatgccttttgttcaggttaactgaaggggtggtgcgctctgtaaataacctgctcgagaagttccatcaatcgtttttcctgtatttccttacagccccaagcaagttcatttcagttggtgtatatatgattccgtttgcattactcctggcacccctcccaatagttgctgctgctcttgctggtggtagtaaaaccaaggggaaattggaggatgaatgtaaaacaaagggtaatgctgatgacctgcaaatggagggtggatcgtggaaatggcttaaatctgcaagagtactacttatcatccaattttgggcagtacttgtttctttactcccatactacattagccaaattcctggtgctatgccaatacagtatgcagtgatttgggccgttctctccatcactatattgatcatcctgtatgcaatgtttggctctccatcccgtgctggtgtggaatggaagcttctaaaagctacgatgatcacttccatcaccataggaatggggcttatgtcgatcataaattttgctactgctcagcttggggctctgatattgatcccaatgtgcttgttttctcgaccgctgagggcacagctcgagatgaatttcctacctcgcacagtattgttggcctcaaacatacttctcaccgtcttgggtttccctccagctgcatttcttatcatgaaaggtctatccaagggatcatggacagtagacattgttggtgatttctggctgtggatggagttcttgtgggaatggagcagcgcgacatatctgtatgtatttcttgtccatcttccctgctggctcttgtgcatccatgtgttgctgcatccatgctaccagcctgaatcaaagatgaagcaggagtagcgtttgtttggtcacgcattgctttgaggttagagaacactgcaagtctgtaatagatattcctgattttgggtgtgctttggttgccaacatcttgaaacgagccacttagttttgtatgcaggactagcagcttagaaacatcgatgtatttttgatgtttcttttgaaagaagcacggatgggatagtaaagcctgcttatgtatactatagtggtggtgtttgttgtgtcacactactcaaaccactgacatttagtacccataatctataccctttaacgtgtcctttcctgtttcactattgactcttctttgaacgaaactattgactccttctcaaattagcttcgggatcagatcattcaactaaagctgtcaggccgggtaggcttatcggaacattgggggttccttatgttgtgactgagcagatatgtctattgtgcccggcaaaaacggatttgcaaggccaaaggctttctcattcggaaaaaaagatcacccctttcaatctaagtgacggagggatcgtacaattcgagccttttctttcatgctttttccggcggtctggagaaagcagcaatcaatagaacttccctaatctacctacttgttcaataaggaaaatcataatactacttagactaaatatatgcttattaattgatttaataagttagaaacttagtttgtctacgggctcttggctagttgtagaaaagctggtggaacgtgaatgtggccattttgtaccactccagtatttactactactacatacatcctttcttgtggacatgcagtggcttggaatgccacaggttgataggtgatgccattcaggttgaatgtgctccgtgcataggccttttggttggaaatgtgaatattatgtgcttgaagtgcatatgaagtgtgctagacatgtgcacgatgattgaagcacagaccagaccaaagcagtggggtgggccaggcggcctggtccgtctgggactggggaaaggattacgggtgagcccaagcaaggctgggcccggcttgggcttggtgggctagtgggctcggtttagtttgatacctcgattatccaactctttcttgttctgttttgttttttttccttgacatgtctttcctgtgaagaaaaggggcgtcagtctcgtacagttcgctaggctcatcaactccgtttggcaccatgctagattgctaggctaaaaatatctcaggccaaatgctctctccgctcgccagaagccattttcatagtcgtgacgtaaatggtcaacacctgacagacctttttgtccatctacgtcgaatctaaaaggaacacatcgtcacagcctaatagcctatcatgaactcaaattgtgccaaggactatactatagtagattaatctgcaacagaattcacctatcctaccactagtccgtaatctatagcgatagatcgagctcgcattattgtgtcctccccgctagtggcggtaggccccgtccgccatgcaaggacgtgcatgcgcgatcgcctcgcccggcggccgccatgcatgcggaggggacgcgcgccccttgggcgacgccgcgggtcgctcatccctccactcgccgctgcggccgcggccaatgttggtgtcccctcctctcctctcctctgctccctacctgggcgtgtaccacgtttgacgcctcgctcacaggaggccatggcgacagaagcggcgtacggtgacgcgcgcgacgacgggtgggtgcgtgcgatgcgcgagcgcgacggggtgacgtacggatgggcgaacgggaccggctcggctgttcccgtgggcggcggctgcaggaatgcagcgggaaattggaagcttggaacttatgcgttggttggcctcgtggccattgccgagccgcgacgacgtcattatatatccatcccaaattcccagtggaacgcgatggaagagatcgagtaggagcgtgtgagggttgagaaaactttgaccccaccttgtttgtttgtttgttgttaatttgccaagtgtacaacttaaacaaatctcgccctcggatctcacattctccgtttctcactcacccgtggaggagttgtcagtagcagttttccaggcgatcgagatagaacgcttgttgatttcttatcttgagatcttccgctgcaatcatcgcatcagcgaaagatatacgcgtactctcaccgtaccaccttgaaacctgcgatatgtgcgtctcttgatccgaggaaatcaattcaagaaacgtactcctagtacactatagtggtactgcctgcagtgcaagcacgtcaggttcagggggcagagacaggcagtgttattattgcacacactgatatttcacctattttacgactgcaagtgctacagcttccaaactgagagctgttggatcgaactgtttttgtccggcgctgaacctctttctagcgtggacccttggcgtttggctttgtagaaaccccgaactctgatcgatcattgatcacagttaaattgcacctcaccagaactcaattgtgtcggttcagcagtaaaagcctactactgccccccactccgtcatgcgaatagcaacgtgacatctcttgaagttgacattggaatcaatcactggtgtgaagttaggtaaaatgcacggcttctagcttttattttggtgcccaccagttacgagcatacgaagttgtgcctcgctccgatttatacacagactctgtttagattcaaagtttggggtccaaacttcagtcatttttcatcacatcaacctgtcatacacacaatttttcagtcacatcatctccaattttaaccaaaatttaaactttgcgctaaactaaacatagctgtagtacatgttgatcggtcaattcgattgccacattgtaatttattcgtgtacagtgacatatcttgaaatggacactgagtgcaggcatttatttatccaatggaaaacagaagagtcgttctcacgttggttatgtcaagatcaaaattcccatcgccctggtccacagcgccgtatatcctcgcgaaaatgtgtgagcttttctctagagcaaagtcaacttctctagataaccagaaatcaaatatccaaacacagaaaaaaaaatctcctgttcttaaccctgatggattgaagcttgaaattgatttttttcccctagaactatcctatgaaatgtttagatttacgatataggttgttatattttgaaacggatagagtacctcaaatgaaatcattctctgaatatatacatcaccgggaagacaattcttgcattgcatctagagcagataataacagaaaacatcatcactctgctcctgtagatggcatgtcccctggcctgtcatgtcccctggagaagatatgggcaacggccctaccgtaggtggctgcgtgcatcagcgcgtggaaatgaggtgttctagttgcaaggaacggaaaagaggctaaacagctcaagcagaagttgaaaagcaaacgccttctgccttccagactccgagttcgttctgaccctgacttctctgtacgccacgcacactgaattaatcgcagcacaccggaaaacatccccgtcctgcgtgctgcctgcccatgattctgcatgcgaagctgaccacgcaccagaaatcaaaagcaaaaagaagccattttgcgggccttaatatgtgccctgtgacttacaaatcaatactaaaatttaaaatttaaaacattgtttttgaagttaagaacatatataaaaaagatgccattgattttgattttttttcaacgtattcttttaaacattggatttttaagtcgttaagaatacatatataaaaattttacttgtaattttttttcgctaaaaaaccattacggtttataataagtcgtaagcaactgaggggtggtattgcacacctctctaagttctcctgctcccaaagaaaatataattccaacgccgacgacgactccatttcctttttgaaaacttctttctttttttttccttttttggttttgtggcagaaacgacgccgcaaccgtgcaaatgtttattgggatgaggcaattcgacgacgtatttagagaaacgataaaggaaagcggccggccggccggctaatgctggatgactggacctcacgctcgcatggctagctcgctcttgaccggccttggcagtataagaaaatgcatggcaatgcgccaaatcaagttggatttttcatttggatctttggtcgagtggcatgtgaggatgaggctgcatgcatgttttctttgaatttttcttggggggcctagctccgaaccagctgcagggtccgttgtataattggtggtttcgtgatcgatttgccgtttggtttcggcttaaagtaatagcctctttttaatttcttgttctagatgaggcaagtcgagcccgtgaggcaataataatcaagggcttaaagagaatatgcacttgtttgtttgctcaataatctgaagaaaacagagaggattcagggtatctttatctcatggcttgctaagtctgacttgccttttgtttttgtttttgtaatgcatgtagcagttcatgaggtcataggcagtttccaactctcttctatttagatttttttttctctcaagttgtatgtcatgaagttggaaggtagtactgcttttttattaatgtgaaagaagaaattgtttgcttctgtcttgctgcttgttgtaccttggctgcctccaaaggatgcagacccttcctaaactgtacattaaaaaatcaaacagaatctcatcttgcataatcatttagtagaatctcagagaatattgtataatttatcacctggttgacagttagcattacaaaatattctaaggcaaacggctcaggcattaatatatagtttacaaaaatatatgagaactgcaaccttgcagctaagcctagctgttccatggcaaaataaaaatgtcagccagaaggagggtttacttctggctcttaagattaaaaatggcttgtgttgctctcctcctttcaatccagtgaatgcaacagtcacatgcatgactgaaccacactagtggtgtagtatatgatttgtaatagtcttctactactgttggtgcgactttgctgcaaggccacagctatatctgacctcaacaatttggagtcttctctacagtttcccagaaattttactgttcttaatcaagacatgcgagaaaccttgctccttataatatggagtagtatgctttatttcttaatcaaggcaagaagggaacagagctctgaaccattgggaaaacgaaagaaaactgcagaaagcaatggcttccatgcttgacaagcaaactttcagctcctttttgaaaaaaattatagtagttcttttgcttaatctgatcccagtcaatgtcccaaatggtctagcaaagttaggtactactagcttcttgccttgcacctgtaactctgattgctctagctgttgccacttgccgatcccaacttgagcaacctgatatcataaattctcctgctatgtccaacacacaaacactagcacgattccttcctgaaagagagcatccatagctgcagcagaagatacaaggtgttctgtttcatcccggaaacgatacaggcaatggattatcatcatgttactgtcagttggtccactcccttatcacacagtactcctacatcacagtagtacaatgtaactgggccaagtcatgaagagatcagctgcatcacatctcagaagctgataaacccatcctacctatccacttctgaccaatccaatactagcaaaaataatgcaaagcacaaagggacatatgatgtttagtctgggtggtcatttcgaatcttgcttctcctatgtaagtacaagatcgaggacataattattcaaattccagtattctaaccgcgacagaaaacaatattatgccccatgtagaggcatgtactttcactgtcttgaataaatgtagagcatacaccttttttttccctggttcttacacgaattgaattgttttatgtaaaattt

SEQ ID NO: 22474 - DNA, 2353 bp, Oryza sativa
  unsure (1)..(2353): unsure at all n locations
ttcttgtcaattatcagtggagttgttgccggaatctggggattcacaggcttgatgggattcgtgttctaccttcttgtaatgatggtggcatcccttgggcttttgctgaaggccaaattttcaattcatacatactttgacagctggaacaggattttgattgaaggagtttttggtggccttatggtaagccatactggagctgtaacattgtgatgcacacctttatttccataaaacttgaatgtccagatcattcaacatgatttacatgaacttgtatctttcatgtttaatctatattctatgttattatgaagcatgggatgatgggaagattgatcattttagaaagttgatgaatgtggaacatcccttaacaatctgttcgggtttggcattttaaccaaattgttagaaacctcctagttaggaatagtgtgacattatcatggatcttcctagctgttaaaaggtggcctggtttggtggtagaatacagatttttgatggaaggagtataaaacattgggagcttcataccctaactaatgattcacatctcaattgttactgttgactgttggtaaatgttctcaagttatacaaccacattttcttaactatatgtttggtgttgctagtattctaatatcaatataggattctattgcctcaatgtatagttcatcactagattatttctcaaatttcttcatgataatgagctttatcctgttttggatggtggcctaacattatttccttgctttttttgcagtcttttgtgctgttttggacgtatccttgatgctgtaaatattattgctattttcaattttccatatatacacaaaccatctagtatttcttattcagtataggtgtcaggcaaggtctgattcgattactagtataatggctcaccaccatagaaccatactaaagccacataactgagagtatgtaaatcattattatgtgaggccatagcatgaatttgaggtagaccattgtggttatacatttgaagatgccatataaattatataatgcatgccaatttttatgtttgagtttgtccttaacaatgaacagatttgcgtatgatattgtgcacatcttctgatgcacggcataaagaactcaactccgaagacttgaagggagctgtggggtttctccttgaactgaattaacgtgtaaccgcaccaaccctggaggactacattcgttggactgctgtcctgttttgttcctgttttttccactccacatgtatcagttatagctctgtactttagaaagatgcaagcttattaagtttaatttacaaattgatgtagaagtgaatccaattgctggcaagtatggtgcttgatcttttgaacatcagaacttgctaggtaggggacaactggtcattgatacatctattgctgcccagcgtgctgatactatactccactagtagtatgttatattgttatcgttggagctctgaacttgcatattgttgatctgatatggcaaagtaaccactacgtggtgtttgctgaggaagttttcaactagcacttcgctatcaagacgtggatctttccagccccggcaaattccggtagctgcaagtcagagggcaacctcccattccggcatccagcaaaacgttgcccgtgggggccgcaggatacaccgcgcgccaagtcgttagcgttggtgtcaatttctttcttgcttgcttccaacatagtgttcccagttcaaagagattgcttttacggcttgcttggcaagaataattgggaagaggaatgaatacaagccattttttgttgggaggagcttccaacatagtgcttcccagttcaaagagatagcttttacggcttgtttgccaagaataattgggaagaggaatgaatacaagccatttttttgttgggaggaggaatgaaatgtttcttgggagttgggaggaggaatgactgtgagttaaggagatttgggtgttctgaattcacactctgctgcagacacgattaggagatcgtgcattgccaccatcgacgtctcactcgtaagagcatccgtgtcttatagcaccaggctagttagttgtgcggtggcgctgcggtgcacagaggctttgggggaagcagagccatggtccgggaagagaagcttgactttgtgctggtgccgctgggcctggccgtgctggccgtctaccacctgtggctcctntacgccgtcctccgccaccccacccgcaccgtcgtcggcctcaacgccatcgcccgcaagcgctgggtcaccgtcatgatggccgtcggtaccaattgattct

SEQ ID NO: 22475 - DNA, 3050 bp, Oryza sativa
tttcatatattattcttgtgtatatatattccattggtaggtgaatagtcgtttccaatatgtgccaacaaaaggcagtaggagttatttgaccagcctccagccataggttgctagcctatagtacaaaataagctaggcaaagtgtaagctaagcttctagatagatgagcatcccagcaaatatgccatccgaacatccatcgagaaaatagcggctagcagaagaaaaacgccctccagtagataccctatcccaccctccaaatttaacgcatcatctatccgagagaaaaaaatgctaaatttggcattcctctctcctcacgctatcctgcaactgccagcacccagaccaaatttgtgcccccatccggatcaattccccgtccaccgccgtcgtcgcaggtcggccttgccccatccgaatcgactcctcgcaaagactgggtggtggtggcagcggaccatcggtgggagaaggagagagatggactcgtcgggaggagggtggagagagataggtataccagaaggatagcgtcgccgcttgcatccgtgtccgtcggccgccgcctgcctcctccgcgctcgtcggccgccgctgccgcttccgcacccgccggctgcctcccgccgtcggccacttgcgccgctcctccgccccttgcgccactcgtaccactccttcgatcgcaccggccctcgcccagccgttcttccgactgcgtcgcccctccgatcagccctcgtcctccccgtcctctcggcaccggcggtagagaagagataaaggtgggaaagattttttttttttagagtggtgataaataagtggtagttgtaaaatattagtaaaatatatgatgttggtatataaaggatgtaatatggatgatctgttaagtgaaaagtaatatggagtagaaatctttttggatgactatctaaatgggagtacgaaggatgaaatttagatgagctgctgggatgctcagataaccattctgtggttcatgttaatggagacaggaattgcgctttgttggcggattcaactactccctctgtatttttaactaacttcatatatttagaagtatgcactctatgtggtttgtgagctttttcactagcgacagccacgccacaggattcacaggaatagtgtgcaggcatctgctatcatataggatcctaagatgagttattttttaggagtcgtgcaaaatgtctagtcgcctcagaaatggttgtattccaagcgtcgttttccgttggatatgagtaccacatattgctacaatgcatgtccttgttctgctttcaatagtcaagctatcaaatgcgtccacaatctacttctctccgggcaggcccttgctaacacatcctccaggctccccaacgaatgtagcctttcttccagctttagtttcacagccggaacttgctgcaagtaacaacatgcccatgcttagtttttttttttttcaaatgttgatcattcgtgaagaggaggatatatcacttgtttttagtttcaaacgtttatatggggttacctttgatatccagagaatgtagagggctgcaagttcagattggacacatgcctcaccaaattcatcggcaggggcattcaggcagtctgacaggaggtatatctcctggactaggaagagatccaccagcgatgtgcctgcagcacactctgtttcctcactgctgagcaagaacttcatccaccattgtgagaggaacctacgatggatccacaaagactacaccaacacactagcacaatcaacataggggaacaacattcactagaaattatggcactaacataaaaatgtcacaatcatgatgggcaaacttcaaacctctctcccttggtagcgcctgataagtttctcattccacgtcagttcctcctgtcagatgcgattactcaagcgtcagagtaatctgtgtttctcaaataaaatgaaatgcacaggcgagtttttcctttgtacaagatgtgcaatgaaaacagagggaaagatggcacaaggggatccatagtgaagcaggtatagattttaatgaaatacgacataccttccacagtaaatgaacttctgacttcctatcaagggaatcttctgtgtcctctacatggcaactgtctagtaatgcaagcagtagggactgcaaacaatcaataaaatgacatgtttgagacagctcaaacgatatgccacaggttgttcaatatgcaaatgttgagtgggatacaagtttgctttggaagtagtaattagtactagctacacaaataagggcagggactaacccgtcggtagtgaaaacaacagttgtcagcgacatgtaactcgttccatcttgttgatttctttaactcattcagaacctttaacagaaattagatgctgatgaggataagcatgaactgataacagacaggcagaaattttgtagggtttttgcaatataacaaaagtcctaacctagctaccatggtggtgctcagaagtttgcacataagattaagaaaagtggacaaagaatttttagcagcttgattttcctttacccatacctgttctcttgtcatgtagggaataagccagcagcgatgcctccacgcacggtagttcatctttgatttctgcataaaggatcaaactatcttgttgtacactgtttatcactacaagtgtgaaatgtcaaagtaatttaataaccacccggcaaaaaaaagtaatttaataaccagttaaataaggaactgtgtgaaatgctaatatgatgagttcggataattatctgctaggaaatgaaggttccgtaaagtagatgggaataattctattaacatcccaaagaagtaaatatttataagtatgacctctgctatctgtttcactagtacagattccatctctataagctccgacacatcctggttgtgctctgaaaccttcttgatcacccatctcctgtagtaggcaatcaatttaaagtttaaactgtaaactgtg

SEQ ID NO: 22476 - DNA, 2206 bp, Oryza sativa
tattgcagccttgagcactgccctatttgctagacagcacagattttgcatcagcgtgtttaagtgcacacggttcctagttggatttgtgctagcggtgtctgttggatttcttagcgccgtcaaggcattaggtatgctatggatcctcggatcccaatttcctcgtgccgagtaggagattagggtggtatatgtatacacacaatctctgtactctcgtatgttaagtacatgtgtagatctgattgtgttagaaccatgtaaacatctatgtctcatgctgaggactagaaaggtctgtctacacatctacgtctcacggcaatatgattggagaagatgtgatagaatgacttaatatgatatgattggagatgtgttaaaatcgctagtgtgcttgttctttatcttgcttttaattaagttataactagaagtggccaagatagggcatttatcaagagtagggctggaacatataatttcaataaaatatagtatttgaaattccagctaaattctagtgttttttgaaagaaaattgcgacgtgttatatataatgggccaagactggcaatatggcattcaatcagttgaacaaaatattaatacacaatgtctgctacaggaaagagttgcttcagcagtcgtgaaaattatagtttttttttcttcatcagttcatcaagattcaagaacaaggttctccagccttgcccttttattccttctcatttctcaagatatcaaatataacagacatactcctattagcgtctacctttactccctccgaagaatcagcaagctgcatattttttagggggaactacggcgggtgtttataccagcctgaactttattaattggctaaaaacagatttttacaatgaaagatattacagggtcggcaagctgcatataacgtagcatcatatcaatccactgttcagagtaagccattaaacagtatacaagtccagtgattacatacatatcccttctttctataaagttagacttaaagctgaaacctcagtgttccacgtcatcgctaattcttagtcgttcgatcggtggatgagatcgcatatgaaccgttcgatcgaatgcttctgtcgttgatttgattcactcgccccgcacggcctatcatggcgccgcatcatacatcggagaaaataacgtgtgcttggatgccggttccctgtcctcattttctcaatcgagtaatagcatttatgcgccttaaaaccggctggcactatcgattggtctgccatggctgatttccatataatgcagacctttaatcctctgtggcactagagttcatctttggctttttagctcacgagctctccaaatcattctacatattattcttctttcgagaatcattctacatattatttagatttaattcatatcaacttatgtaacttatgtttatgtaagcttacattgtttaagctatcttacacattatttttatttattgttataatagtaaacttccgtagcaacgcgcggggtttcacctagtataaacaagatacattgccatgaaaaagaagataaagtctgtgctagacgcccagacaagaaacttgatagtggacaaggaatataaatggtactgtcccagatgttcctttaataaagaaaaaaaaaggaaaggttctatggttcagaacatgtaagcaacacagttacaaaatggaatctagtaaggtatatgttgagtttccagtcaatggcattgaataatagcaccggacctgctatctacctcacagactcatggtagattaatttggagggagaaatgaataccacgatgaaagaaatgcacaggtggctattatggtttcattgctgtctattatatcctctattacaaaagcatatggttacttgcctagttggctacctgttcaggacgaatattttcggttggcctcgcggttcattttgtattgacaaccgcagtcttccgctgctttacttctgtattcatgggtccaaatctggaaagattaagatttgagtggtttaagtcattggccaagcagacggaaagcaagaaaatgatgtgcttatataaagatggaggagcttcattacatagtgcagcatccaggtgaagccctgaagacatggggcacagaaagcccaacatcgccccagcgcaatgaagca

SEQ ID NO: 22477 - DNA, 7040 bp, Oryza sativa
  unsure (1)..(7040): unsure at all n locations
cagtaaatccaagttttgacaagaaatgcaatattgcaaacaaacgacaaggcgtcagtcttgcaaaagaaaagaacggagtaattacatcgaaattaacatggaagaaccaacgcgattaaaattccatagtcccactatctacataattacatattgcaatatccagctccaatgcaatacataatgttttagaggaagtctctatatattaatgaacagaagaatcttgatgtagttggcaagaaaataaacttgtccacatgctacacataattcccctaattcctaaggggcatcaaaagtccaaaaaaaaaataatcaacacaaatgtatctattttgctccataatttgctgatgtattctgatgttggcaacttggcatagcaatttgaagtaaaatatcaatagtaagaatgaaatgggaacatgaattttgatccttaaccccttccctaggcatatttagttcttggacaaagttgtgtctcaagaatggggaatatgctccatgaagttttcaagtgaaagcttttagttggcgaaaatgttatctcaataatctgaactaaccaaccaatgttcgaaatcctgctggaatttattgcacatactatgcagatcaacaactttttggtacccattttttctaaatctgcaaaaagtgcttcagtagccacttcagcaactaatagtctaagcatgcagttcaaatatcacaatgtctttctaatttatcaactcaaatggcacacaaatttgaaacagcaactccaaggcaaggatgatgacgtcacaccacttcaaagttgaaactgtaacctcaaacagattgaaacatgacttccagaaactactcagtttgctaaactgcaacaaattccaaactgggcaaatcatcggattggaaaaaaaaaaacgcgaactgtggtgattaggtaccatctcaaaatcctgacagtaagctttagtcctgaattttatacaaactatatcatggaatgagttctaaacatattagataaaagaaagaatcaaacaccctgcaacaaagtttagtttagaaattttctatagattatagcatggattgacctcagcctcatgattctgaacagtttagaatacaaccttggttgaaactggacatagaccaaattgaggtaaccaataatatggtagcttttccatggtgagcagctgcacaactggacgactccaaattttactagccttggaagaaaaaaaaaaccattcaccataacctgcatctctctaaacattatgcttaagagctaataaggaaaagagacaacaaaatcaggacctcacacaaaatataccaaaacacaccaacagtccaactaattcaggggacaaaacactaaacctcatcattcattcattacgtgaatcaaacaaggatgcgcggcatgctttgcgtgccctaccagtcgccttataattaacatgttgatttgagcgtgtatatcgctggttgacatagaggctaaaagctaatcattagatatatgcagattgtggacaggatttatctagcaaaatttgacacatgcatggtggcagaatagacagtacatagtaatagcggtagcattacagcagttatgctagatgagcattacctgcagtacagatggctaaatgctaaggtggttatttagatgcctttgcagcaattaccctttccccccttgaattcagaggattgcatcacttcaagggcctttttgttgatgtagaaatgcaaggcacatatttgtctaacttgtaccatcttgtttctatgatgaattgcttccacttatacatagctgtttgaaaagtgctccataaagacaagtgtcaatactgggagtcaataaccttatggcattgaactactcaacaatatttagatcataagcatcctcccctcataatgttcttttgctgaatgtgaataaaataagttcacggcgttatttttgtggtatatgtttagattgtaaggattaatacaggcatacagcagtagttgatgtcaagtaatctgtaaaaaattaactgaaagaccaagaacaggtacaatatccaaatttaaaccaatttcaggaaataaattgaacacatatatattatggttatggaaatacaaaaaggtaccggccaataaaaaaatgatttatccgtactaaaaaacataagaggcagacaaacaatctaatctattgtcttagcaattttctcataatcaggaaatgtaaactgagcaatttccccaacaacataaacatgtctgttcagcaaagaaagttgtaatggagaaaaccaggtcagagggggagagctcgagctgcatcgctacctatctctcttgttcgctctttccggccgagccaaagccgccatcatcgctgtccacctctgcatcgctcgccctcgacgaccccagccctccgccgcgagctgcgccactaggacaactgctcccatccgcaaggccaatgccgagccacctccgcgagcacgggtggaagaaaggcatctatgtcctgcggcagaggagctggtggcgccgaggtggcggcgcaggggagctgggggcggggcgggccgtggtcgccggcggcggggcagctcctcactcctatgtgccaaccggccgcgttggcccctgtcccagcaggagaacaagggggggctcaaatgtaaaatagggagacgactccacgtcggacgtccaatattccaccaaatatcagatgcccgactgtttgtacgtcatcacaccacctgcatatgcagcatgtaaaaaaaaatcggtcggtcaaatgttccagttgactaatgagtgaaacatcaagttatataggctgaaataaaaaaaaatcagtaactgaaacattaactgaaacattatgaagatgcgcgttgaaacatatcgctgtcacatatgaaacaaccagtgttaatggattgaaacatatgtttttttcatcaaaatataatcatgcgatatcttgttgtaaagatctgcttcctccatttcacaatgtaagttattctagcatttctcatattcatattgatgttaatgaatctagacatatatattcatattgatggtaatgatgtctataatataagtcattctagcatttttcatattcatattgatgttaatgaatctagacatatatattgatattaatgttaatgaatctagatttgtgaaacggagggagtaattataaagaatacaacggtgtgatcggattgtagattggataattagtttaacagaaaaatcgttttgaaactagctaaaatgcatgcatgcatgcatgaggtggagagagaggacagagaatagtaacaattagttttgtgaattttgtgaaatacgctgaagacacatgttgaaacatgtcctattacgtatgaaacaaaaagtgttaatggattgaatcatatgattattttttattagaatataatcatgcgacatcttgttgtaaagatttaattacaacgaatataacggtgtgatcgaattgtagattagataagtaatttgagagaaaattcgttttaaatatcattaaagatgtatattatatggttggagatagagatacattttcttagataggtgcatgtgtatcagtttgtcagaggctgcccgtccaacttttctcattggttcgggggcaaaaatcacctaatctaaacccttctcacaaaactaccgctcaacgtcatcaacaaatatgtagcgtccgatttcctctccagatgattctaaccgttcgatcatctgattgactcctcaagaaagttcatttgcaatcagatcctttcacatccctggcgtagaaaaaaaaggtttactccgcccccaaaccgcgacgagattgcgggggcacgccgcacgggcaccacctcgccgcccgccaccaccgcttcctcacccgccgcagccaccgcctccacctcctcctcctccaccaccttcctagccctgctgccgcttctcgtactctccatccccgtagtcggcatccgtgcggcctcagcacacctcctccatctcccagatggccacatgactacacagtggcgctcagccacgtctcccctcccctacggcaagttcagagaagacggagctgggggtaggccggcaacgagtcgccatctcctccccacgagcccacgcctccccgcctcagccgccgcggcccaccactccggcttccacctcagattgcgaatcgcaaggtaatgagtactaaaacacaactaaatgcaaattcttgaaggtctgtaagttgggttcagaaaaggccatgcaaatgtggtcagcgggtgctgatatagaggaaatagttcaagccagcacatgcaaacaatttaacttagaagaagcaaattaggcatgcagtgaatgagatctcccatttgcttgactggttttcttataagcttgatttttctctcagatacgttgctcatatcatgatgattgccatggcaaagttatctgtctatagttccataatcaaatttcatgctgtaatatcttggaagtgcttaaatgatgaattgatgttgaggaattatatatcttggaggtgcttaaatctcatcctggaattatatatatccttaaagtcaaatacccatgtcaaagttagtaaatgtaaactttcttttctgaaaacactagaaagtgctgaaggcaaattaggaattagatatcttgatggagagcacatattggtatttccctttgttttttcaataaaattttcattgttacccagcaatcatgtaaatttgagttttactttcagacgaaacatcaaaatttataacaagttgagatattgaacatctcaacaagccatatgtgataggtcaaggcgtcaagcattatacctttccctacaatttctaaaaaaaagacttaacacaaactttaatttttagaaatataatactataattaattaaggatgtcctaagcattcaaaaagggataagattaaagctaatttccatgtcacctcaatctatttggtacaagaaaaaaatgagctctacttgatccatcttaatctggtctcctcaaaaatattaaatctagcatcctgatcgtcaagaacatatattaaaattttgggcttggattgattcttctcaaagttgttgtgtgtggtatcatgtcaagggctttgtgcgatatggtagctggcaactgaaaactgtcaaattaatctatttagcttagttcagtgcagcaattgctcatcaaagagacatgtaaagtagtaattccatagaagaagaaaattataagggacatgtattttgcagaaattaagctccatttgctcatcaaagagacatgtaaaggagtaattccatagaagaagaaaattataagggacatgtattttgcagaaattaagctccatttcatgcttacacaccataaagaagtttatgttagtttttagtacatctggagtttacctgagaacagattgcaaaggttgtatatgtgatcagtgcactgtggtaaggaacagagttaggggtgggtgctgtggttcactgaccttattcaacaattactggtgaaccttggaaattttcgctaacatatataactgtcatgtcacttcatttatttttgaatatggtttgaggaatttcagaaaagttcaattgttattttaatttttcccattgttttagtgtttatggttattgtattttttcctgttgcaacgcacaaacactttgttaatcaaatattaagaggaatttgggcattctttgtttctttagcaaggtagatatggcgttgcttgtttgtatgccagctttgaacccaataaactcccatatgacaaagacaaaattattagtcttgtcaagtcttatcccagtgaattctcaagtatgtacattatgagacttcgtttcattttaataacttcgttgaggatatgcgaagtgacaagaggttcaaggcgtaaagattggtaaattcatttaataacttcactgagagagtctttttttaagattagtgattaccgattatgtgatcgagcgtttctgtgctatggaaaagcgccacagtgataaatgtgattaaatttcatcgtttgtgctatgtaaaacttgattctaactgtacttttcataaattaagacctttgttgtatttatgtgcatgaagactttgatttggcacttgaggcgtcagaacacaaagggtaaagatcctcggtttgccactggctggggtggatctggtgtgacgcagataccccaaagcactgagaagccattgaggaagctcactcttgaggacacgcgcccctttggctgcactagcacagatttcacaagaacagagaagagtgaggagagcaatggaacaagaagcagcaacagctttggcagccaagcaagaggaagtggcgcagctcggggagggtatcctccaccactttgagcaaatcctccatcaagattccctcatgtaatcacatttggtttctccattcaaatttctccctgcacgcattttcttgtcctcacttcttgcattctgcaacacaattttttttttgaaattcaatttcctgcgtaatttggctgtttttaactctctgatgagcattcatgcagagatgaagtggggttcttgcacccgacacagttccagtcactagaacacagncagactagtaattggacattttgagtacctgaatgtnctcagagatacctgtggtgcaaagaccataagcttgccatatccacggaaatcttacctaagctctaccgtgctgcacagcatgcatactccaattcagcagcagccaaggatggttcattcatggaaactgatctgatgaggcacagcaaggcactgctcattctttgccctgacatgctcaccgcatggaactcaaggtaatgctgtcaacctatcacggtatcgctaaaagattg

SEQ ID NO: 22478 - DNA, 628 bp, Oryza sativa
ttgtcagcctgtctgtcgtacgttcttgtgggcgcagaacacggagaagaacggcgtgctggccgtgcagacgctgcggaacaacatcatggcgtcgacggtgcttgccacgacggccatcacgctcgtctccgtcatcagcgtcttcctcggcgccacggcgggaaggtccccggcgtccccctcgtcgtcgtcgtcgggggcgccgctgctggtgtacgggagcaagaccggggaggtgttcgcggtcaagtacctggccatctcgctctgcttcatgctcgccttcgtctgcaacgtgcaggccatccgcctgtacgcgcacgccagcttcctcctcggcctgccgcccgtcgccggcgagggggagggggaggcggcggcggcggcggcggtagcgcgggaggagttcgcggcgtacgtggcgcggacggtgaacagggggagccactcctggtcgctgggactccgcgccttctacgcgtcgctggcgctcttcatgtggacgttcgggcccatcccgatgctggcgtgcagcgtgctcatgtgcggactgctctacttcctcgacaccaccagggagcgcgccgccgccgtggccgggatccaccacggtcacaaggatagc

SEQ ID NO: 22479 - DNA, 708 bp, Oryza sativa
ccgccgccgactggtgtcaccgcctgcacagctggcttattatgccgctgttgttgggcgtctacatcttcacttactgcccccctcgtccgccgccgactggtgtttccgcctgcacggctggcctattatgccgctgttgttgggcgtctacctcttcaccgactggctgcctcgtccgccgccgactggtgtttccgcctgcacggctggcctattatgcagctattgttgggcgtctacctcttcaccgactggccgcctcgtccgccgccgactggtgtttccgcctatacggttggcctattatgaagccgttgttgggcgtctacctcttcactgactgaccgcctcgtccgctgccggctggtatttccgcctgcactgttggcctattatgccgccgttgttgggcgtctacgtcttcactgaccgaccgcctcgtccgctgccgcctggtgtttccgcctgcacgattggcctattatgccgttgttgttgggcgtctatgtcttcaccgaccggccgcctcgtccgccgccgactggtgtttccgcctgcacggctggcctattatgccgccgttgttgggcgtctacctcttcaccggccgtctcgtccgccgccaactggtgtttccgcctgtatggttggcatattatgccgccgttgttgggcgtctacatcttcatcgaccggccgtctcgt

SEQ ID NO: 22480 - DNA, 5096 bp, Oryza sativa
  unsure (1)..(5096): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagttcctgtgttgagcttagttgaacaaatattatgaaattttcttcacttcagagcatgactttgtagacaaaaaattactaattccttgcaggttaccagatattgtttctatggcatgaaggagtcatttggatttacaccttcctggctcttatggcttaggttggctctagtcgtaaacaaatcataatatgtagcataaacttcagcgaattctcttaaaaatatgctgctgttacttccatactaattactttgcaggtacagcaccttcatagtatgccttcctgttggtacggttagtgaggttggcctaatctacattgttcttcctttcatgaaggtaacttaaataacttagaaaggaagatctctgcctccatttcataacaaatcttgtttaaatgctcttcttttgcatgagcaatatcaggcatctgggaaatactgccttaggatgcccaacaaatggaatttctccttcaactacttctatgcctctatctttttcatggttttgtatgccccaggtagtgtttccatgggattgtacttcatttagtaattgatgctacaacctagtactccctcggtcctttaatatatgacgccgttgatttttgttacaagttttgatcattcgttttattcaaaaattttgtgtaaatcttaaaaatataaataatgcttaaatttcatttagtgttaaatcaagaaaaatatttacttaaattttttgaataagacaaatgaccaaatataatgtaaaaagtcaatgacgtcatatattaaaggacggagggagtattttttttaaggtagttgtaggaatttctgaaatgaaaacaattaggatttgataacacactgcgttgttgtttcatttggatgagtgcagtatatccacgcttgtttcgctacttgatcgcccagcggaagaaggccttggcaaaagcaaaaaccacataactatactcaagagctatctactctgatttctgctcgcggctacagctcaggttgctaccgtttcttgagcaaataagtaaaagtgtattagaatggaaatgccgaaatacagactatcttttcccttggtaaataaaaatgtacacgagtaccattttcatgatttgctaatggtgtgtcctaccaaagatcggcttttccttctgtaaataaaattgtactccatatctgtgcccaaaaatgatgtgtagattttctgctttttaaggatgaagaaggtaactatcaccatttgattcatactagatgggctggcgcggctcacgccgcgctgcacttgtggtatcattgaacacaatagacataaaacagactattggtaatgacaataaaaacacaagaacatttaaataagttcacatgctaacaaagtcttttgtctgtttcaaattacttgttgttttaactttttctaaataaaacacttgtatattctatcatcaattcctaaaaatcaacttaattaaaaatcgtaagatctatgttttagattcaccatgaacaatacttttacaatatataattcacatcttacttaaattaaacaaggtttttaaaaaattaatgatcaaagcgtttgacttagttaacagagggagtagctaagttaccgcagttataggctttatcaagcctgtagaaatcaagaaaccgctcagcaaaataaccaggtttgagaaaaaaaatgctgaattcaatttttaggcaaaatctgtaagaattcgccccatgtttttgtcaataatagagtgaaaccatgattactggaagagcaaaatcacttacgaagttatgattccctgcagacaccacatattacaaatgtagatgatgcttgtccgtctgtattcccattgcccaaacccctcaagttaaatcagagacaacggaaaagataagaagatacaaaacgacacttcttacatgacacataaaacaaaaaaaaaagaaaagaggaataaacaccacacacatctacaaaccatctctgaatcttgttcagttttctgctcctaataacagctacagtgaagagtgacatgatccatgccccctcttctgccaaaatcacaacagccttgcaggcaatgccggtgacgggcggcgttggtcaggcgaagcggttgcgacggcaggcgacggtggcgaggaggctagcgatgccctttggttcacatgtcaatgctctctatggatgctgcactcgaactcgatcacccggtgctcttcatttgctacatcattttcttcaacaaaatcaggacatatcacagatatctctttattttttctagggtaatatcacagatatatcaggggtacaccgtatacactcgtgggtatctaaaaatttatagacatgcagtaaaaaaaaataccacgtacatatcgtcagaaaggccatatacgagcaaaattcgttcagatgggctgaagggaagagtttggcgtttcagtaaaaaaaaacaattgattgattctcatataaccatcctgcaaataatacttgaaaagattgctactcttatatggcaaaaacaaaatcaacacaagaaaacatttgagttgccctgtcgaaccagaaattttcaaaaacctgctactccatcaaatgtttctgacaaaacttactaatatggtataaatgacggagggaatgagaagcaacaagcacaccaacattttttcagaacaacatagtggaaatctagagccccaaaattcctaggatggattcattatgaatagagcagcacatttttagttgctttgttgaacagagcaggatatcaaagctcctgaacggaaaactcactaaaaagattatcatggacagatttgtgctactttactgcataagaagactcaagtggtcaagaacaagaatatgactgaacacaaatttatagaacttgcaggttgcagcaaatagcaaaaaggcggttcaaacctccctaaataattcagagcttcgagtccgaataacagaagctcgatggggctcatcacccacgcatagatcagagcttggaccacgggatgcagatcgcttttgagctgctgtgtgctagattcagttcgggtcaggggcgccgagatccattgctccatccatccgccatcccatgaaaaaaaatgcaaaaggagtaaatcggtcactcccgatgtgtacctgctcctggccgcacaaactttgcagctcgagatctaggggcaagcagacaggattcgaaacaacaaattccacaaaacaaaatgaaaaccttcgaatgggaaacaaaaatggaaatgaaacaaaatcatgagccaatcgaacagagtgaaaaccttcgaatgtggcatgttgaccaagcgcttcggctgactcgaaatgattttgttgaatcgaatagcaaatgatcaatggtgtttgggtaggttacctttgcgggtgcgcttgaggagtcggtgccacgggcgaggagttcttggctgcagatggtgaggaagttgttgtcgtcgtcgtcgtcgccgaagctgttgctcgtgttgctgccgttgccacggtggcggtggtgatgctgctgcttctgggcgttgtgtttgtagtgttggtgatggttgatggcagcgatggcgttcttctcgacggggatcacagcggccacgttccacacgtccctgaacgccctcgccttgaccgtcgccacgcctctcaatgctgcgttcagatatcaagaacaagatcaatcacggtgcctcgatggagatgatgtgaatgggtggaacagcgagggcgaaccgttgccccattggcagcggcggcggtgatggtgacgatgtcgccgggaggcggacgctgacagtgaaggcgacggcggcggtgaggtggtcgcgctcggcaccgagggactcggcggcctcgacgcactgggcggggaacagcttcgccgcggacggaatggtcatgttggtgcgcgcagtgcggtcgtccctgccactgctggaggacgcggtggtggtggccaccgctgccaccgacacggcggcgtggacctgcgcgttgtgcgcacgcgtctcctcccgtcttcttctcattccctccttcagccacctccccaccgtcttcccaccgctgccgccgccgcatcgatacggctgcagcttcggcgtgctcaccgctctgcaaaacaacacattttttttcaaaaaaaaaatttgttaaattagcaaataactaaggaagaggggtaccagctccggcgccgccggcagccaccgccgcgaggtgaggaagaagaagacggagagggacatcgacgtcgaatccgacgcgccacgcgtcccgacgacaccgtaaggggaaggggagggggacaacggcaccggcctcgacgccgtcgcaaggggaagaagaagaatgttagttgcgatccaaattcatttgtacttaataaaggccagcttctgccgtagcggagtggatcatcatcccttttagggttccaccacatatatatatatacctgttgtaagccgccgtgcggcgatataacctcacctcacatatagtgaagataattttgctggctggcgcctgtggttttttctctcctgttctgagagggttttccacattaaatctcgtgtcttctgtgattgatctattgttcttcatcgtttgttcgcctatcgttccctaacaagtggtatcaaagcttgttctcatattagggtttcgcgatggcgtcgatgaagtatgatctatcgctgctagactacaagatgagattctcgctg

SEQ ID NO: 22481 - DNA, 4144 bp, Oryza sativa
atatacctcacctcacatatagtgaagataattttgtggtggcgctgtggttttttctctcctgttctgagagggttttccacattaaatctcgtgtcttctgtgattgatctattgttcttcatcgtttgttcgcctatcgttccctaacaagtggtatcaaagcttgttctcatattagggtttcgcgatggcgtcgatgaagtatgatctatcgctgctagactacaagatgagattctcgctgtggcaagtcaagatgcgggctgttctggcgcaaacttcggatctagatgaggcgctggagagcttcgggaagaagaaaacgactgagtggaccgctgaggagaagcggaaatatcgtaaggctccgtcgctgatccaacttcatctatctaatgatattttgcaaaaagtgttgcaggaaaagactgctgcagaactttggctcaaactggaatcgatctgcatgtctaaaaatctaaccagtaagatgcatatcaagatgaagttgttctcgcacaagttgcaggagatcgttgccgacctagtgtcgatggaggtacagtttgatgatgaagatttaggtcttttactgttatgctcactgcctattccatatgcaaattttcgtgacaccatacttttaagtcgtgatgaactaaccctagcggaagtttatgaagcgctccaaaacagggagaagatgaaaggtatggttcagtctgatgcgtcgtcctctgagggcgaagcattgcaggtcagaggcagatctgagcagagaacctacaacgtgtcacgtcctaataaattcatcccgaaataaaaatcattttctaaaaggaataatagaattaattaaaattctaaaagaaattggcaaacactaaaatacgtacaagaaaaattcaaatgtagcccggagaatttttgttaaattctccttggtctaaaaagagccctcaaattttacttaaattttcagagcaccggaaatatttattaagcaacaacaactatgatcaaagtttacttaaaaagaaaaacctaaaattaatccccctcctccctttgggccaagtttggcccaaagtcctctctctctttctctccctctccgtctctccctccttctcttcggcctccccttcccctcccggcctactccctcctcttctcctcctgggccgcctcggcttcgcccggcccaagccgagccgcgccttccacccgtgccgcgcacgtgcgcgcgcgtgcgcgccgttgccgcacgttgaccgcgcgcctcccgcgtgggtcccgcctgtcaggccgtccccgacctccagctgccggccttcttcctctctctcccgtgaaccttagcgttgttcctcctccaaatccaccccattcaagccggctctttccaaattaaatagggggaattaatctccattgattcctctttgatttcccccgttttcccccttgaatcgtgcccccaatcgccgggaacggacgcgccaaccccggccgccattcccgcctctgttccggcctctctcgttgccggctccctccccgcgcctataaaatggaaccccctccttccgttctccagttttagccccctcccgcgctctcccgtggccgccccacctctccccgtcttctccttctctctctctccggcgtatggccatcggggaacagaccagctgcacgttcatggaggttgctgtgcccaactcctcaaacagagactgcagccggcagtatcactttcagtcttgctgatgctcgcaagaagtttgcagattgatgatgttggattttagtactagatgtacggtaggtaactggacgctgtgatttaatttagctccatgaataaatcggacaaataagatgggagcaggggttttggtagtttgtgcatgtgagaatcgtacaaattaattaaaatagttccaagaaagctcccatgaagtgtactgtaactttatattgcattttattacaagttaggtgggccatgcatttgtaagttcaggggagtgaaaagaatttagaagaccaataattagtaatacctgaaagaaaataatccctaagagttgggacgtgtaaaacaaatatcatcgtcttgatgaagttatggagttatagttgtgggactcgttttttttacataatggattaaaccggcctctacatccaaacggatgtacacagccaaagttgtgggactcattttagtcgagataaattcaaatgacacctaaaattaaagatggccttgtgaattcttactctggaatactcggtgcagagactgagaattatttatatcaatatctttaacatcacttattaccaccgacaatatcccatatattgatgcttcctatgtctccttcctctcttccatttctgtgtttccagatagcctctgttttttttttttggtcaatacatggtctatctcgtctcttactgaatgtctatctgataaatgaaacagtacctactgcttaacaggagtacccttcatttgggaataggtggcatgaggaaataagcacattgcttttttgaggatatcatgttaggaagccaatgaaaaaggacagggacactgcctgcttttcctgggagccggccagggatattaatcgtcggagatatcaagaacacaaagttgaacacaaagttgaacaggcgtcgaatctcgcaagaggcaaagaagcaacgactagccaacctgggcacgaccacactgtaccatatctgtgactttggatcctttatatcagacaaatttgtaactaaagatgcatggcctgcatgcatgatccacatgtccaatttactaaaaactaagtagttaattttgaaaaatttcatatatgttttatcgaagttgcagaaaatttacaattggcacttttaccacagtgttggtaaatgcattttcccacgaaaacacaaccatgtgtgtgaaaacatatgtagacatcaaaataaaaatgatagatagtcaagcatctcaacaactccatcaccacagtctgcttaaccagagtgaatttttatggccccttagtgagcaatttcatgactttctgtgtgtaatcgaggacgattgagaagtaagtaaatttgaccttaagaaagatttcggacatgcgacaaacactaaaagctattaaggccattcccaacccaataactggatggtgtctatagcattaaataagctgccaccgagaataaaaaatgatgtggcaagtgaataaatgagtaaagagaagaaaccatgtcttgcatgaaacatggtttctacgtaacatccaagacatcatgtgagataaatagcattaaattgaagtatggaatagtggtgtttgcattggaaaagtagtgtctagtactagtttcttgatgatgtggagtttatcgaaactatgtatagtatcatgggtaagtaatggcctaagaagatcatacaaaaaggtgtgaaaaacaactgactactcctagttatgttttctccttgacctacgtgcatacctacgtgcatacttattatgtacatccttttcacctctccacttttttttctttcaaaaaaattaactgtatggccacctacgcaattttgacacttccaccatccattcctcctccagtttacattattcttcactagataagggttacttcccctatttgtctgcaaagtgtgcggcgacgcgggaggcgcggctagatcggcggcgcggtgtggtcgagggcgtggcacggtgcggccaaaaaatcgcgaaggcagcggaagacactactacagaagatgtaaagggtgccaggtgggaaagccccttcggtgccggtttttccaaccagcacccgtatggcagcactgattagctagggtgaaaggtgtcggttccaaaaacagcacctttgaggcgcccatgagccaaaaataaatcggctagatgcatcgagccgatgcattgagccgtcaagccaatcccatctaatacctaaatctcaaaatttcctcaaatcctcaaaaatcacattcatcaagaacactcgtcaacatcatcacattcattaaaaacactcatcaagaacacatcaacatcatattcaa

SEQ ID NO: 22482 - DNA, 1193 bp, Oryza sativa
tcatattcaaacacattcatccagaacactcatcgagaatcaagaccactcatcatattgccttcaccaccaccgccactaccgccactaacgtctccacggctgccaccgtcatcggatgaagagaagggcgccgctgccgcagcaccgctgtcgctgtcgccgggccgccgctgccgtatccccttctgccgccgggccgccaccgccatctccctcccgctagatctggtggaggggagggaccccccgccgggccgtcggaccgccgtcgcctcccctcacgccgccgacctgtcgccgccgcacccccttttgccgtcgcgccgcagacgccacctcccctcccaccagatctggcggaggggagggcgccgccgctgggccacagtatcccctcccaccaccgaccggccgccgacccaccgccgccgcagcatcccctcccaccgtgcacgccgattcagctgagggagagagagagagagagccgattcgatcggtggagaaagagagagttgagagagagagagagagggagggaatgcataaggaaaggagaggagaggagatgaatggataagattgatgtgcaggccgggggtcgggtcggctcagctctgctcgatttatttggttgtcggttctttctttaaaaaaccggcacgtataatatattatatgtgtcggtttttaatcaaccgacacctataatatattaaaggtgctggtttttattaaaaaaactggcacctatagaatatatattctatataggtgtcggtttggttttatacgatttcaacccgcggaggtgggaaaaatcttataggtgccggttttagtactttcggcacctatagtggcgacacctaattaatgttttgtagtagtgagaggacgtgagatcacgacgcatgcgcggaagaagcggcgaatttgggtaggagaaggaaaccagtatttgataccatgtagagaattatgagacgccacataacccaacatgaggggattgtatttatatagccaatgcattagagattacaacaaactcttaaataagagatctatacagatagaatagatatctaggctatacaaatctaatataactctagtattgttcaagtcatttcggaatgtgtggcatccggaaagaagcatattggaccatccagttgtgatgtatg

SEQ ID NO: 22483 - DNA, 17604 bp, Oryza sativa
  unsure (1)..(17604): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaggtttcatctcaaatttaatgtattcctttctgaaaagatcacgacgaagttttttaatgttatttgtaccttgatgaaaattactcaaagcaatccaaatcttatgagcagtttgaagataagcaacacgatcataatccgaacgagaaataccactcaaaagaatgttgcgagctttgcaattttgttcaaaaacaattttttagcagcagtattaatagcttcaggaatcacataaggatgagaaacttttctccaaagatcataattctcagccataatgtaagattgcatcctactacaccaatgagaaaaatccgttccatcgaaaatatgaggcttagttgtaaacttattagaaatagccatggcaaaaactcaagatcggtaaagatcaaaaagagcaaacgtggctctgataccacttgtaggatcgaatcacaagaactaagccaaccagaggggggtgaatgattggtatacccaaaaaccaaaaacttttagcggcaataaaagttaccctcgaaatcgatggctcgcggtctgaccaaagtagttgtaccagtctaaccacctggaacacgccggtctgaccgagatcaaagtccattcgaaccgccgagatcacctgtcgctgaccgccctagcgccgccggtctgaccgccctagcgccgccggtctgaccaccagtatatcgccggttagaccgccgaaacccagtgaaacacaaatcgaagaactctcaaagtagatgacaactttattgcttctctctgtgtttacaaagtgcaccaacagcactccttacaaaaatctcgactaaactcgaaaccctaactaaactagatctcaaaagctatacaaaagtgataccgggaagcctcacgctccccctctatttatacatgaggtaggtagcctaaagccacgaatcaaactcatacaaagagtcctaaacaccatagaaaaccctctagtacaagaaagaaactttacataaccattcgtaccaaatttggactccttccaaattcgactcagcatcccatacgcacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgatgcattgtaagacagcagcctaaagccacgaaccaaacccatactaagagtcctaatccccataggaaacctcctagtacaagaaacaaactctacataaccaatcataccaaatttggactacttccaaattcgactccgcatcccatacgcacacaatacctccatcgtatgccatatggaatctccatcaaccacgtgcatcaactctagccttagtatcccgcatgatatctgactaccacggacattgtcttaacaccaagccgactcccggaccatcaccgcaaatactctctcgaggcattgagtcacctacacatgaaacaaacaaagaaaccatattccgagaccaagctatctcccacttgactcattgttagcaaacaaacagtattacatacgtatagtatctatctagaagccataaccatgaaacaatcacagatatccaaagaaacaacccgaaaccgaaaccgacacagcgtcggccggtcagaccgcgggccggccggtccgaccgctcgatctccgccggtctgaccggcaacaccttcccggtctgaccggtcacatgaaataacagcgatttcctgtagattcacctgtgaactccaatcatctccaaaaccacttcgtgaataaactccagtatcaaaaccaataatcacagatgccaattgttcatcacagaataaaaatcaaaacacacgttgatcttacaatttcccccttgatgaacacattggcaaacccattaaaaatgttttggagtttggaacattaaaaacaaaagcggtaaaaagcacacttcgtacaaacgtacacatcgtgctcaaaaatccaaaagaaaactactccccctttttaaaagaaagaaattcccaattgaaccaaaaacaagaaaccttctcccctttttaaaagaaagaaattcccaattgaaccaaaaacatgctcttcttaaaaactcttctcttctaaaacttaactcttctccaaaagatccaaaaattttcacattatttctcccccttttgacaactccaaaagatctaaaaattttcacattatttctcccccttttgacaatgatttcataaagcataggaattatttcattaatgtataaaagcttaacatacatatagcatatcatgtcatgtgttgcaataaaaagaagatgaacccatctataatataataagcatgcattaaagtataaccatgaatcaaagattttacaattaagcttgaatcaacaataaaaattcatgatttcatacaatttataatgcaacatcttaacaagcacataggttgaaaaataaacgctaaacacatatacctattgcatttatcactctttcttaaataacctttagcacaacataacaaagagaatttttaactttttcttttcttgagcctttttctcatatttttctcttttttttattctgagtacgtccctgtcgtcaagactgtttccagggattcggcacccattattttactcacatcgaatacgtctttgtcgtcaagactgtttccaaggattcggtattcattttttcatattttattctctttttcacaatgagcaattaaagctatttgaggaataacaattcaataaaacatatatatatatagcatttagaaatcaaaccatatgcttttacatcaacattgcatatttgcttaattcaagtatagaatttaagtgtcatgcatcatctctcttaaaagcaaaatttaaatctcatgaaaagactagaatacatacaagctatgctagagacaaataaaccttcaaagtattgctggcatgcacaagaaaataccatatgtataaacaaagctctcttttatcaattttttcattgtcatatttttgcttgataaaaccatgaggtataaactcccccttaaatcatgccaaaagaaagtcataaaaagcactaactccccctcaaaataacctccaattctccccgaacaaaaatcaagaagaaatcaaagattttgaaaaagacatccaattgccaaagatatcacaaatactctcaaaattgacatacattcattagtatcaacaaaaactacaatctcaaacactagcacatgaaaagctaataatcaagaaagtagaacaatattatgtcaatccaaaagtaaattgatgttaccttgaaaagcaatcgtcatctcaacattgaacgcacatggggactatgccaccaaactacctacaaacgagaagatgtcgacgcctctgtgttggggttagaaataagaaattttggaatccaacactgagtcacacaaccagtagaaccagtagatacatatgcactaataaaatcagaaccagacttacctgaaaacttaccttgtcgtttcacaaaagtccgatttgaagtatgcgaaaaattgccccaaggccggtctgaccgccgctgtacctgcggtctgaccgggcctggcaactggtctgaccgcccgttcacctgcggtctgaccgactggacaatgtcggtctaactgtgctcctcgaattaaaacccgatttttgccaatgtcattttgcaaaagcaatttctctttcctttttctgtttatgggcaagtctaaaacaaaaaacaaccaaatgtccattttttccacaaaaagaataagtgtacttttcacgacaagtttgtgaagtagatgattctgaaattgatggttttgcattcacaacatttgatttcgatgaagatgcacttaaagaagacatgatgccagcaaatttaaacacagtgttcttaggctcagatccaatcaaaatttcacctcctagcaacacccaaaataataggaggatgtctagcatgataagcataagaatcaaaacctaaaccacgattgtgtgtgctaaccttagattgatccagaatcatgttgaggttctttttaccatcagaaaatctttgcaaagaacttttcaaataagaaaccttctgtgtaagaatagcacaatttttacaagcatccaaaagacctttttattttctacaagttgggcaagaaaacaccttatcttgtttaacaatttcttccatgtgtttaacacgccctaaagcatctttcaacttcatctcattcaaaacacactttgagcaatcttgagaaatcaaaacaccattgttttgttttgccttatttgcacatgaagcattgaccaaagaacttgcacaaaaagcaactttgtattttttttcaacacattctttgtcaaaatcaactcatcaacaacacgagcgacagcgcggcgtgcgagaccgcacgataccgtctgcgacgtctttcccacgttattttcgcacaatggctgtgcgataccgacgcgacgtctttcccacgttattttcgcgcaatggctgtgcgataccgacggtatatttgtcgtaggctctccggacctctcattatatttgagggataaagtgaataattcaagccatcaaacaaacgtaataaaacatccgacgcctcgagagaaggatattagagacattaatgggcctttagcttgccagtcaacttcagcctgagatgtgcccatcaaaccacacgaaggagacgatcagatgtgttacacattcaggagacttgtcaaatgggctaaagatctacgatacctcaaatatccttaactcatactcatatgaatcttgttcctaggatatgtactagattcacactttcttcttaagcatggttatgcatagcaaatacaaataagacgaaagcgattcaaatttacaactactttatagttacataggccgaccgaccaaatatagatagataacagagaacagcggaagcttgactacccaaccacaagcacaccgattaagggtttaccccattaagttcaagtcctagaaaaagcaatcgaaacccgcaccactcaagaagactaagtctaacctgcaagcaaaagattattccagtagcaagagtcagtaccttaatgtactggcaagccaaaaatcaatcctaacatactacatgtaaggcatatattcaaaggacaatatgtagtttaatttcagcataaagcaagttttggttcacaaatattttgtaaaggagttgattcaattaaattaacaaatttgtaagttcatcataattaacataatatatcatcatatataacaacatatcatcataagcatactcttgttgccttcaatggcacaactcttataatcatcatcactcacacaactcaacacaatttttccatttcaatcccaagtttcatcaacacaaggctatactcatgacacatcaccaaagcgctcatgaccgtgagcatggctaatcgattagttttaaagaactctacagagtttgtacagctttacccacatgatatgaacactatagtttgtttcgagtttgcaagactctaccacattcttcacgttgaatgtggtctaaaggtcataacgaaagcctttacattgtctaatgcctaaccttgcacgagcacggcaagtgtttattcacacgaggagcaacccaagtgccgctaggtcggggggccctcgccatccctagcgccatggcagcgaacacatccattcctccacgaggtacttaaccgttatattaaccgttatattggacacgcttagacgcctaggcacaaccgcactaggtagctcctataaaccatcattccgactagttcatactactactgcctcccaatgcaaggttagacattaaacaacttaataagctaaggccgtcccattcctagcacatgtggttgcacggtatacttagatggtgacacaaagttcggtccttaattgactagggcgagcacttcccctataggtatgcaactaacaccatatgcataccacttgccgcccaggtctaaaatcacacttttacaccttttaattcacaaatatcagagatattcacctctgtccagcagtgaaaattttcccctaaattctcattttaaaagtgatcatgaaattatttagaaactactaggcatggctaagcgtaaggcttttatgtaagcatgtataaacccaattgagcactttgaaagtactctaaccatttctaagtaaccatttctaaggttacaatcagtgaggatcacaattattcaaagaagtaaatgcagcaattaggtcatagctaccataaccaagtttcaaataccgttatagtctaaattcatatgcaactttgcaaacaaatatattttcattcctcaaaacatgggattcaatgtgatcaaagattgggaggagaaaacttgccttgttcctgggaaatgttagcacctaattcacttcttcatcatttacgcaattatctatataaaatacacgttatgcaattaaacaccaaaataggtaaaaattcaaaatgctctaaaatgcatgctttgtgcacagtgggtaggtactgatctaagatgaatttaggtgaaagaatttatattttatctctttttatttgtgagttatgagttttagaagtttactcggtacagggtggtatttacttaggtagtgttatgaaatatttttgcaaagtgatttttattaggtttgatttctcaggggtgtagagatgtgttttctaagactaacacatttggtttcataacttttagagttattatgaatttcttatgtattttacaagttttaacgtgttgtaggtaggtagcttctatgtgtacatggttttggagttttatgtccagtacatgtttcatattgtttgtgatgtataaaatgactaattttattaaccaatataatcttagttcacaattttagagattatattacgctactacacattttatacgctaggggagtgttctatgttagttacttaacataccaatctagaaattgatatatgagctaagtgtgctaagtttttggtggttggggatagaactatgacctctctggtctatcaagttttattttggttacttagagctagagtgcatttatatatacatttatacatatgtattgcctaacctataccatgtgactagcactgaagttatctatttaaagtttagtgacatatttagtatagaaggtgccacattttattttacctaattaaagttcattacttgctagttctaaagaaatttggttcattccatttggactaaagatgaattctctacaaattttagaagttgaagggtgctctaagttgtttattccttatataaatatttaggggcttttattgcactgtaagtatatatttttattttatatatctaaagtgctaaacttgatgattctacagaacttgagtttactcaaaaaggaagtaagatgaattttatataaatttttaaagttcagcttgtctaaaattagttattttgtataacatacatttagaggtatttggtgtaaagcaagtgcatctttttattttattttaccttagagagtaagttgatgaatctgtggaagttgagtttgcttcaatttaagttgaaatgaattctctatacattttgtaaatttgtgcatgctttatgtatagtttttcttagacaaattttagaggtgaaatttatactgcaagtgccaagttttatgtttccatattaaatttcatccttctatgagttcacagaaacttgaatcatctcaaaatgagctatatttcactttgtatgaattttacaagtttgcatgtttttctgttgaaaatataaagctctagaggattttccttagattttcagattttaagctcatggggtccacctgtcagtgagagaccaatatgcaaaaggtccctggcttttcaggaaatcaatccgcagtcctatgactgttccatgtgtgtggtagtttttacaaagtagtatctacagttttgtttcttctccacagaggtccctggttcgagctgaaacagagctagccatggctgagctcgttctcgagctttctggcggcgaacggtggcagatctcggcatgaaaccaaaatataaaaggaataggggttcttttcgaagccaatggtggtcttatcgtgatctgtggttaccggaatcaatggcgacggcagcacgagtggctttgggtctcggggtagtgatgcatgtcacgttagaggccggatctaggtggataaaatgcatgcatgcaactctagaagctccagggtgctcacagtagtattggatgaggttggcgaagcttggtcgtcgacgacggcgttcggaacggctcggcgacggcgctccttctcgatgaacggcgtcggcttgactcactacaagaagtgccatgcatgtatgtctctggtgttaaagaggtcctaggaaatgcatggaatcgacttggagctcaccggagaaagaagaatcaaagatggagctcggcggccggagttggagaagaatagctcgatctctctcctcagtgctcagatcttggggattcttgagggcatttggagaggacctcgaggggaagatgttagcgcgacggctcgaccggattcgctccacagaagccgggacagcgacgaggtcgtggcggcggcgctccgggcgcgctctggagctcccgtgggcacgatggcgttcccgtcgctgcagtggatgaaatgagatggtgtcaaaaggaaacttgttcggcatgaagattagaatacggaacgggaaatatttggtgttggcgatgtctcgacgatggggtgcggcgtccttcttcctggcggccggcaacgaagaggagagggaagaggagagctggagctctccctctcggtttctttggctcacgggtggtgagtgatgtgtggcgatgcaactgggaggaggagaaagctagagatgcagaactgggcgtccacgcgtctcggccacgcgtcgaccggcgcccagggcgtgtcccctcttctctctcgtgttcttggtcggttggagaggagagacagaggaagggcaagccaaggaggctgccaagtgggtccagggcgaagggaacaagtctggagtgagagaggtgggtaggagattgggtgttaatccattttggatgattttcaggatttgaatctctcttctctctttgtaatctataggttaatttgtgggcacgataaattcatgtggatttttctggaggtagctgaagatacctagtttccattttattttgtttctcttaaaaattttatgtggtttgcactcagaaaattggagaatatgggctcggtagaactttgtttgaatttttaggagatttgaacagagtagataaattctgtaaaaattctatttattcatgataaataacctagtattttaataaattatttaccctatacacttttatgcagtttaatgcacattatggtgaggcaggttttagccgattaaggattataattggtctatcatttaactggtttgactgatttattcgaggtatcattctaagtgttaaaattttaataaaattatagtgaattgtatgtgttgagtagagactacatgaattttcccatgattttaccttgcataaattattttcaataattagcaaggcgtttatttatataagtgttctcattatataaatgcatctaaatgtttgtaaagacttgtattaggacttgacttgaactgagttgttattatttgaattcactttcatgtccttataattacgtcacaagaatgaccatgggtttgtctagtgaagttgtccttttattcatgttcatgaacctaacatgatatgcaaaccaaaatcaaatgcacataaaagactgaaatcaaactaatgctagatgcatatgcatgtacactttttttttttgcatttttgtgctaggctgaaaaaatggggaaaaaaagagggggtttttttttaaaaaattttttttgggggggtttttcccttttttcccaaaaaaaaaaaaaattttttatttagtacaagtaagtgactcacctagtaaagtagcaatttttggctctcaaaattnaaaannnnnntnntnctattnnnacaaaaaaatnttnnnnanctacttaaaggttttantnnnnnnnttnntccacaaacttttgcatcccgaatattcctgacaaaaaattggatgaacagtatatttttaaatttaattccatttgttccatgtccaatgagaaaaaactgatacatttgttaaaatacacacatacattccctaatgatatgtattgtggataataaatcttgaagatgcaggtattcatgatggacataaaacaaaattgagctacagtgggccacaaccatgatgtctaagaggtcttccgttcgagaaaaaagtgatttttgaggtgtatgtatggaccagcgaaatccaaacttgccgttatgcccaaaggcaggggatgcgaaccctcgatgaggacatgtactaaatgtgctgagaagatgccaacaaatataagcatattgtcctggcatccaatatgtattcgctgatttcacgatcgatacaactaccagaaataaccacagcataataatccatggtcatgaatagatttagaagagtaacatagttatagttttaagttagtattgtttgtacaaatatataaataattacattgcagttttaattaactcactattccttctttactaaaataaaacgccaatgatatttcaagattgtaaaacaccaaaaagtaatttacaattaaaaaatatactttcttaattagttcttcaaggatgacaatgccaacttattcatccatgcatatggttaaatttataattttatatttattcttcaaaacaacaaatatgaagttttactttacatgctcgaaagtcaatgtgttattttattaaaatctaagcaataccaatcaagaagttgcgactgtttgttagttggttatcaatgccgtactaaatactaagtgaaaccccgtgcgttgctgcgggagtctagtacgataataataagtaaaaataacgtgtaagataactagacaatataatattatataagttaacgtggtttatgataatttaaatttaaatagtatatacaataatgattcaaatgtaaaagtaaggtgatatgactttatgaaagaagaaaaatattgagatagtttggaccgtagattaatcttctaaaggctaaaaataattgaggtgataatttagaccatagattaatcatttaagcactaaaaacaattgatgtgatatgactcaatgagagaagagagaaataacattaactaagtgaggataaactatatagctacatagcatattgtaaaaataatgaagatatatattgaaatattatgtgaattatacgggatgatgatttaacatgtttatattttaaaagctctaaaatttaacaaattataaatttatagataatataatatgtttgtatgatgtttaaatttaatgattgttagtggatgaggatgtggcatattgttagtggacaatgatgtggcatctttgcatattaaactttaggagttagtgggttataactttataataagagaggattcgtgttaaatgtagtgtgttattgattaattataatatcatggactcttcaaattttactaccatggactatttagttatagacatacctaaaattttaatatatcctaaattcggaaataataacaagaaaattgaaaatggaatggattcttcttttcagcaaagccagaataatgaaagaaaccaagacatataagatatgaaagcaatcttaatatttttaatatcaacaatattagcttgagccatgcatggggttgcgagtctgtgtaaaataaatcatgcattataatagtgtgggctctaaatttataattttgaaatccacaagtaatcaatattactccctccgtccaaaactgtagcaattttttggtggatgtgatatatcctagtgacctgtccagattcgtagtactaggatatgtgacatcgaactaaaagttgttatattttgagacgaaggtagtaatatattttacacccatcttagactctcaattttgcgctctattaattcagttctactattctaaattaataattagcaaagttgtaacttatatggactcctcttttaatataatcacacgaaagataaccaatatgtttaacataatattacaacattaatggtagcactattccacgcgctacagtgcggaatattagttcgagcgccgcagaataccctgtccttccgatttttcccttttttaccactccacctttcctccgcatcccacattttctcggttcgtcttttttgttttttaccaccccaccttctatgttttttcacttttccatctcatccatgcttcatcaatgggcctggtaaaatattaaccatccagatttttttgtttttcattccttctctatagtttttctattttcacgtttttgtaaaatatttaccatctaatttttctttccgatttttcctttttttatatctccgcacgtttcaaaagtaacgaatttactccgtggagtttttcatttactcccagcctcccacatttactcatccaaaagtaacaaatttactctcattaatgcctccacatcgtataacgcaatacctagatggtcataaaagaaatattaccagcttacaatgctagtaattctttaaccaatattataaatattgtttaaatttcgtggtctatgagtaaaataattactaccttcctctcaatatagcccatgatctcgtagccaccgtgtagtaatatgtttactgatgtgttcaatacacagtataagagactgagatttcgtggtctgcgagtaaaacaattaccaccttcctctcgatacaaccatgatctcgtagccaccgtgtagactgatactaagagtattgttaatctgtatcccaaaatagtcgtatgaatgaaaaaatttacatgctcaatcacacacaagcgataaaattactcacatatgaatcaaactagaaaagaaaaaaaatgattcagccaaaaattcatctggtggctttgctggatcttgctataaggatgaagagcatggtctgtgtcttgtgactggtagtggagagggcaaccgggtggcgagcagtagtcgatgatggaatcatggaaggatgtagcggtgtggtatagagatgagctcgacgttgggcagtagcagccatccatcatctagcaagtacgaaaaaaataaaaaaccatttttgttcatgtcaatagagacgacgagcaaaagaaaaatagcaaacaacctctgtcactggcggattccaccctatcctctgcggccagccccatggagcacgatgtgcaaatgtaaggcctgtgcagcccatcaattgagatcaggtaatattagagattgcacgttaatttgatttgcaaaaaaaattagggcttcatgtgtgaagttgaaggagagtatgcaaatataaatcagagtgtcatttccttacttgcttgttctatcaaagtcgccgacatggagcagccactggttgttgctataggcccaggtgaacatctccatgctcgttaaggtgttgcctagcgtccggcagcgaggcccgaagcagtgccttcgcctcaactaccgccggccaccgctcgccggtcaccgccatcaaccgccacggtgtcgtcgtcctcctccatggtgtatcgccgatctgtgggctgggatggtggatcaattcagatccgaaaaaaaggaaaaaaaataaagtgggttctgaaaaaaaggaaaaaaaataaagtgggcgcgagagtggttggttgggtacagaaaaaatagaatatataccggaagcagagaagttgtttttatcgaagtaaatcattgactccgataatggtaggagcacgatgcgggacgtggggtggaatcggaagcaggggagttgtttttattattgaattaaatcgtttactcgaataaatgtgggtggttgaggcgcgcgataggagtaaatcgtttactccgacaacagtagaagtgggatgacgggacgtggggtggggtgggcctaggctgatgcatgtttgacgcttggaatattagaagtagttctaacaacatttatagtatttgtaataaataataacctgtgaaatggatgggtagacaactagaataaataaggcatgatgtgcacaattttagtaagatgattgtgcacaattttatttcattcatgagtttaaactgtagtaagatgattgtgcacaattttatttcattcatctttttgcctgtggcatgatgtggccatttagcttcctatttattgtttctattctttggataactattttttatttttctaccacctaaaccctaacatatactacctatcagctcatcccatgcacgaggccacaccatcaagaagagctaattaacccgatcaatctggtcgcatgttctgcgtttatatattcgtgcctaccatacagagtcatttgttcaatcttgcttattttacattataacttcccctagctagaaacctgtgaggtgtcatctagtacagtgtgcttaagcttgtcctccatttatactgacagattgacaacaattgcataaatcaaatcgtaatccaagcttcatcctagcagctagcagcttagcttctgtcttcctactactacgactaacccagaatattgagctccaaacagaggcccacagggcataaagtgaaatgtaccactgtgaaatatggtggacaaagttttatacagcaagtgttatgccaatattaattcttccttgtgctgtttaggagtgggtggcaccagaaaagaagaaaacatggcagccgtgatactgttcatggataaatagtaggcttcagaatcatcatcgcccacaggtgctgcatagcattattgtttgatttaacttttgtagctggggtagtttcttttctccactgtgcatgccttaccgaattccccagataagctagcccaagatgcagattaagtacatacatgtaaaatgagagttattatatcatgattaattaagttttagttgttttaaacttgaaaaatgaatttatttggtattttaaagcaacatttacctataaaactttcgcatgaaaaaagccgtttagcaatttaaaaaacatgctaacagaaatcgaggtaaaatctgtatcttaatcaggttcaaatggagccaatgtgtagtgcttttagatggtgctagcagctactaccttcatcccataataagttaatctaattggccagatttatagtactggttaggatatgccacatctcgtactatattaacttgtatatggggcggacggaatagctactctattgatgtcagcaccggctttagcacattggtggacaatagaaattagtttaattagttggagattagatatcaagttgggaaaaattgtagaaaccaatatttggaactatacagtgcacttatcaaatggtaggaaataaatgcattgttgtcggataatgcacctactgtgtttagcctagtcggaaacacacagtaggaaatcgaaaacattgaagcattcaaaatctggccttgatgtgctgatgtgcatataaatcgaagaagctaaattctttttggaatgcttcaattctgatctcattgtgccgtaatactatttggaatgggaagcatccagagtgacgcaaatagaaaggatgaggatggatgtgcagtgattctgtgactgacctcgttgatcttatgattaattaggtacatcccgtttgtctaattaattgtcttcttccattattcgtatagaaccagtagttcagctactggaatttattttctctaccaagcactcacttgcactgtccattctcatctctttgtatactggaaagctttgtatactagaaagtttagataggtggaagacctgtagtaaaagggaaacaatggtcggctctaccgattcaactgggaatgagtgggattgggaaaagatagcacacgtaaatcttgagtccatcttattgtgagaaattttatgccgtggaaagaaatcgatgttcaataggaggagttaatccatcatcttaagaaaaaaaaactatttagttcgagtttttgaatcaagagatggaagaaacattttttttaacgaaccggtgagccgccaatttcatttttgcaagtctaccaagttgtaacccaaacctggattgcaaactatctacagactgatggcgaccataagttgcacacctgtactgttgatgaaaactgaatattgcaaatgctgcatcattaaacttgtggttttatattgtttcactttcgaaatatttgagtctaagtctgaagaattaacactattgactttctggcacatggatgattcacacattccctttaacttggtcttttacaccgtgggttccaatgcatgagtacatgatattttttaagctgattaattgcacgcatggtagtaaagagtaccaatcttctattatatactaaaagtccattaaacttcctacaaacgctcttaagccgccacgtggcactcctacaaacgctcctaagtcgccacatggtactatctaatctcaccgttcattttcacttaaattgatagacctgttattttacactattagattagatctattattaaaaaataatatcctcatgaatgtatgagtttgagtttatacgttacaaatgccactgctttctttccatacgtacaaacgttgtacatgattgaaaacaaaactttcctaatcttcgctggaaaaaaaacatatacatgtacataaaaatgacagaaaaaacatacattcataaaaatcaacagtatttaaaatatgattttctactatataaagataaaatatatt

SEQ ID NO: 22484 - DNA, 2111 bp, Oryza sativa
cctttttttattgtaggatgatctaaattctcttacactatatatatagtgattatatatatagtgatgtatgattcctttagcattctttttttaataacaaataagatgcctgtgcatctatgcaaaattcttttctgatttatattccggaaatgttctacaacttatattccgtcgttatagagtttgaaacacaaaatataatacatgcccacacgaatgcgcgggctacctttctcgttatctagaatgtgccatttggtaatgcacagctcaaacatcggtgcttggagctgtttgacatgtgcacacgcaatctttatatacgatttcaggggtggaaatgaggcgtgtgatttggccacgtggctcactgattatttagggttagttcatctgaaaatcagccacgtgtccctgtgcaatctcagatagtcagatcagtaacttctcgagctggcctgtcttctcctacctgattggtccacatggacttacaaaatgttgagagactccctaaacacaagatgcagcctgcagctagcctgctagctacgctctgctttcatggttacaatcctctagatacttccaagctcgtagaagtatagtcaataaattaaattaagaacacctagatcgtttggacgatctcaaaaatattaaccctagaataaacattacacagcgaaaaacgatacagcacaaaatttaggaaaaactagaagaaataccataaattggaaaataaataatgacatgttatagtgaaaaaatagttgtcaaaagaaataataaggccaagactttcttttgagaaaaatcaacaactcaagtctagagcctagatgcttttgagctaagggtacaagcggctacctacaaaaacccacttataggctaaactaacctccgaactcgcttatcttataaaccgatttcagggttctaaccctggccagggattgggccacgtggcaccacgcatagaacaccagccggattctcggctggagaagcgtgacacgtatcccacatctcctgcagccatacgatagcatatcaacggtgagaaaaaggtccaacggacgtaaatatatattgcaagtttgagatggtttttttttttacaaaatgtgtgatctcatctaaaacggtctagaacagtcaggagtggaccaaaaaaatcctataaaaagaatctaataaaaaaatcaacgagtggttagccccccaagtggcctaattccatatttttgtccctaagcatagccatttgattaaaaatcttgttagaaaaaaatccagaaaacatagtactatgcatgagaaaaaagaaatctagagtggagacccattgcaatctagagagaaaatctggaattaatatatttgaatctttgtctccattaaagataaatctggaattaatacaaagcgaaaatacgaaaaggtgttgcagattgtgaagaaaaaatagggataaaaataaaagagccaatcttaccagcccgcgagccgccgccatctcccatcccacgagacgccatcgccagccatcaccaggcaaggagagccgcctcaattctagcttcttaggatgggaagagaaggacaatggcagatctggtcagccgacgaccttcgctagcgacgccatcccctctctttcttccccttcttccaccggattcgcccgtctcaacggtgcggacctgttgaaccggccaaatccaaggaagtcgatgttggaccgcaagcaacacctccgtcggctaccatctagttttgacctataagtgggttcgcgggtgacctgcttgcaccctaattttgagcgggtctttgaaactggagctcaaaaaataaatagagaaaacaatggaaaattaaaatgtaaaaaaaatagatctctaaaattgaagctccaaaaaataaagataacacaactgaaaatcaaaatatgtaaaaaaaagggagctaaaaaatagagaaacaaaccaaaatccaaaatgtaaaatttaacagcggtgcctcctctactgtgttccttaaaaaaatcacaatgtaaaagaaaaagaaagcacccatggatatcagttgcactg

SEQ ID NO: 22485 - DNA, 2342 bp, Oryza sativa
attatgtaaagacttgcaaaattattctgatcatgtcacaggctataaattttgaagcacgccaactggcgtgctgatgatttttctagttcttacttatttgactgttttatcctttcctggccacttcgcatttccaagcagtttggtaagccccaagcagaaaggagacaaaaattgatactctaatcaatttaaaatgaaaaaaaatcatcaaccacaaagttgatcttataacgtgtatataaaatttgttcccaacggacttcatatgaaacagtttacattttaagaggcagtgacggttctcctatgaaattttttttcaacatgcggttttagaccattggtccctcttgtcattatgacaagtggatgttcttttgaccactttgtaaaatgaagctggactttttgaaaaacgatttttttaagtagtgatatcaaggtttggccaagaacatgatgaaagatattcacaatttaatcatgtaaatatataccatgaaatagttggtactagtctatctcaaaaaaaaaaagacaaactctagctacgaacctaaacacgcataagtccaggttcatagctatgattggttttttttgacacaggggcgtatgttgatacattttatctttttttagggtaaataaataaatccttacatcatgagtaatcaatgattgtgtgatgatgtaggccattgagattctcttggaaaatattttttttcagctaccatgaactagaaggtatcatacatttcagccgacgtccttctacaccaatttataccaacagattgaactgtaatataagatcaaattgcagtccaagcttcatcctatctgcttctctctgtacacctacccactagatatattgaactccaaatcaagacccaacacaacacagaatgcaaaaccaaccactgtgacttgaagtacagaggtcgcgtgtgtgtgtctctctctctctctatatatatatatatataaagtttatcaaaatactatctaggtatccacattccttcaaaatctatatattgttgttcgtactgcaagtatgatgccactattcaaccttgttctgcttaggagtgggcggcatcaggaaatgagatagaacttggcagctgtggtaatatgcacgcacaaagtgtaggccttcaaaatcatcaaactttgcttgtctcactaaactttttgttactaaagaagtttgtccatcttagtcatatcaccaattatgtatccaatggcaacatcagaaagagagcagatcagctagccgaatatgtagtgtacgttgtgatggcagacattgcttcctctgttcccagtcaaggtccggcacaaagtttagtctattttgagattaccgggttatgtcaagttggaaaggaattcatctaggaattgttagcgctagcgctgaactccgatcgaacaccttccgggcgaactgtagccgtccggcacagaaactccaagcacagctaactaacgaaaatgaaaacagagcaagaacagagtatcaaggaatttcagaacttagcgaaatcacgaacaaatgtggggcaattttctagggtttttcattcaactgaattgtaaaaccttacaagggaaaaatgaactgattgctacttatactctagaaacagaaagaggaatcctaggcctaaaatcgtgccatcccacgactcagtttctcctggactccatgcagatgcaaaatgccactccgcacgcctgacgcaatcgtcgccaccttccgcagcctcgctgccaacttcgtgcatgcataacaaactccaaacggattttattcctccagccgttacaactgtcaagactggatcacattggggccacagctgaaataaacagcaacaggaatcatgttattgattacatttgtggtgattttcttttgtgagatcagtagagacaacacacagtgtccggaaggatataaacacagactgatcgtatcacaaagcatcttgatatatcagatactatgtgctaccgagtgctgagtgttagaatgatagttcgtcatcctttccagattctgagatagataagattgaagtctcgctgctatatgtacaaacggtttcatacgtaggatcgaatcataataactaagccaaccagaggggggtgaatggttgttatacccaaaaaccgaaaacttttagcagaaataaaagttaccctcgaaatcgatggatcacggtctgaccgaaggtgttgcaccggtctgaccgcctaatgaacgtcggtctgaccgagatcgaactccggtcgaaccgccgagattgcct

SEQ ID NO: 22486 - DNA, 33018 bp, Oryza sativa
gtctgaccgaaggtgttgcaccggtctgaccgcctaatgaacgtcggtctgaccgagatcgaactccggtcgaaccgccgagattgcctgccgcgtctgttgccgccgccagtccgaccgcctcgctcccaccggtctgaccgccgccttgccgctggtctgaccgccggtgagtcgtcggttagaccgccgaaacccggtgaaacacaaatcgaagaactcttaaagtagatgacgactttattgattctctctgtgtttacaaagtgcaccaatagcactctttataaaaattttgactaaactcgaaaccctaactcaaaactcaactcaattgctctctaaagtgatatcgagaagcctcacgctccccctctatttataccgaggtaggcagcctaaagccacaaaccaaactcatactagaagtcctaaacactttaggaaaccctctagtacaagacacaaacattacataaccaatcataccaaatttggactccttccaaattcgactccgcatcccatacgcacacagtacctctatcgtatgccatatggaatttacatcaaccacgtgcatcaactctgaccaccacggacgtcgtcttatccccaagacgactcccggtccatcaccgcaaatactcacccgaggcatcgagtcacctacacatgaaataaacaaagaaaccatattccgagaccaagctatctccaacttgactcattagtagcaaacaatagaattacatacgtatagtatccatctagaagccataatcatgaaacaatcacggatatccaaactaacaacccgaaaccaaaaccgacacagcgtcggccggtcagaccgcgggctgcgccggtctgaccgcgtgatacacgccggtctgaccgacagcacatgcccggtctgaccggtcacataaaataacagtacctgtgattcacatgtaaatccaatcatctccaaaaccacttcgtaaataaattccaaatatcaaaactaataatctccaatgccaattgttcatcacagaataataatcaaaaacacctttgattttacatcataatcaatcgatatcttctcatgtttaatcttacgtcgaggttgttcttgtgtgctgctagcttagagtcttcagagccttacgtctggcatatgccctaaaggcaatcatagagatgattgtatcacatactatatttacatatttatccgacattgttccttgaaatagataactcattattggttaataaatatgtgattctttcatgagactctttatgttgtttgttactatttctaaaagatccctgatcaaatatcatatgtggaacaaatatgtttatatgatcagcacatgtattaattgatgatcatgtctcatggatcatggtatagagataccaaattaataatgtggacacatgttggtgaacatattgttggatagacccaacatgagacactgcatgagccatatgtgttgtgtcatcagtgatctcatttagtgttggtgttgaatccttagacctgagattctcatggttcccaacatgtgtagtagcttacttagggactgctaaacgctactccgtaattgggtagtaataaaagtagttttcgggtatgctatgaaacatgtagtaggatataaataatcaagatgggatttgcccctcctatggagagatatctctgggcccctcgatgttgtagattatggaagtgcatggccataccaaaggtgattgaggagtcaatcacaagttatataatatatcaataggttcgagtgaatgattgagctattagaggacggcacatatctaaccttgagcttaatcgatatcgtggcgcaaaggggttcatacaattatacactagaggttcagccgatatgatctttatgtatgcccggtgggtcaatacattctgctaggggccgctgttgacgcgtggaccaaaaaggagttttcgggttacagccgagtatacatgaacctacagggtcgcacgcttaatggaccggaatagggggattggatggagatccaatatgagcttaattcggatagggatccgaataggagtcctacgggccatggaggcccgagtaatggatcttatatattcgtgaggggtgtgatcggcggaggcattgcatcacgtgagaaaccgtagccgtcacttccctccctgagcaagaccctagccgcgcacgggtgctagcacatctgtgcgtggcgttccgtccttgtacgtgtggataccggtagaggcgtcgctggtttgcggtgctgatcggcgtgggagtatggcgaggagatcgcacgaggaggagaaggtcgagccgatgtgatcgactacttcctctacatcaacgcgcgatacttcgcgagagttccttcgacttctcagcgtcttcttccgctgcgcagcgcgtcgagtagtaacgatctatgatataataattgcatggttcctggtttacacgatataaaattttgagttatgctatcgtagcctacgcgtatcccaacatggccaccagtgaaattattctattagctaatttgtagtatatggaaagcaggtaggagtacggttcagttactgagcaccactattttccttaattgccgaagatatggaatatattttcgctaccattcactcgcttccttaaaaatatccttgccatgtcaagcctgtgactctcacaggtgcagatagatcaaaggccctgttgtaaaaagggctgaggcaaccgaaactttgtagatagatcgaaggccctgttgtaaaaagggctgaggctacccaaacttagggccttttcgttttggaggaattttaaaggatttggattcctaactgggaatgagtggaattgggaaaagattgtagacgtatagagcctgcacgagttgacaacagtgctcaagtggtggaaagaaggtaacattcagcagaagatggaaacatggatgaaaacaacaggcaacaaccgatcgtgctgggataaatcattctaaggataaatcaaaagtaataccttgtaccttatagttccatctaaggataaatcattagtaatatcttatagtaccatcaaagacaacgataatacatttacacattactatcaaatccgagtacgttcatcgatggaagaaaacagatgaacaagatctaagcctctgtttgctatgcaggatacttcatgattcttgaggaaattaaacttctcatgtgaaattcctagtttctaatataaaccattaaatcgtatatcttcagaactgataataaccccaaaccctcaactactaagtggaaatttcatttttagtagcaaggacatcttgaggatatttttagttgaatttggtaaatcatcagaattcttaacataggggagggagggtgccttttgtctgacaaaattgacattcaaccatcgtctaaagaaaattgcgaggcggaggaatcaatacctcatcgttgtcgacgccgacgaagaagaaaagggaagcgtaccgccggtacaccaccttgtagttccggtgctccacgaacgaacactgcaaccgcacgaatcatacaaatcacatcatcacgaggaagagaacgaacacccaagaaccagcacagattcagatcatataaatctctatttaggatctgtttggctcagcttcagctctcaaccaaacagtttcagctccacccaaaatggaagcggagctgtgcggagctctctcacaaaatgaactggagttgtgtggagctgggtttaggcagctccacaactccacttcagacctaactcctgaagctaaatttaagagttggagctgtaccaaccaggtttttaatggcttatatattttaaatcacatattactttttaaaatctatttacatcatatattctactcaaaatttgtgacaaaacgagatccatgcggaatatattcaaacattttattaatttaaaagtaatttatttaaattgtagaagtaactcagatatgcaatagaaataactctctattacattagaagtaattataatataagtgagttgtagcaagaaaatatgtcgagtaaattcacaagcaatgtgtacagaagattttcaagtaaatacatttatgaaagtaagttacataaagtcaaaaaataatttacataaatcataaaagtaactttgcacaaaatggaagtaagttgttacaacattagaagtaaatccgttgtatggataaaaacataagtttatcaagaaattaaacttacttagcacaaattatgaaattgactaaaaacaataataaaagtaagcaacttagagcattatgaatgtataagaagtaatttattcaaatatgaaagtaatatatatatatatatatatgagaaaattttctcataaatcggataagtaatttatgagaaaatttaataagaaggaataaaaaaggacatgcatgtgtagatgtagcagttttttttccctcagcggctcttgctttgtgtatgtgcgtggtcgaatggctttgaggtgcgtcgtgcgataagattaaaacgagaggcttcttgatttagatgttacgctaatttttctatcatatcgccaactataaaatcataagcgagaggcaatcgatattaggcgttggaagatgttcgtattggtaaactccaccctccatggcaaatctataagcgaaagaagaagtgaaatccggctacatggcatctcaaaacagtcagtattatatcaaattccacataagcaagaaggtgatcgtgttaggctaagatcaattatgaaattggagacaacaagaacatatataacaaaacgcaagcagtaattaattgcccagcaaattgaatcacaggacggaccgacagggccggttagagtatagctaactagctaggagttgagttttgcacttggcctgtaggacatcaccgcgaacaccgtctgcacgagcgtgcagaggaggaggacggcggcggcgagccaggccaatatgagccacgggttgtcgaagtggcggcgcgccacccacgcgagccagcggttgaggcggcgtccgtggtgcctgttgagctccagccccacccctcgcaggtagtgatcgccgtcggtgtcgaaggcgaggcccctcgcgagcccccggaacagggcgcacgcgtcgccgtcgttcccgagcgagtgctccatgacgcccgaccgggacagcaccgccacgtccccagcgctccccagcagctgcgacatgaacaccacgtacgccgtcacgtacgcgtcgcgctccacgccggcgccgctgtcctgctcgaacgccagcacgttgcggaacacgcagctcatcttctcgtcgatcacgtggcgcgacatggtcaccacgccccacgagaagtccacgtcgaggagcccgaaacgaggggcaggctctgaatctgacctgaccctgaaccggacgcccgattcactgtactccgtcgccgtcctgaaccgctggatgtgaccaccacccgccgccgctgcctgctgccacccggctggcctcaggtaggtgtggcacaggtcgaccagatgcttgcagtcctccttgacgtcgtcggcgttggaagccgttgggatgtgttgcatgaagttcctcaccgcattccaggccgttttggctagagttgtaccagcatgatcgacgagcaagccgaagatgctgtgcacaacgaagaacgggatctgattctccagcagcaccaagtcgagaaacccgtcgacgagcaccctcttctgcgtcctgctgccagtgcccggtccagaatcctcttcttcttctttattagcaggcgcgtcatcctgttcctggatgccaaacgcggtgagcatcgcgatcaggaaggccccgtccaccagcagcatcatgcagaattcccccgaatccatggcgacatcgccgtcgtagcagcgcctcgcctcctgctccagcgacgccatggacagcaggcactctctctgcagcgacgccgcctgatcggcgtcggcgccgagttggagcttcatcaaccgaaccttggtgagctcgttcctgcccatctcctccgtgccgtggcggtggtaaggcccaaccgagaacaagctcggctggtaagcgtcctcgtcggccagccgatgcctccccgggacgcggaagatctcgcgccttgcctccacgacttgtgcttgtgcttctttctccgcggcgtcgagacgtcggatgatttcgtcgatgcgaatgtgcgccgcctcactgccacccatctgctccccgccgttcgtcctcatcatcggcggttcagttccatctggatcaaacaattactagttaaattaatcacaaatggaaataataagaaactaaatctcgaggggaaaataaaattaactataaccaaatatggatgagtttctcgaacaacgtgaatctgagaaacgtacgtactgttgggtgaagccggagcagagtccgcggaattcgacaaacccgtcatttccacgctcaaccgcagaatttccggacgaaacatggtgtctgatgaactcaatcggtcccggacgacaagagtagtaatcaatatctcagggaagtccagatctggtaacaggtctgacgacggatgaacaccacggcttgcactgcggcagatgagctagcgatcgagtatcgaggcagccatatatggcatgcggtcatgactcatataagatgagatgatgactcatgaacatatcattctagagcttaaattaggagggaagaaattacttactaacttatccgtttcacaatgtaagaaattttatcatttctcacatgttaatgaatcttacatcaatataaatgtaaaaaatgttataataatttatattgtacaacggacggagggagtatggagtaacaaatagagtgtgatttggttctagtacgactgagcacgcgcggtcgaaaaaaaaaaagaagtggccctccaatcatcaacagctatagcagatcgttatgatattgcgaaccacatggcctgtactaccaaaagtaccgagtagctccccttcaagaaaaaagcaccaactagctagttttaaaaaaaacaaaataaaagtgtaccaattagcaacactatattaccttgttttaaaatatgtgacgtcattgactttcacataacatttaatcatttatcttattaagaaaatttgtataaatattattctttttttgacttgttttttataaaataaaatataatcttagcaaataattttacatatacacattaaatttttaaataataagaaattaagaatggtccaatgttctctgaaaacttagcgacgccgtacattgcatgcagtatttgcaaaggccaacccgatggcttgagttgaaccaaaacagcacattgcactattggagaccgggaaagctcccgtgtgcttcctactgctacatttgcatatggatacgacaagtttatgacatgccaaacagtacacatgcatcttttccaattgcacccaaaactatttgaacgtgacctttttttcatgtttatcagctaaaatttaaattttccaccttaattttgaaactgattttaaggtttttctcatcaaaatttatttttcagtttttacttttaaaacgctaaaaacacatatataaaaatttattcacagatactttttatttgtaaatatatactccctccatccaataaaaaaccaatctaatacactggatggatgtatgtactatgaatttgactactattttttttacggagggagcatatcgtttcgattgggccgttgcatggcccgacgcgacgacttgacgactcttgtcttggcattccatgcgcgacagaccacgtgcggccttagctgtgtgtccatgctactctggacgcattatcaaatgctccggatccacgattccacgccattgagcatatatatccaacataccctgtttagttcacactaaattttatccaaactctcaactttttatcacatcatatcacatccaaaacttttctactaacattaactctcaacttttttttttaaactaccaaatttctccaaatttctccccatttcagacactaaacacagccaaaaagtatgatttggacagttttgttaattataagcggtgctggtaatttggatgtggacacgataaaatctgataccacaatagagttttgttaatcataaggtgtgctggtaatttggtgcaaggagttgctgtcccactctccgagcaaggaaaaaaaaacccaaaatatatctatctattatatactaaaagtccattaaacttcctacaaacgctcttaagccgtcacgtggcactcctacaaacgctcctaagtcgccacatggtacaatctaatctcaccgttcattttcacttaaattgatagacctgttattttacactattagattagatctattattaaaaaataatatcctcatgtacgtatgagtttgagtttatacgttacaaatgccactgctttctttccatacgtacaaacgttgtacataattgaaaacaaaactttcctaatcttcgctggaaaaaaaacatatacatgtacataaaaatgacagaaaaaacatacattcataaaaatcaacggtatttaaaatatgattttctactatataaagataaaatatattacttcacacatataaatatatttagttaaattaagatctataataaatatcctatcaatgttcttttaaaccatcttctaaatctatctattatataaaaaaagtacattaaactttctctcaaataaattagagaaacactaaaaatctattatacactaaaagtctattaaacactccaacattgtcacgtgatgctctaataaaattagagaaatcctaaaaatttagagtagaaaaagaaaaccatccaacctttaattttcacttaaattagtggacccactattttaaacattggattagagctcttaaaatttccgtgctgctaatctctatcccggaaaaaaacataacttgcttacgtcgtacgatcgtctcctactcgggaaaaaaaacttaaatacctacaccatatatgatcgaaaaaagataaagccaaaaaaataaaaagaaaacatgcacacgtacatagtagtatcggaaagaaattctaatcatgaaaaatcatcagcgtcagcactgatttgttgtcaacatcctttaatctacgattttattataaataatactacacaaatatgcacagctaaacttaatcgtaaacttattgtagtgataaatatatcatgacaaatgacgccaacatgtaatagttaatgcgataataatgttccaaataatttcatatcgtattttatggtgtcaaatatcacgtgacaaatatacaacgttaatttgaatctacatatgtaaaaaattaaaataacaaaacctatagcattgttttttgagtacatctatttaggtttatttaattttggaagagattgagattctcaaagtattaggaatttttcaaaacttttcttatttgaggtgtgagaagcacaattaatagattgatgagaaaacataaattaaattttagccagtgataataaaacaatagaatttagctttggtttttaagtggatctttttaggtttattttgggtgatattgagattctaaaggtatatgaaatttttcaaaactttttgattgttatttgaggagtgagaagcatacatgatagatagatgtgaaaaaaaaataaataagattttagacagttattttgctagaatacaactcttaattcatcacgagaagtatgtattatctttgccaagtagtattggcaaaacatgaataatccaataaaatacgcataaaactacttatattatattttttgtagttgatagaaattctaatatactgggtatataattgacgaatgttatacaccacagaacccaactataaatgcactctagcgaattggttagtgtaaataagtttgtgaaaataagtacattcttagaattattaaatgagtctcatataattataaataacatatggtggaaacaaatttggcgctaaagtataaatctttatcaaaatataaataacgatacggtgttttacagattttcgtggtagtacatctctttagctatatttttttaagtagtgtcgaatgattaaccccactcatttgaaaaatatgatattgtatgtattccattaaaatttgataagtacttattactaacttcatatacacattttgtctattctctaccaaaaatcgactcaaatttttttgaaaaaaattgttttcatcacctcctccttctttctatccctctttgacatttaatgcagggtgcagtacttgctacgctgtcatatatattgtatgggcatctacatggttgagttaaggtggtgtctgtgaaagaccatcataggcaatgtaactaaagtgacatagttatcaatataatcatttgtaagtgtaccaatagtgtactaagtgttgaaattgtattgtatgatggtttttaggggcatggctacatcgaaatgcgggacctatatgttttaagccattacatacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatatgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattgtttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactgcaactgcatcaaaacattcagcatatctcttgctatcttgcaattgcaaattagttatactcgtagctactgcgcgcgcactaattgactacacaagcaaatatgggttctccttctgccaagtacttgctgtttagccttgcaatcctgctggtcctgagtagccagcagcaagctctgctgccttcggcattcgcccgccagttggttccgatgcccacgaacactgccgccggtaagaataacatcagtgttaattaccagttccatctgtatatgttttgtgaaatatcatgtggagaaactaaccactacatctctttgaacatttggagttgcggttctttcttctagcgtgtgtttggccctcccctttttaacctctactctcttatttctacttgcatgtttctcgaactattaaacgataatttttttaaaaagttatgtatataaaaaaactatttttaaaaaatattaattttttcttctaattttgataagctaatacttaattaatcatatggttacgagtccctccatttttgcatgtgcccaagaccttcattgcgaaacaaagccttaattaagtatagctagctatgtctacatactttctctatttaaaatataataattgcctcagatttaaatttatcgaggaggaattactttgaacgttttctggtttagtatatatttttttatatatattggatttttttttgaagtaacacatactcctacgtacattaattaactgtttccattcgcatgcgtgatggagcaatcgacaggccacgcagatgtcacggaggaaaagcctagcgtcccgccgtcgagcgtaacaaagatctgccgagttttacgtatctgcaaacgatcatcgtcggccgcaacatcggccaagccgtgatgtgtcaacgacggcaaatgcatgcacgcgggaataaataatggaggcaccgattaggatcaacaatatggttagtccattaaatatgtgtgtaagctcgatcgatatggaataatgagaaacaaataaacaatgagaaacaaatattcaccatgtttattactacctctgttttcaaataaatagtattgattagtgtaattttgaactaaccggcatcaaacaaaaagaaacagagagatacttgtttacgttacttcttttgtatacgtatccagccgcgatgttcggaaactgtgtaggatcgagattggcatcgatcagtaagggcatcaacaatgttactttttagctgccggtaagaagcattaaatgctcttttcctatccggtagcaagctctgtgagagtggcgaagaattaaaatctggtgataatatctattaccggtatattactaccggtgaagaagagataaataatattatttatatagtgttttaatagaactttaaaaaaatgaaagtggctgttgctgtggggtgatgctcggatcgagatgacatcgatcagatggtgaaagaattgtttaggctgtgttcagatgcagttcctaacttcaaacagtgcgcacgaaaaacgaagtgatcaattagcgcgtgattaattaattattagctatttttttaaagaaaatgataatatgattttttaaagcaatttttgtatataaattttttttgcaaaaatcacactgtttagcagtttaaaaagcgtgcgcgtggaaaaggagaggtgagtgttgagaacttggagtacccaacacagcatctaaacaatagtttcaattatccctataaactgtggcaacaaaataaattcactaaatatatatgtttgtaccgaacaaccttagaaaagactgaccagaaaagtgcatgatctgcaaggtagccaggtgcatttttagtgataataagtgtgtacttcgaggtaaattttgctacaggacgcttcgacttcgtggagttagccgtgggataccgcctgaactcatttttagaggaaaacactccataaatatggtaatttgtcaatggacaccgcacctattagaataataatttctggttgaagaggagagagaaatcacgtgaaataccaaaaatgcctttgggccaacacgtcagctctcctatctctcttctctctatcttctctcccagagggggcatcggtcgccggggcggaggacggcgaggacggtaggagcggccgccgcgggcttgcggcgggagcagcggaggacggcaaggacatggcgaagcggaggagcgggagcaccgggacgcgaagctgtgggtcgccggcgtggggtggcggcgcggccgcatgtgggacgtgaaggtggtcgccgacgtggcgacggcgatggggacggcggcgtgtacctgggtcgtggctggctgcggttcgcccgcgcccacgacctgcgcgacggggacctcctcgtcttctgctaggacggcaaagacgtggcgaagcggaggagcgggagctccgggacacgaagctgcgggtcgctggcgcggggcagcggcgcggccgcatgtgggacgtgaaggtggtcgccgacgtggcgacggcgacggggacggcggcgtgtacctgggccgtggctggctgcggttcgcccgcgcccacgacctgcgcgacggggacctcctcgtcttccgctaggacggcgccaccgtgttcaccgtcactgtcttcgacgacgggaccatgtgctgccgtgcctaccatgacgccgccagtaatataacctcgccgcgcgtcctccgtcccggcgatcgactccccctatgggagagaagatagagagagattagaagagagagaggaaaactgacatgtgggcccaagggtatatttttgatatttcatacgatttctcactcctcttcaaccgaaaattattattttaatcaacacggtgtctattggcaaatcctcttcaaccgaaaattattattttaatcaacacggtgtctattggcaaatcaccttatgtttatgtagtgtttttcctcaaaagtgagttcgggcagtgccccacgactaaagccacgaagtcgaagtgtcctgttgcaaaatttatcttacttcaaactcaggtagacgcaagaaaatatgattcagtgaggacaatacatatcaccgcaggtcaattgcaatagagctataacagctcaaatttcaagcacaaggactgaagcattactaaggacagtatgagcccagtactacccaagtactaccacgaaattcagattaaataaatacaagtaagatgcccgtgcgttgcaacgggaaattttattaagtttaaagaaattgagtgaaaatttgttaaactaccagaagcaagcagtcaacacgtacatttgtaatatctccaagcggggctgctcatatccaaatagattagaacgtatttggtacaaaacacctaacaaatttctacatgtgaaatattacacatcaacctgaaacagatgaggatgtaggagtagccattttggtcgtggaatcttgagatccatgatatgaaagagttgaattaattcaataataataaggtgttgtgttcaaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaattaggaagcaaaaatatatcaattgagtaatggatatgaccatggctggatggatgaaacaattacatgatcttttggacgatgttggtgctgaaccgccaccattgttatccattgcagaactaacttgattagaagttaaccgcaactctagaaaatcattgttcggtttcaatttagttcttcacaccaaaactggcacctaaaactgaaaatcgtacatcatgatgtggggataatgacatgcaaaagctaccagcaaagtagatgagtagactgtactgcagaaaatgaaaaaaaaaacatggtgcatgtactgaaataggtaagatacattgcaagaatgcggatttctgaacttgaactaatgttcagaatgtggttttcaatactacaaaatattcaagataccattcttataatagtattcagttttaatgtccatggtgttgtgcaacaaattataatgttgtttgagtgtccttaggcaaattagtgcaagatttgcagatccaagaatgtacaggttaagaagtgcaggccttcaagttagtagtagtagactgcattctgtatctttgctacctaattaaattgtacagataaatcctattcagggtaataggttatttcagaaatacttgccgcaaccaaaattgtagttactcaatccatgatgctaggatgcctagtgatgcaagcaacacaacatgcatggattggggatataacatcagaacttcaaacttattacatttttttaaaaaaagaagaagagcagagtccagatttgacctgttatctgaacaactccacaaaccataccaaatgtcaagaatggattcaaaaaattaaaaaaaccagagttattcagataaagggatgatggtctggataaaggaaatgcccttcattttctcatcattttatcaattttaggtcatgttctccaggcaactacacaacattgtagtgcttctatcccgttagaatggctaacggattaatagtctgaaacccctctaacaaccaaaccatgataaattctgaagcatgatatcttaatagataaagatttgtgatgaacgagagcaattgtttttattctaaattccagcatatgcaaaaaacagaaaaaataatatcttctcatatcaatcactcaaggaaaacagggaaaaaaagagagaatagtcccgcagtagttcatcattaataatttactgcccctttttgagatcatgcataatcacagttgttatgcatgccaatgatcctgaagacgcagatgaagttattactatgctttgcctgagagcctgacagctaatctctaggtacgctgttgaaaaatcatcacaatgcccagatatgcatggtgaaaaatcatcacaatccaatcagctcacatccctccccaattcatctatacgcacgctgttaaaaaatcatcacaatccaatctgctcacatccctccccctttcatcacacatggaattcagcggtttgatgcactcaccgatgcacacgaccttactcaaccgccaaaaacgcaaggatttttcattcagttaaagaagaggaagggggaagcaatggatgagtacctgcttggccgccattgccggtgaagcatagaacatgtagcacggcctgcccgctgacccgaacatgatggaggagcgggaggcctcggcggcggccgtccaggcgacctcgttctgcggcggcggggtgaccggttgctgctcttcccgcggccacgtgctcccgcctcgccgatccggcgccggcgcggtggagaagccgtccgcagggggaggtggaatgcgggcgctgggggatgggggatggggaggaaggaggatgaagcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacggtgacccagcatggcggccgctcctcctcagtcttttgctctccccaacacgcgtcggccgctcctgtatgcctatggaactaccgaactattgtaatgtgtcctgtgtggcagtgtgcctatatgcctgtgtgcagtgtgtgctgtatgcctgtgtggcagtgatgacttatatttttaaattttaagcaacgcagtgaccattgaactactgaactgaacacttatattattgataatttattggatgtgttatattaagcaaaattatattattgatgggttttggttggtttttcctaaagagctgagatcatgttcagatgttgttttgctatcgtattgcggctaattgtaatgctgccctcttattatatggactgaatacaaacttgacatccgataactttttatcctttttcgaattgagtccgcaccgattccgcaccgaatccaacgtccgaaataatccactccacatccgcacgtcatccgtacccgctccgtatccacttaagaaatagtttaggatatgatagagctattatccgtctaaatccgctccattttcatcctctccttccctcccattctctgatctagtcacaacttgctgagttgcttcttttcatatgtgcgacgggagagattggatcgattttttcttcttttctttttcatgccacagaattggatgattttttttcttcttttctttttattttttgggacaaaaaccgtgatgacgtgcatgcttggtgagcacatttttaccattatttcttaattatgtgcacgtgaaattttttgtcctttccaaaaaaaaatattatcaacattgttttgcaagataaaaagataatatttcttgcataaaaaatacaacatttcagaggtttttaggtgacaaaggaaaacaaccttcacaaacaaaatgactaaaccatcagtgcttctcaaattgtcacaaagtcattaaagatgcgaaagggcctgtagcctagtggttacaagagtctaagtatcacttgaggttctgggcaagacgcctgtgatgactttgtcaatctgaaggatagcggctattgtaagtgtttgtattgtactgtttaattctaaaaaaagtcatctatctatctatctatctatctatctatctatctatctatctatctatctatcttctatctattttatactaaaagtccatgaaacttcctacaaacgcttctaaatcgtcatgtggcactcatataaacgcttctaaaccgccacgtggcactatctaatcttaacatcgattttcacttatattggtggacccgttattttagatcgttagattagatctacacagttaattttcacttataatttagttgctagaccattattttagattacatatatatgagaatatatagatgccaacagttggccgaaaaaaaaggcaaaagtatttactgttcgtactatggaaaaggaaaatccatacacgttgatttccagaccgttgttttagattagatatgtaagtgtaataccttcctccgatatatacatacacgagaggaaatttagatgtaacagttggctgaaaaaaaaaaagcaaaagtacgtaaagtaggtactactttgtggaaaacagaaaagcttgcgtatgtacggttcgccaaaagaaaaaaaaaacgtaagcaccataaaaaaatatgccgtcgcaaaaaaaaattaaaattatatatttaattggatcttgttgtattccttttatctaaatcaactattgacatattataaaagttatattatagtcctactaaatacatcacgacacatagagccgataaatagtaattaatgttatgataattttttaaatgattttgcatcatattttagggtgtcaaatatcacttgaaaagttttttaagtagatatgatttaattttaatttttttaatctcaaagtgtttttttgaaattttccagaactacttaattgttattagagaagtgagcagcacagatggtacatggatgtgaaaaatattataaaaaatatttcaaccaatgatcctgctataacacaatcctttaatctatcatgagatatatggttatatatgtatattttgtttatctggtcaaatagtttgataacaataaaataatatgtaaaataaactactcatgatatatttttcttataattgaggaattccaacatatcaaacataattaatagatttatatcatacaccccaccgacatgactaaagtatgctcctacgaattagttattatacaagtttgaaaaagaaattcttaaaggtgtctcatatgattatcaaaaataggtgttgaaaataaaccaattgctacgctatagatatttgtcaaaatataaaaataatatagtgctacgaagattatcctggtggtatgtctctttagttataatttttttattctatcgaatgattaaaatcgcttattttcaaaagtgagtactctatctatagcataaaaaaataaaaaaaaatattttgatcatctccatttcatctttgtccttccttgaagggcaccaagcatcgataacagagtttgctacgatatcgtaattagtacgggcatacatatagctgaattgagacggccctagtggaggccaccgtcgccaatagtgcccaacttactacttagtgatgcaatactatatgagggtatgatagtgaattagacattaaaattatactccagactggtctagatgggcacagctacatcaatgcaggacccatgtttcaaggcacaaagaaataaagtcttgctggctacaatgagcttcacactttataggggcatttatgtttaattttaagatgtatcctattaattggtacaagtggtatttttagaatgtttttatatggaattggaaataagtgagacaaaaacacttaggtatagtggatatttttagtgtattaataatatattagacttattttattcgtacatatgcagtttcatttattaataggtactcaactttagaaagtgataataaattgtagtgacaatagggaagtttatatgaaaccggaacaaagtgttttttttaatttagaagacatccttatcatttaaatatattaatatatatatggtagaaacagtgaaatgtgactttttttaatcattattttcataaaacaacaaataaaatgcccgcgcatctgcgcgggcttcctttctagttaaatataacaatctagtaagccatttacaacttagttgccgaggatatagaatatattttcgctatcaatcactcacttcctttaaagtgtcctcggtacggtgtaattcttaaaaaaaagtcattaatgataacaatctaataagccatttacaacttagttgccgaggatacggaatatatttttgctatcaatcactcacttcctttaaagtgtcatcgccgtgtctttacatattgcaaagcctatgactcaagtgtagactttgtcaatctcgaggataaggatttgctggctattgtaagtgtctgcgttgtactgtttaattctaaaaaaaaagttattgaagataacaatctaataagccatttacaacttagttgccaaggatacggaatatattttctctaccaatcactcacttcttttaaagtgtcctcgccatgtctttatatattgcaaagcctgtgactatattttcgctaccaatcactcacttcctttaaagtgtcctcgctttgtctttatatattgcaaagcctgtgactcaagcgtagatagatgaaaggcccttttgtaaaaagggttgaggctacccaaacttaactgggaatgagtgatacccaaacttaactgggaatgagtggaattatgaaaagattaaacacgtatagagcctgcacaagtcgtcaaaagtacttgaccagtggaaagaaggtaacattcagcggaagaacatggaaatatagatgaaaacaacaggcaacaaccgatcgtgctaggataaatgtagttcatcaatcaagatcaggaagatgaaaatgacattgcagcctcgtgagatttgggaattatatcatggtcgatagtgttgacccaatctacacatttcctctgtttgccccactacctcatctaaagttagatatcacgatatctatatggtcagagataggatcatgcctgcttacaacagtccaaacgttccttttcccttcaattacctagacaagatgctccctctaatttaacagttctacagcattatagtactccgtatgaagtatagtagttagagtaaaaaaatggtgatcaaattggagcacacatcaattcgagttaacatgattcacatcaattgcaccctctgacaatttaagccgtagcacttattatgatctcacaatcagtggctttgtaatcttcacaaatcatgtgtaaaaaatcaaaatgaaataacatgaagaaaagtacatcgcatctttgtattcagcatataatcatctccagtcagctcatatcaataatatgtgcaaacagaaattttttatactccccagtagatgaaagataaagcaccacagagacaaaaggattaaaaactagatagttagagaatgctattctaagaagttttctccataagctggattggtgctaagatgttctgtttacttgtctctactatgcagccattcatcaccatctcttccagcatgaagtgcaccttctctagatggaacatgatgtcgagttcacactggccaaaaggataattaccatcagcttgtcccatgtgatatatgtgagcgtatttacagtcacaagaaaaataattgttgggattactgaaaaataccacatttccgaagtggcggtccatagtttccacaaaaagatgaatgaattcgagaatagctagctcattctgccaaacaaaagaaaattgaggcattttaatatgaatcaaggaaaacatggtgcaggctgtagttatgattgacatcccagaggaaaactacaatgcaaattgcaaccaaaacaagttgaaggaagatttgacttcggcaattgctacaaaattcattgagaaaccaggcagcaaacaatgaactgcagtcaacaggcataagatggagatactgagattcgtatgcagagatgtaagtatgaaatagtgttaccacacagaatcaccaatataacaaattttcttactaaagagttctatctaatgataaataaatagtaatagcgtatatcttatagttccatcaaagacaatgataatgcattttcacattactatcaattagcaaatccgacttgtgcatatattcatcgaaagaagaaaacagatgaacaagatgtaagcctctgttgcgatgcgggatacttcatgattattgagtaaattaaacttctcatgtgaaatttctagttcctaatagaaaccattaaaccgtatatcttcagaactgataacaaccccaaaccctcaactactaagtagtaatatcatttttagtagcaaggacatgttcagaaactatgagctaactgcaactgcaggagcatttcggtgccataaaatggaatttaatggcaaaatttggtaaatcatccgaattgttcaacaaagggaggcagggtgccttttgtctaatgaaaattggaaggcggaggaatcaatacctcgtcgttgtcgacgccgacgaggaagaagagggaagcgtaccgccggtacaccaccttgtagttccggtgctccacgaacgaacactgcaatcgcacggatcatacaaatcacatcatcacgaggaagagaacgaacacccaagaacctgcacagatccagatccaagaacaggaggcttcctttccccgctcccccacccaccaatccggagcccaagtttccgcgctgggcaatattggatccaagaaaacgaggaggaatcggaggggggatcgggaattggggggttaaccaaaacctgctggtcggtgcgggcgaggcacttgcggacgatctcgccctcgagggcgcggcgctcgtcgatggagaggtgctcgtagtactgggccagccgcgtctgcccctgcttgttcacgaacagcacgaaccggatccccatcgcctcgcctctcctcgcttcttccttcgctctgttccaaggctgcttcgtcttcaacctctcgacactctgctctttctttctttctctctcccgtcttctgtttgactcttcttgcccatactcgtcttcaacacaaggcaaccctcttttcgtttgccctttttactatttctaacggtggaattattttaggtacggtgttcgtaatacaattcgtatattcagatattttattaatttaaaagtaatttacttaaatttaaaagttatttttttgacgggaaaccgcaggagaggctcctactgcgataatatattaaataagggatcgacatatacaaagaaaaagaaagaaagaaagaaaaagaaaatagattacaggaaaatatattaaatttaaaagtaacttagaattaactctttgtactattagaagtaattacattaggaccgaattcaaataaaaaatatgtggagtaaattttcaagtaaagtttacacaagattttcaagtaaatacatgtattatattttcaaagtaatcactatattatttttgaaaacaaaaattttgcatcatatagaaattaactcttcacgatattagaaataacttcattattagagaaaagtaatttttataagtaactcttcataataaatacactcctaaagggaagtgactataaaaagataatatataaataactaactctactactagatagaattaagttttcacggcaactacactgctataaggaaagtaactgttatacaaaagtaactcttcacgttattgaaaatagctacactgctagtgaagtttatcggtgatatggacctggggatatcatctttacagggaggaggctacccccgaacccacatgccccccctccagggagatcgggcctggggtggagcggcggctgcccctctccagcttggggtaccgagattggagggaggaggctgcccttagacccacgttgcactttcccgagtagggtcgagcctagggtggagtggcggccgacccctcctcgcttgggggtcgggccgtcccgaccccctcggagcatcagcctactcctgcgagttgggtgggcgcgcccaccgtccacctaacagcatttaaatcagaccgaacgggcgtgtcacgccgcatttaatgcggcgtgctgcgcgcctaaccagtctatgaacggtcgaatgactgatgggactggggtagtgcgcctacgcattgaccatgtgtcagacggtgtgcagcctgccatgccccgtcacgtcatgatgatgagaggctttcccagccggagttggttcatccgctctagtcaagcagggttcccatttcccggtgcaaacaggaacccagaagtcttcacccattaaatgatgaatgaaacgggcgtcccctatgtcagccggttcgatttgaccggtcccacgaccgagatgacgtgcacgtgacttccaagtcaaggaacaagacatgcattcaatgcaaagattgtactccttcacccatagacaggttcttgggcccatgtggtaaccccttgaggtataaaaggaggtccatgcctactaagggagaggatgagcccattttctaacacacacttcagattcactatctcaagcatctacaatcttcacagattcagccaagcacaggagtagggtattacgcttctcagcagcccgaacttgcataaaccttttttgtctctatgtcttcgaggggcctgacccctctctttctctcatccatcacagggatcctcgaatctcaaccgctgcccccggccgaactcacaaagagagggggggtctcacggtcccccgctagaggagttcatcctctgacatagttaagaagaaaggttaaataatttaaatatattcaatattagacttgttttgtcatatattttgagtagagtatgatggttcaaacggatttaaaaaaaatatacagtttaagagatatacatcatcaaagattctattaaaaaagaatatatattagtgtaactatatgttagactcagtagcatgcacgtgaatctatgtaacaaccagcagataccatgtggtcctctttttctggcaagtgatctcatttctctatcacttgatcagtacaacatccacgtgttcatatcttagccattacaactgatcggacggcttacgaaagatgtttggataaggtcaaatagtgtgtgtgcactgaatacattttaccataaagatatgggttaattagattcatgccattataacctttatagttttgaaatatgccattactatttaactatttgaagtcgtgccatttagtagatatttaagaaatgccaccacatacccctccaacacactgaaatttatttttggaccaaattacctgagtcttttttcctccatcccctcctcccattctctttctggatctgagttcccggtgtaagcgtggtggagaggcccggcgagcagccccgaaggagtcaaagtgatgttgccggcgctgtgagatcgtactgccgcagtgtcgtgttatcgtgtgagccgcgaaacgccacgcccaaatcaattttgagaaaaaaaagataaagaagtaaaaaagagaaaacaatgcacggatgaaagaacacatatctgttgctgatagtcctatgcacaatcaatgtaaaacgagctttaagaagacaagaacatatcggcggaaggtgatcttggagcagccgaggtcgtcacgctcctcgcctcgcctgcgcggtgcttcgctgcagccggaggaggggaggaggatgctagttgcagctgctgctttcagtctggtcgccggtagttctaaggccgccggccaccactgaatcaagccaaccgggtgtagctccaaatccgaagagggatgggaagaagaggagtagagagagaaggagattgaggaagatgacatggaaaatttggtccaaaaagaaattttattatattaaaagggtagacagtgacatatttcaaagagtagttattccaaatagatgaatagtagtggcattttttaaaactgtaaaatttataatgacatgaatccaattaaccctaaaaatagatgctgcaagcaaaactcaacaaaataaccacaaattaagacaagtaagcacgtgtatgaagatgttcagactccatgtagacacgttctctgatcgatctgaagcccaagcagtcgagcttgtgcccaggggtcaataccggtgaaggtcaggagcaggtaaccgaggtttgagaggaagaaaatacatagtaactgcggtggagatatacaggtggtccaaactatgctactagaatgtaatgtttttattttgcatgaagttgctccagttctttcataatgttcgtattcgattaaaggtatatttttgtggaggctccaacttcttgttgtaaaaaatgattatttgccgagataaaatggtttactatttcaattataatattattaattgtaaagaagatgttttgcccttaaaaccatagagtgttctcagctccaaggctccaacttctagagttacgtttcttctaccaaccttataacaatcctaaatgacagccctaaactatgcgttcagtcttgtctaaatttaatggaaaaaatgcagcagaagattgtgagaaagtttgtttcgttttccatgcgcacgcttcccaaactatttgcaatgagagtggtgattactttactaatgtgtctctgggttttgatcctctcttgggtcggcaatggtgactcctgctcctttgggaggctgggatttctccctggggatcacatcagggatgaaaccctactcaggttccgctctcctgttcacttctctctttttctctaatcgtccgttcaccctggtggtagactttcctcactcctctttttggctttgttgctcttcggcggctctcgccctcagggcttgcattggtggttcttctggtgatctccatgtctctcatctctctggaaggtgttacagttttacagtttgttctaagaaagttggcctttggatctataatcttagatccttcacttgcaaggattatgttgctcggtttttcctctagagagatgggggccctaactggcataaggaatatgatatctggtcggcagctcaagaggctgattggacaattgttcgtcacaagaaaaagtctaagattgtttccaagactatctctagcagccgcaaatcagttcctcgtgccaacaatgctctagtgcctgtaaaattggtgttccatcggttgtcttctttcttctggcgatcaccggaggtaagatggataagaatccagttaatgtgggggcggtattttagctaggtcttctaggatttcaaattcaaaatctaaggctgaatcatcgcctctgtctgttaaagcctcttctgttagtaggcctagttgccctagatgtcagaagccaggtcatttggaatctaactccataaatagagtccgctgtgcagcttgctctaaacttgatcatcgggcttcagtgtgctggaaccaaaagtctgaaaagaaagtctgggttcgcaagcccaaggctaaaaagcccattggttcagttattgcttcttctagtcggaggcccgcaactgatagtttggttgtttcgtggaagtcgctggaggaagagcataatattttagttggcatcgtttcgtgccttaattataggcagttgcagcctgacgcttcttcttcctctcttcctctcgctctccgcccaaatccaatctatagtgctccaaaaaccccaatggccaacatcaatccggatcctactccattcgtcccgccgacgatggcgatcaatgatgcttggcttcactgtctccctcgtgcagatttgatcatcatggatgaacctcccaagaagcatgaaggtatcgcagttgccattcttgaaccccctcccaagaagcaagagcattttgtccttgtggtttactacgttcaaaacactctgggttatcatgtgttggacaccagtaggcatgcatctgagtttgcttttattcacattgcctcggctgtgcttagagatgctctagtattgggagggccatatgatgtcaatgaacagattaccctaagatttgtcaaccatgataacacctccacttgccacaattcccctccaattagagagggttgggtgatgttcttagatttccctctagacctacaaaccgacagaattgtggacaaaccagttggtacttttggttggttgctttgttggtccagtggaccaaggttcagaggcagggttcttgcgaaggtcatttactccatggttgaggaggtccctctctaaggtggtgattaagaagtactcaagctttggaggtgttggccgctcctagacagtttctgtgtttgtgcttaatggggactttgcagatgtccagcctgcagatgaggatctgccacttgtgaaccacattcccttgccagaaccatctcctgttcctcaacaagctaatgtttggggaaatgcagatgaagacataggtgagaatgatgaagtgaatgcacagatctaggaagaactttctcacaatgtcagtgctgtctcccagcaggactcaggggaatggcaaattttccctgcccatcaagtggcacctactatttctttggatgttgcaatggggccactggtcagccagactgaggaagttgtgccttcattcattgtttaccctcagttttggaaactgctcagcatttgtaggactctcctgtgtgggccaagattgcttgggcctcagcccatgtcatctgatgtagtcccataccagctgcctgtccatcatgtttttcaatttgccatgctagcttctgcattgatatgggccaaagaaaactgggtcagccaacaagttatttcagtccaaccgattcaagctatccatcctcaacacacagtttcagtgttgaatcttctcctggacccattccaacaagatgtctctcctgctctacccccaaggcccaaaaggaggactgggaagttgattttgttggattcagaaatacggagaagtgaaagaattaacaagctttctgatggatttatgtcccctgacccaaatttgggtgtgggaaagccaaggggaaaggctagggcaaagagctccaagaagcttaaaatgctggctcaagaaagtggtatcttgctctctctcaaccctttgcctttggaacttaatgatcgtattgcttaagatgatgagattgatgcccccctgctgattgttctatacagcttcaacagattggcactgatgtctgtgggatgagcagggagatggtatctgctgaagctttgactgcccatgctggaaatgggagtcactgtgctgctgctccctaaattctgccccaatgaacagtcctattttgttattttgttgccctatgttgggtctctccaagatttgtaataatgaatttgcctttaaaagctgtgctattatgatgaatgggacttctgcctggatcgtttcatctgttactcttcgctcctatgttatgcataggactctatcttattgctctttgtttgacaatgaattcacacaatagaaactggaatattttgtgttggaatgtcaggggtctcaactcttcctctcgttgtcaggctgtaaagcaaaagatagatgaaagttcttgctcgattttttgtttgcaagaaacaaaaaaggatcatttggcgccaagttcgttaagacgctagcccctaaaagatttgataatttccttttttctccttctgttggagcctcggggggtgttttcattggctagtgaagctctatgttttttggtgtgctcctgcaacaaacccaacatgttttagtggtcagtttcacttcaaagtcaaatggtcagaattgggttttgatcaatgtttatggtccctcctgtggtccccagagagatgagtttgtacagtggttacacgatcttgatattgccaatgattattggacgatcctaggagatttcaactcctacgggtctattgacaatagaaataaaccgggggacaacatgaatgatatttttatattcaatgatgtaatcagttccttgggcctgctagaaatccctctaagtggaagatcttacacattgagtaatatgcaagcagacccccttcttgaataactggactgggtttttacttcggctaattggatcagtgccttccctaacacgcaagccctagttatggccaggaatacctctgatcatgctcctattaaaattcagattgctacctccatacctaagtccaacgttttcagatttgagaattactggttgaagcagcctgggtttttggatcatatcacttctgcatggacagacattcttcacataactgatcaagcaaaactgatttctgctaaatttaagaggttgcgttgctctcttaagaaatggagccaagctatctctaagttgtctagaacaattgagaatattctttgtgccctaatacactctctggatttttccatgaattttcggagctcaagaaataattttaaagtcacaaagttcattaaactaatttaaataaaaaagaaaactaattaaaatcatccttcctctctttgggcccctttcggcccaatccccctttccctcctgcggcccgcgcgccctctctcggctggccttccccctcgtttcttgggccgtcggcccgtttttcctccctcgcaagtccagctcgcctctcccttcgcaagtccgttttgcctccctctcccatccctctctcactctctccccgacaggtgggacctgtggaacccacctgtcatctcctacctccggctccccactcccaaccaccatggccacccgagccgccccacgtcgccgcttcccccgcccacctcctccaccccgcgtgctccagcctggccgtgggacctcgccgcccatgtcctcactctcctaccccactcctt

SEQ ID NO: 22487 - DNA, 8585 bp, Oryza sativa
agcttctcgcgccccgtactgctctccccacgctgctccccatcaccgcccacctccagcgagctccggccgccatttcccgtcgctagggccgccgccacactgccccgccgccacgttcggcatcaccgagccaagccctatctcggcatcccctcttttccccaatctcccaccaaaacactaccccactgtcaacccgagccgccatcgcctttgcgagctccggccgtcgttccccgtggctggaacctccgccgcactgtgtcaccgccaccactggcttcgccgcagcaatcccaagcccggccaccgcttcttttctcctcgccaccaccgaaaccaccccttcaccgcgtacccgagccacctcccccattgctgcctctggctgcaatttcccttggtaccgcgcctcctcctcccttcctaacccctctactctctctcccaggctgtgttgtgccccggccgctccttcttcgccggacgtcgccggagtcccaccgttgccgtgcctccccgtggagcccgtcgccgccgcgttcccgttgtctcttctccgttgcgcgagctcggtgagcatccctccctctccctctatctccccttcgccggccgcccgcgttgcaccgccgccgccggtggccatccggctaggccgctgtcgccgccgttcgccgccgcttggccggccggtctcggctgcgcccgccctgcactgtggccgcccgtggaccggcgtggtcctggtccacggcgcgcctgaggccgcggtggaccgtgtccaccgtgggccgcccccttgagccgctgatgcctggggcccacctgtcggtgccggccccctctttgatgacgtcagcatgtctttttttctttggaaaaacaatcaataattgcgcaataaatcaataataattctagaaatctattaaaatggctcaaaacttctaaaattcatatctaattcattcgaactccgaattgagccattcaacttgcaaaattcatctaaaattgagatctacatgtttgtttactttttatgtactgtttgcttggtttttattagagtttttcctcgttttgcgtgccagcgtgtagaatccgtcgtttcggaagtccgcggtcgcaaggataagagttcagaaggttgttgtgaaaaagcaaggcaagtcacatattccccttgagcatattgagcctactttacaaatgttttactgtttgcaaataaatatgcatgttttgctaattacatgggatcagggtttcacctatctgctcgcttgtgccatgtttacttgatgtctgtcctttgtcaacattgggtaataaatcgactagctcatgttacttatgtgacctagctagaactatatgcttagctatgcttaattaccactagctcagttgatgggataattacagtattagacctttttagtattagaatgagctgcgtgctcgagacatctggccatgcttcatggtcataattatccaactaaaatgcgactaaatggtgggctgtgggtgcatggttttgctagtcacacccatggcaattaaggactggttcgcgggatgccctagaagaacttattgtacttaccacaaaccagcgtgggcaacggctgggcttgtagtgtagctttcctctagctgatgtacccaggtaagggtgggcgttatggagttgggtcggccggggtgttcggttgatcggcttttagattcaccgtggcacgagagaggggctgcccgttgcctgctggggacgggggcgaaccctgaggtgtggtgcgatcggttagagggggttatgcgaagggtcatgtcacggcctctttccggtatgttgtggtggcatgtcggcacacggaaatgtgtcgtggggctgtgtcttgtgggtacagttgtacacctctaatcagagtaaaactattcgaatagccgtgcccgcggttatgggcggtcgactagattcaccgtgattagtcccaccttaataaatcaactcaatgcaccgtagttcaggtgggttagttgggcctgttcaatgtggtatagcgttgatcagtggagatttaatattaccttaattactctattgttttactgtttgctcaataaaatgttttacaaccgcctttatgcaaatagccacaaaccgtccttgtattcccatgcacgtctgcatcattggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccactgctgctgctttcgtttcggtgtgtggactaagcgcctcttctgtaagtattttacgctttatttacgtttggaactgtatattacttatcgttttgtgtaccctggctggtcctggacagagatttagtctggaaatttgggctaaatttctgggtgtgacatggctccttttggtggaaggatgttttctaatatgatgtcttattcagaggaattgccaaacctgtcttggattcgggaaatgacgtgctttattgggatgatttatgggaaggagtgattcggtcctctaaatatccaagattattttcctatgctaagcacaaagatgactccgtagcccagcatctggctcgagatccacaagatcagttcttcctccctctctcccaacaagcctttgatgagtacaatgatatgaagagagaactctaggacttttctcttcaggatacaactgactcttggacttatatatggggatcggcaaagtacacttcaagactctgctataaactcagtttctggtctttatcccctcccatcaattttaaatggatctagcagagtaaggttaatatgaaaataaaggttttcggctggctgttgtttttggacagagtgaatactagggatctgctggagaggaaacactgtgctcctttgaatgcctcagacatctgcccttcttgctcaaccaatgctagagaaaacagggagcacctgttttttctttgccctttcagctcagcctgttggaataagttgggttggtgctgtgatactactctgcagtttcatcaaatgattcaagcccaactggcagtggtatcgcaccaatgcttcatggaattgttcttaattgcagcttggaatatttggaaggagaggaatgggcttatctttcagggtatccaaccttcagtgcgtaactggttaagaaacttgaaggatgacttgagtatacatttaggtatccatccttcagtgcgtaactggttaagaaacttgaaggatgacttgagtatacatttaattaggctcatggatagagcaactgtaatttttgtttagttttccgttttcttcttctcgtttgtcttctatacatatactctatggaaattaatataccgtgggggcatccctcactgttttctggtaaagaaaaatataatggattttgactttttcttgcactgttagaccactcgtcttattaaaaaaatttggaattattatttattttatttgtgacttactttattatccaaagtactttaagcacaacttttcattttttaatatttggacaattttttttaaataagacgagtggttaaacagtgcaaagcaaaaaatcaaaatcccttatattacgggatggagggagcatgtaggatggccatgccatgtgcacaatgttccctaatatcccaattcctagggaacctttctatccctaggattttacaggagaaaacgtagggcactttcaatttcccccacattgttttcccttggaattgtgttctctatgaatctctttaggactgtgtgccttttttccgacgccacccattctcagataaatcaactttggtagcaagtgatgctgcaggccctgcagcatgtgtatgaatttaccatctatcgttgcatttggtaaaacctacaatgggaggcacgatggttgcatgatttttgtgcagtggatgaaccagatgagcgatcatggattgcaaaatgaacaaaacctatccaggaagcatatataaatagtggttgtgcccgcgggggagagggagggggggggggtgtaagacgtagtaagtactttcttaataaaatgaagtcaaagatgctgatcgatgactacaacaacataggtcacagaaagtaaactaaacaaggaggccctagtacagatcctctcatctgtgacggcccatcacatgcctgggcaacgtaggccatcagaacgaagtcatcccaatcgggcctaaatttttgccgttgtagatgtactcgtcggggtgcatattcctatagctcgtcaccgatgacactcatctgtgacagactcgaagtttggcccgattgagatgacctccactatctcaattgggcccaaatactgagcccgtcacagatgagtgtcatcggtgacgggctccaaagaaggcccgattgagatggccttaatgcccgtcaccgatgactcttatcggtgtcgggcttctatttctgcccgttagagattagtgtgcgcccgttagagatgacatttttttggcccgattgtgatatactttgcacactatatatactccagcagtctgttgtctgtagttatcccactgttcactattttggtgggaggttgaaggggtgaatttttttgcaaacaaaaacaggaaaatcataaaagtaagtaaaagggtactaatcatttcctattaatttagtagtacttatgttatgagatgttaactaatattttgttcattgttcaacgatggatagaagttggatgtacacgactggcttgaggtgtcagtacaaggagtatagagatggcgtattaagttttatgaaagccgcagtggaggataggataagaagaaatgacaagtacatgtgttgtccatgtaacgattgcaggaatgagatttggttggacgatgaaaaggaagtacacgctcacttgatacgccggggattcatggagagatacacatgttgggtgaagcatggagagcaagatctgggtactgatggtgcagctgcagacggaagtggtgcagacaatcatgaagaaggacatgaagaagagcatgacatgtttgtcccatctccattgggcggtgaaatggttgatgtggaactgatatgctgcaagacatattacgtgacgttgatgacccagctatgaacgagagagattccatgaagttcagcaggttggtcagtgactcggagactcaatgaagttgaagcacaccaaattatcagcaacattagacctaatgaagttgaaggctagtagtggatggtcagacaagagttttacagaacttttgggaatactgaaggacatgcttcctcaggagaacacattgcccgagacgacatatgaagcaaaacaggttctgtgtctcctagggttagaggtccggagaattcacgcatgtccaaacgattgcatattgtaccacaagcaataggcggacttagatgtttgtcctgtctgcaaagcttctcgatacaagcgaaaaaagagcgcgggggagggaaagaagtcaaagcggggtggtctggcgaaggttgtgtggtatctaccaatcattgatcgtttcaagagaatatttgccaaccccaatgaagaaaagttagtacgttagcatgccatagagagaaggaatgacggtttgctaagacaccttgcggattcgatccaatggaggaatattgatcgaaagcacaaagactttgctgtcgaccccagaaacatgaggatatgtttgtgtacggatggcatgaatcctttcggagacatgagcagttctcacagcacttggccagttcttattgcgaactataacttcccgccatggttgtgcttcaaaaggaaatatattatgttgtgcttgttaatccaaggtccgagacaacccggcaatgatatcgatgtgttcttggagcctgttattgatgaccttgagattttgtagaaagagggtgtggaaacttgggatgcatatggtcaggagaacttcacgctacgagttctattgttctgcaccattaatgattatcccgcgctgggtaatctttctggacaaaccgtgaaaggaaagaaggcatgctctgactgtatggaacatacacgcagtaggtggctgaagaaatcaagaaagatggtttacatgggtcataggagatggctccccctacggcacgcctttagaagaacgaagaaaattttcaatggtaagaaagaactagggtctgcccctgcggatttgtccggagatcaggtacacaacatggtgaaggacattactaatgagtttgggaagaaaagaaaacgtagcaaggaggacaagaagaggatgtggaagaaaaaatccatattttggcggctacctcactaggaagttcttaaggtccgtcattgcattgatctgatccacgtagagaagaatgtgtgcgatagcttgctggggctattactgaatatgcctggcaagacaaaggacgggttgaatgcgcgtctcgatctacaggagatgaacattcgcagtgaacttcagcctgttacagatgagaagacaggaagagtgtacctcccaccagctagccatacattgtcgaaggatgagaagatcgcaatgctatcatgtctggtagatattaaagttccttcgggctattgcgcgagaataagtaagtacgttaaattggaggatctaaagctggttggaatgaagtctcacgattgccacgtgctaatcacacagatcttgccagttgctatcagaggcattctaccaccacaagtccatcacatgatccaacggctttgtgccttcttcaatacaattggtcagaagattatagatccagaagacctagatggtttgcaggccgatattgtcagtaccctgtgtcacttggagatgtattttccactggctttcttcgatatcatggttcatctcactgttcacctagtgaagcaaacaaaaatatgtgggccagcttttatgagagaaatgtggccattcgagaggtacattggaattctgaagtcctacgttcggaacagagcaaaaccagaggggagcatcattgaaggttacatgaccgaggaagccattgagttctgtatcgattacatggccgagactgatcctattggagttctttcgtctcgccacaaaggaaggttggcaggtgtcggcacaactggcagaaaaagaattgttctagatcaagcttcctacgcgcaggctcatttcgcagtgctgcaacatatggctgaagtaaccccatactttgaggagcatttagcgaaggtccgacaggacaatattggtcgatcagatatttggatcaacagagaacatggtgctcgtttcaacgaatggttcaaggatcgtgtagtacggtcgaccgatggcccaagtgagatattacaaaggttggcaaggggtccatcttgggatgttgacacatggcatgggtacgatatcaatggatacacattttacaccgtcacataagatgagaaaagcacagtgcaaaacagtggagtccgtatagatgcatatcaggatcaggctggatcgagcacatactacggccgcatagagcagatatgggagctgaactatctaaacttcaaagtccctttgtttcattgcagttgggtgaatatccgcacaggtgtcaaggtcgacaaggaaggcttcacattagtggacctggccaaggttggatacgcagacgaaccattcgtactaacgaagcaggttgaacaaattttctacataaaagaccccgcaaacaagaagatgcacatcgttagggatggcaagagaagaattgtgggggtggacaacatcgtcgatgaagaagaatacaacaagaatcttcatgtcagacctcaaatcgaccttgacgatgatcccaaagacgaagtggcttacgttcgttcagaccattcggaaggcatatcactgtgaatgatgtatttaatttgtattggagccttaatgaatgaattgcatatgtttcatgccattctagttaaaactctttgaagaaatggatttgttaattatatggttttaaaaaattatacttgttattttaaactatatgtgagaaagccaattgttaattgtatgaatttaaaaaagtaatatgaattttaaactatatgtgagaaaggcatttgtcaattagatgattttaaaaaattaataggaattttaaactatatgtgagaaaggcaattgtagattatatgattttaaaaaattaataggaattttaaactatgtaaataagacatttgttaattatatgtgataaataaaatgtaatagaaattttaaatcgggtagaagttaattataaatgatttttataacttaaaaatattttaataagtcatctgtgatgggctttagtac

SEQ ID NO: 22488 - DNA, 3382 bp, Oryza sativa
attgactagggtttatttagtcaatcctcatcccgacgccgcctctcactctttcacactctcactctctcagatccaccgccgtcggcgcctccctccacgcctgccggttcaagatccaccgccgccttctcctctagacgccggcaccttctcccggttcaacatccaccgctgcctcctccctcgtcgtggataccggctccccgactgccgccgccgtctcccggttcaagatctggcctccccgaccgccagcgcctcctccgcacccaagaccgccgccgccgccggcctcttctccaagtccgtgtcctccatgcccaagatcccgccgccggcttcctctccgcctagtcctcaagaccgacgccgtggccgtttcaccgaccgccgccgccttctcgtcctcaacgctgccgcctcctcctccctcgaagatccggcctcactgaccacggccgcctcatatcctcctctctagatctacgcccagcggccgtcgacctcgtcctagccgccgcgtcgacctccttcacgccgctgcctccctctactgattgccgaccgccgccgttgcgcaagaccgccgttcccgaggccggggccgctcaagatccggcctccccgacggccaccggctccctccacgccgtccccgagcccggcaccgcccaagaccagcgtccccgagcccgacgcctccctccacggcgtccctgagcccggcgccgcccaagaccgccgtccccaagcgaggtaggtactcctcaccgatgatgatgcataatgtgatgatttgctgtgtacatgttatatgtgatgatttgatgattcgatgataatgtttaaattcgataatgtgatagtgcgattatttgttgattcaatgtttagatgctaatgtctacatatgaattgtgctagtgatgaatttttgtatggctgtgatgacttgtgcatttttatatgtgttagctaatgatgaatttttatatggctgtgatgacttgtgcatttttatatgtgttagctagtggtgaatttttatatggctgtgatgacttgtgcatttttatatgtgttagctagtgatgaatttttatatggctgtgatggatgaatttgggggagaatgggatgttgggaaaaatgtttagatgtgggctgtgatgatgaaatattgtgggctatgatggatgaatggccagtgatgattgctcaagaacataccatttttgggatgaattgttgtgggctgtttttctatgtctatttttttactgcataaggacagacttgttcttatatagttgtttgcaaaatatttagggtattttgggtccaatgggatggatgaattgatgtgggctatgatggttgaattattttgggggaaatgtgagttttggtatgtgacctgtgttttttatggctgtttttatatggctgtttttttttgcatgacagaccctctacacttgttcttatatggttgtttgcaaattttttgggatattttgggtctaatgggatggatgaattggtgtgggctgtgatggttgacttattttgggggaaatgtgaattttggtatgtgacctgtgttttttatggctatttttatatgactgttttttttttcataagaacagaccctctagacttgttcttatatagttctttgcaaaatttttgggatattttgggtccaatgggatggatgaattgatgtcggctgtgatggttgaattattatggctgtttttatatggatgtttcttttttgcatgaggatagaccatctacaattgttcttaatttcttttgggggtgggggcagttgcaaatgatggtaattgatgcataatttcttagcaaaactgaggccaaacttattatatgtcatgacttttgtttttttaggtacaaaaaataatatatatgtgacttgtgtagtatgggctgttttgggtgattttgagggaaatgggatggatatgcatagaaatctgttatcaaatgaagttactgaaattatggcatttaggagaatacgaagtgtcccagttgccaaatctggtttggtcgggttactgcctgcacggtactgaccaagacaaattggtaaacagaacatttcattcaaatacaacatttctagaaatctgttatcgttaccaatatcctagattgctttcaaggtcatttctttaggaaaccccattcccataaattcagtatccaaagatggttgttgtatctatgggaataagggttccctaacgaaatgatcttggacgcaatctaggagtttgctgataataacgttagggatcttggataggaaaggttttggttgcctgtgtattctatctgcgtccgcctcgtcagcagatatgtagcatccatgttccttagggccggaccagacgggatctcgacctggacatccatatcccactagaacttgctaccgttgccactatcttatggtagtgacattgatagcaagttcgagtgggatactgatgtcgaggtcgagttttcggctgctccggccttattgagcatggatgctatggttccgtcgacgaggcgaacacaggtaggagatagaggtatatcaaaccatcagagaatgtgtgtagatgcaattttgtgtttaaaaagtactttctccccgtacaacagtgacataggacatgttgtagcaaggcgaaccaatgtcgacgaccactactgggactacttcgagccggaatcctaggacccagaataagattcctaaggaagtctacaccataacagaggtggatgatgtttgatatccgacggctccgacgaaagctgtcaaaaagttccctacgatatgcggagtcctagggaggcgaaacttcactattctgaaggaccacatcgatctggtccctcaagaagaagaagaagaggcctggaggcagttcaaggaaagcttccgataccctacagaggccgaggcaggactcaagcggcagactatccgcaagatggggaattgttggaaaaatttcaagacaacgttggtcatggagtacgtcctcaaccccgcccagccaaaaccatttgggaaatacccattcatcacccgacccatgtgggatgagttccatgcctccaaatcaacgaaagagtctcgggcaaaaagccaggcctaccgtgatctgcaggcaaggaaccttcacccgcaccggcttggcaccggaggctacgcggggaaacagtctgaataggacaaggaggatgaagctgcagcggaatctaacaccccgcaagtgcttgctgatatcccggtccagcgggcaaggaactgggcaagggcatgggtgaagaagaatagtga

SEQ ID NO: 22489 - DNA, 8507 bp, Oryza sativa
aagtttcattatgttgtatcgtattcttcgtttaacgcgtcctaactggaccgcaggtcgaactgaatgctgagagacaggcctcccaagaggtctgctcacaaaaacgcgaggatgacatcttcacgaaagcgttgggaaacgaagaacaccgtggacgaacaaggggcattggctccaatgttccatgaaagtttgggtttccccaatacgtgtggcagtacaagaagcacaagctttccaaggcgtagaaagctgcacgcattaaggcccaacttcgggaggagcttaaagaagagcttagagaagagctcactgccgagctgttaggtatggaggctcggatggaggcacgcatcagggataggtcgaccgatgccactcccggtcccatagtacaagtgagccccacgcagaggcgtagcagctgcacatcaactgaggctcctgcagaacagcttgaaggccctgccgcggtggtccacataatggtaaaaacaacttaataacgcatatactgtattagcaccacaatacattgcaacatatactaaggacactaatgaatctatcgcaggaacccacatcgtgtaccctagtcattaggatgacaccaggatttgcaattcctgccgcagagggtcaagcattcaagcctaccccggagacctgagtgcatggggcgcagctgctagccagcaatgccgaagttcaggtggacttagtgaagcccaattgggttggctacactatcccacacccacctaatgatgagattctgacccttggggctgcacgtgggacctttattcaatggcccaagcacaacattgagatcaatataactccaagcaagagggcgaaatcttctccacccaagcttgacacacgcagaaaagctgctggaacggggagaggaaaagtaaaggtgccattagccccaaataagcttgatcttggcaaggcgtcaggagctcctccaaagcctccagccgaattcacattgggcatgccattggtcggagacgatgccttattctagatgggcctttcatgcaaggagttgcatgggtactacatggagaagtccaacgcaaggaggaataatagagagacctccatggtaggccagcacggtggtcagccgttcctcaggcctactgccttcatcgccgtagacttcaaagatctatgagacctctatagggtgcgagcgatcgataccaacctccttaagtgctactccttgtaagtatttcttggtacgcgatatggtagtgactgtccataaattacacttaccgtgactcttgtcttgctcgtaggttaacctggaagcatgtccatcgtaaagcaccccatgttgccttactcgatccagctgtcatcaatgagacaacgctgaaaaacgatcgagcaaacatagtgggctatatcaaggactgcttatttgcccatcaagacaaggacttcactatgtgtgcctacaatcaacagtaagcgtgtaccgtacttatactcaaatactcgacgcgtacaactgtagtatgtaactggcaatttaataatttcgcaggcaatattggattcttctggtaataacgccgaagtggagtttgatacactagcttaactccaatatcaagccagaaatatacgattggtcggccatcgaatctaccttgaatgaggcatgggaccaatacgtggcaagaggcgggaggcataaggatgggcatcccaaactcggtcacaagaaagacttcccaatacgccaacaagttggcgaccagtgcgggtttcatgtctgccataacatgaggagctttgcagacaaagtgacattgctcgaccctgaggtgtgtaattcaattgtttatacacacataggatgacaaatttacaagtatgtagactaacttggcgctgaacattcaggaatttatttcaaggatttcggaaatcaacatcgaaatcattagagaggagatagcacaattcatactagatgatatcttgtcaccgaaagggatgtttagagtgaagtcctaggtagctcgtctcggaatggcagaacatttgcaatgcatatgcgacaaacatttgatttttgtaaatattctttgtaatacgattatattctttagagtaatgtcctaggtagctcgtctctgtatatacttgcatttctacttacatataaaattgttccaatttataacttagttttgcaggttttgatgcatgtcggcggtttggagagaaaaatggatgtgaatgacatatatatgtgaatgggttgtggatgtgaatgtatatgtgtttgattttgtgaattggctatgctgtgatggaatatgaatgtgaattggctgatgtgatgctgggaatggatctatatgaattggctgtgaattggctgtgatggtatatgtgaattgatgctgggaatggggttgctgggaatgggactatgtatatatatgcttctgtcatttttgcagcgggcatggctagcaaaggcctgaggctagccaaaaagacaaattttatttattttttggttctaaactcatccctgacgggcatttagctaatgcccgaaagagataactcatccgtgacgggctatagagtcaagcctgttagagattagtcatccgtgacgggcttttagaatacacccgatagagataagtcatccgaaccgggactagtttgactcaacacgtagggtcaaacctatcggtgacgagctctggctaaatgcccgatggagatgactacttatccgtgacgggcttagtggtgtgcccgattgagattagttatccatgacgggttcctaactatggtggtttgactggtcatactcatctatgacgggcttggttgtcagcccgattgagatagcatccatccgtgacgggctttagcccgattgagatattttctcacatcagtgacctgtgcccactgacgggggccttacccgatagtgatgaggctttcagcccgttagagataagcgatcccgttctagtgaggttggatttccttacgtttccctcgtttgaacttacaaatgtacaacccaactcgtatgcaatatataaacttgaaatacaaaagttgtctcgttcagttttttgttccatttataatttgctgtctttgtgagttcacacatatatgtttatacttaaacattgttatccttttatgcttataatacttggggtttccgttagcccgtagtaccaaatgcctagtggcactactacaaaaaaagctcatagagatcggcactgtaggtgccggaccagctaaaaccggcacctataatgcttttccctcctctatagactgaaaatacataaaaccgacacctttaaacaacaataggtgcccgttctaaagaagaacctacacctataatataagtgccagttttctttaatataatataggtgccggttttttaaagaaaaccgacacctataccataggtatcggttcttctttagaaccaacacctataataagttataggtttcgacttatttaaaaaaaaggcacctttctaaaccaagccgagccgagccgagccaatccatgccgacgccctatatgagtcaaacttatcggcctcatctctatctccctatctctcgccttgtctcgcctcctctcttggatctagagtctctatcgtcttctctctgcagagggcgactggcttccgcggcagcgtgatggaaggcggcgggcaacagccggctgcgtgatgggaggcgacgggcggtggcagcgcccttccctccacaggatctagccagaggggaggcggcgggcggcggcgtgatgggaggcaccgggcgatggccggcagcggttccctcccctccgctggatctggcgggagggaggcggcgggcagcggcagcgcccttccctccaccggatctggccggaggggaggcggcgggcggcggcacaagaggggcccaccggcggccagcccctcttcctccctcatctcttctttgtagatttttgattagatgttttgatcaattttggtgacggtttgtgaatgattatatgtgatgtcaatcaattttggtgacgatttgtggataatttggggatttgggtttgggcacatggctacggtgctcagtgagttcggctcgattcgagccggctcttttttttttctcgagcaaagctaaaggtgccggtttatattattggtgccgaccaataggtgccggttggaaaaccggtacttatagtcgattcccaaccggccccaataaccctttttgtagtagtgtggacaacactttaaattgccggggagcaatgaactacctccggcgaaaactcacacgagagcatgcacacaagaaataaattttgaggattattaacacacaacgggatatgatgacaaacaccagccacgcacactttttcttattgcaattcacacacttggtgacaaccaagtgatacacggcggcttaaggttgcgttcgtttgtgccggttgagagtttatccctccggcataaaaaacggaacagcttattagcacataattaattaaggattagctaaaattaacttaaaaaatggattaatatgattttttaaacaactttcctatataatgttttttttacaaaaagcaaaacgtttattagtttgaaaagcgtgtacgtggaaaacgaaggagaggggttggaaacaaagggtgccgaacaaagcctaagtagcctcgtgtacatgcattctgcagcttcaacgacttggctaactcatacgaatgcatcagccatcctcgcaagtcatgctacgtgctccactcatatatatgcatgcagctacggattctactgcaccacttgctgatcctatatataatctagctataacagcctgagacttactcctactaacacatacagcacacgcacgtgcagttactaattgagccatctacacttgcacgctagtccagtacatgacatacatgaatcctattagatgtctaatacgtgaacacccataacatatatctagctaacataaaccttgtcaagattagtgctaacagatcatggacactatggactggggcatggtgtatatgtggtgtactcgaatcttagacgatggtcctatcttgttcaaccttggcttctagttttctcctttacaagtttgaattcatgtgagcttagtagtgatgctgctcacgcctgtttgtgttggaaacacgctcgcaggcctgtgtttttcctgcttcgtcgtgccgtgctcgtcgatcgtgacctgaacgtctgtgggacggcacggatagtgatgaccatgacacgtgtttagggtggcttgaccacatcatgataatgtgtttcggatttgtaagcatgcagcgagagaatctcggagaagagcgctgcgatgtttttggcagcacaccaacttgatgtgtcgtccattttggagtttcacgtgtgtgttgaattcgaccaggagagctgatttaatacaacttggaagagatcgagctttccgcggttcaagttgcgccgatatgttagcgttggagaaggatgcatagaatgcatacaaaatcttgtaaaatcgagaaacttggaggaatggatgctatttttttcaattgagaatgttccattggaatcaaatccatgtctaatttcctgcaaaacacactaccaattttcatccaagtgcacaaactgggatcgctggggtagaaaatgtttaagcagactatccgtatccctgtctccatggctgtatgcttgagctttggaagccctactaaacccatgatgcatccacatggaaaaaccagcccttatatatctgaataagaatcatgtctgaactctgacgagaggatcgatgatgaaaaaagaagtacataagtaaccacgtacgcgaaaatttaattcatgattcagccatgtctctgtggaaggcaacaactagctagctagctgcactctcaatccaaggggttgggcccaaccacctccatcgtcgcacaaataatccatggctgcctgacacagtgagcccagggccctagcccgaagcccagggtcgtcagacattggctccgacgcttgctagagtaacgtaagaggtaggcagatcatgcagtatgtttcttttccaatgccatccattctcaagtaaactgatgtaacagtgttgctgtagtacgtgtatatgttacaaacacgaacagtgctaaatagaaagcattacctatcacttgccagggatagatctagagtctggacagacgtacgacaggaggaaaatcacttacttggatgggatgatagtttgcttcctgcaaaggatgaagtagatggatagaaaggatgaagtagatggatagaaaaagcttatgaatacgagagtggaagtagccacgggacatataagaagaatcaatactcggttggtggttgtagtaagtatactcccttcagactgataatacttgtcattttagataagggtgaggtcaaactttacaatctttgattatgaatcatttttaaaatatttatctttcatatatggtgattacatgtatagattagtcttaaaaagtactttaataaaatcatatattttttaacattcttatacatattataatgaaaaataatggtcaaagttgtttttttgagaccatgctcttgtccaaaatgacaagaattatcaacccggagggagtactttcttaactttgaagaaagcacggctagaaaagcaaatttccagacgatgacatttttttcaggtaggtaggcctctccgagctaaatgaccacctgcgaaaatgacaaccgtgaggtgaaatcgttgtccacctgcaaaaatacacttaagttgatcagaagttgataactatatataccatgtaggccatataaaggaaactgaacgagatggtctttgtttttttttaacgaatcgcactagagagtgtaaagttctactgatagagtaggaaaaaataacaaaattacaacccttgaagatggtaaccaggaaaaagaaaaaaaaagtatactaccactcacacacccacaacgccaacacatagactcaggagaaggctagcatcagaccagccaccgctaagtgtaaccgacagccactaagccgtacaacggaacacagccgacatcgcccaaaacccgaccattacaactgacacaaaacacagctctatctaaatctttgggattgagggtgagagggtgagagagaagaatgcagccattctccccctaagccctccaacgtggccaacttgcggaagctaggatgccgacataagagaatatgaattagagagagcttgcaccaattgcttgggagattttggcaagggggtgcctacacggcatctctaacgagaggagcgatggatacaccgccgccgttgtccgtcaaggcctcaagagggccaagactgggttttcacccgatagccccactggaggtgaaggggcggcacgacaacgccctcaagaagggtaaagacgttcgaaaatgccgtcgttgctagcccggccaaggccaaggccgggctaggtttttacccgtcgcctaccgcctgcgagtctacaaatgatgccccgttgctccaccaccgtcaagcctccacaggcgcgtgggcttcactgcaccggctctccccaccggttagcctttgcgtgccgcgccagcctccaccacctgccgaccgcgcctcgacgtgctgcgccggcctccgttgccaccggtggcatctcctcgcgccgtgtcggcctccatcgccatcgtccgcgcctcctcgcgccgtgtcagcctccggccttgctccgcagccatcaaactgctcacgccgtcgctgtcgcccacaacccaccatgcccgcatgcggccgtcgctctccttcttccccattgccggtcacctccttcctcgcctcctctctggctatcgccgtcgtctacacgccagtccaccgcatcctcctcccgtgcgccggccgtgtcccatctccctgcatgccagcgcagctccagccggcttcgcgcccgccgctgctagcagccaccgtcgctgccgccagcaccactggtcgccgccaccaaaaccactcaagcccggctgccatcgccagccgccatccccgccagatccgaccggcgcagcgcggatctggtcggggtgctctgccgccgccgctgccaccactcagcccaaccgccagcctccaccccacgagatccggccagaatggcgcggatctggacggttgccaccaccgccgccccgagcaattgccccgaccaccggacgcacgctgggcgcagcccccccgccgccgtccttgcggccacgcggctttgcctacgcccgctcaggcggcggcgaggcagagaaggaagaagggggagg

SEQ ID NO: 22490 - DNA, 12379 bp, Oryza sativa
  unsure (1)..(12379): unsure at all n locations
atccgacgggcgcagcgggatctggtcggggtgtctgccgccgccgtgccaccactaagccaaccgccagcctcacaccccacgagatcggccagaatggcgcggatctgaacggttgccaccaccgccgcnccgagcaatgcccgaccaccggacgcacgctgggcgcagccccgccgccgccgtccttgcggccacgcggctttgcctacgcccgctcaggcggcggcgaggcagagaaggaaaaagggggaggagggagttggcggtggcgtcacctctcgtgttgcccatgtggagagcgacacgagatcttatggtctttctattacatccacaaatgttttcttttcaagtaatgttaattactgatctttcctccaatttttttttcactcactaacatatatatgcacgtagaatatgtagtttatacttgtagcacatattattagtgattttctcttaccactttgtttcttttttgtcaccaagagatcatctctaaagctttgtggtctgtatggagtcgtcaagtaccttcattttgagaagatactaatcatttctcatgtttactagtcccaaaaaaaaaagtacgatcgttacggcagatcggaattgtatcactgtttgcatgcacagttgcccttcactcgcaagctcgtaagagaatcccagcgcattcttgtcatcaacgcatgcccaagttagggacttggctatctaccagcttcggggacaaaattgtactgccagctacacactgagccaaattcagtcactgagatcaagagagaggtccacgatatttcatccttttgccttaattccaactcaatgagctcagtgtcccgactcccgagccaccgcccgggatcgccagctggtggttctgctggtgcatgaactgtcatgcatcctaaagtgaacatccagtcctcttcttctccaatgctacccgttcttaaaatgaaatcttttagcaagctctttacaaggtacatgtttcagaactaaaaaattacatgtaaatagcatgagttgttttatatggcagactgatatatatgagttgatttttttttttttgcacgcgagagcatgtacccacagttacaccatgtatatatacaccttgcacgaatcctagggcagttacattaaggtgctaacaaaatatacctcgcatgatgtttcctttatactatattttttcaaatgtaaaacatcttgtttatgtgttttttttatttcttgtattttatatggttgccctattaattttatatgtttaattgcttgagatgtttttccttaatatgtttgatgaactgtaaaacatggtagcatatatatatcatttcgggagtatcatttttgtaagatgtaacctggtgaaaaatatattatgcaatttttcatgcgacgcttctgttgtatatatatgattcgtacctgggacccatctgtcgacgtgtaacatcctttctgtatgaaaataatattattctgatgtctcactataaaaaacaggtaattcatatttggcattgtagatataacttcaaatgaaaaaaaaagcattaactataatgttgtagatattgccgggcagtccaaatttcatatatagcttttccccatacgacgtcatttgaaaattttaaacattcttccgtggaaatagatcccaacactttgaacatctaaataaaaaaaatacatggttcaatctttcgttttcggtatttgtattaggggtgccgatatggtgatatttccgaaattttggtccgaaatttcaaacaaaatttagttaaatttaaacaaatattgctaaaattcatgagaattttttttaaaaaataaaatcgtatcggtgggggtggggtccgatatgaccaaatcttttgaaatttcgttcggaaattttgaaccctgacacaaatggatccaaggaagttgtagaactcgtcgaactctacgattttgccataaagtttttcataaaaggaaaaaactatcatttgaatatgtcggccttttccaatattcaatggataggtccgaactgtccggtcaattgagtataaatgctggttcatgttatgaagaaccagtgatgcttgtttcctatcactgccgatttataacaagaacaactagcagtgatacaatagtaatggttcataacaagaaccaagagtgatattcaagtatcactgctggttcagagtagtatcagtgactgttctaaggaaccaacaatcatgggccggtttgatttatttgaaatgataaagtatgtcctagaaagaaaactaaactggaagatggaatctgtcaacaaatttattttctcgatatacaggagaactacatagatgcattaagaattgtcagtaaaatacaatagctgcttttacttcctgcctactatacttttatggtggtgtttactagtagtagaaatgattgacaattgatctctcttttatttagtaaaccatatcaatttaataacaaatattatagtgaacaggatatagttgtgcaataaagcaagagcctcataaccaatgccacgaatcgtttctacttgcggtaaagaccattataaaagtggccataatggaatacatatggattcaaaatagaaatcaacatatttttcttttatagtcatactgacaacctacttaaagtcgagctattgacgaacccgtattcttcatggagagctcatgtgaataattaaccaaaatgtatatatggggtgtgtctgcaaattttcaactgccgatcgttactgcgtggctcttgtggcagccatcacatacagagcacaattcaaaaaagcacacccttaaacaaagttatgcttatttgccatatgcagaactcacgcaaattaaaccttatccagtattgtgctcatgctcggacgcaggcacctccactccatggatttgatcatcgctctgatactggcttcagtactagtgcacataatgacctgaaagtacataatgacttgaagggtgcattatgctcctttcccgatgccacacattctgaaatgatgattcaactcgatccatcaggtaagggcaagtgctataatagatgtgactaccacctctaaatttatctattttattcactcataaaataagagacaacctatacaatgtatcacctctagtactaaaaataccaatatatctaatactctcacactcttcttgaaatttgtgtagaggttacctcttgatttaggggtggctcatcatctctctcctcacttctctcctccatctcatcattcaatccaatgtgacactcttagaggcaatatatgaagtattatattacttgccctagctagctgagcaaaggagcaggaagcggcggtgcgcgcgtgcatccaagacgcaaagcaggcgctgcaccggcccccttgacatagcagctgcactgtgaatctctgctactttaaaagccagcggtgatggtagtgtctgcctccaccacttatagtttaatataatatatgttagtacaacaaattagaatgaaagaaatgagagaataggatagtagtataatatggataattttgatccattcttcgtgtatattataatatacgctttacaatatataattaagttatctttctttaacttacgtacgattgcaaggtatggacatttaattagctagtttgaataaatgtcaatatctacagttttttcactggcttattgctaagtgctaagtttcttttagataatggataatatctgagctttactttaacggaagctacaaccacatatatagttcttagctgaaaaccaagtataataatttttaataaaggataaagaaacgatacaataataaatgccacggtaaaaaaagagagacacttattcaagaacaatcctattgttaaatctccatccaaagttaacaaaaatttgcatagcggttgtctccaattttcgacatacagcgtgaataaccaccaatgtcctcttcacacctttgtagttgggtcaaaaccgaaccagtatattgctctgatgagtacatgcatataaactttagttggtattttattaaaaaccatatcattcctatttaaccatatagccaacataaaaggcagatgctctaattgaaatatgttttttggtctttgagtaaatcccaatcagccaattataaaacatatgagtattgtaaaccaaattaaaagacataaaaatggttctaaaaaaattagccatttgacaatcaaagaatagatgttggacataaaaaacaacatctagtactaccattctaatttcttcttactaaattatcattgattaattagaactaccctttagctagataacacatgaaaatcttaagtttgataggaatcttcaatttccgtaacactttattcctatcaatatacccactgttgatcatagcaagatacatggatcaaacagaaaagataccattttgatgaaggttccacctaaacatatatttattatcattaaggttaatacgtacaattcgagcaacaaaattttgccaattaactatattctggcccactagttccctatggaaagaaacattcaaaggaactgtattcatgatagttgcaactgacgcacttttccgacgcacaatattatataaagatagataccaccctttaaaagaagagtttccaatccacttgtcctcccaaaatctacattgaggacaaaagattcaaaacctagaaatttatttttaacttttattagacccggctagaaatgagagtcacctgtttttttaaccacttgagtaattgtctaattatgtagttatttccttcagagcatttactgccaaacaccatcctcattaatcaatttagacaagcatttactaagaaaatattgtaccttttgctcttgttttgtgggtgcagaactgcatagtatttgaagaccaaatttagccatggtccagtggtagatagtgatattttttgaatgcttgcttcttcttatgcatgtttacaaatgggttgttaaatattgacttgttgagtctaattactaaactataatatcaatatcaatgccattaaagataactcattttaaatttgcaagcatggccatgggccatttggccacacctcattatcttttcgtcatctgtctctggtttcatgtgatggatgaactagatgacctatcatagaagacctatctacgaagtatataaatagggtgaggttatgcgagattgaaaaatattatggcaatctaggtcttcggagaattaaagctaaaaggaagagatggcatttgtgtcctaagatacaatgaatgtttttttaataccttgcctctaaaaactgtgttgcaatgtatgaaataagtaaatagatcgtggatcaatatttatggatgagaatcttacatttaggagaggtaaagggatcttcttaaacaaagggaagacgcggggcggggagcggacatagtaggtgcactagtattattatctagtactctcttaaccaactatgaaagctaaaacagaggttgacactcccatcattcacaaatgaaaggaaattaagtgcatgtttaaaagtaaagatgattgctatctctaatttagtgtacatcatctacttatccaataaaaggtaacatatacaatagactacctctaatacacaagctccaaaatataataaatcttcatttattcatttccatctaatccactactatgttgattttaactcttttggagttatatacaggttggcgctcctttttcctctcctcccttctcttctccaccaggggcggatccatcatgttagctatggtgtcagctgacaccaataccttttggtccatcccatcactacaagataattgagctattccccccaaattattacaacaaaaaataattcgtagcaatatattatactattgcaatgataatttttctgtggcaaataattatatttttttgcaacaatctacaatcgttgttttatttagtatttttgttgcaataaaaaatgagatatcgccacaaaaagtcttactgttgcaaaaaaaaacatgttctatcgccacaattttaatttttgtggcaatttacatagtacatggtacttttcactattttttgttgccacgatcaacaaattcgttgcaataaaaaaattatcgtctcataatttaacttatttttttcatatggacacaaattgagacaaattttatatgggaattatagctgtcgatgagatctacaattttataggtgacaacattttcatttgaaatcttttagatatttaaatctatgattcaaatctcagttaggtaaggttcaaatggaacgatatgtattttccaaaagaattgatgcgtgtgtgagttggtaaaggaaagcacgcgtgaagaatagatcttgggttcgaatcctagccaagacacaatatcaaaaaaataaatagataggatgataaattaatatttgaacctttaatttggtacgtagaactaatgccaaatatggagtggtggcaatagcttttattataacgatgtgaagtgttgcaatatgattttttgttacatccattccgtggcaacatcgaaatttattaccactaaataaaaatcgttgcaataacctattaccacgctatttattacaacggctagcaacaattttaaaattgtggtaacatatatctattgccataattttagtattgataccatgatttttttcgtggtaacaaataatttttctagtagtgcatgtaacctgttctagtctacgatgagtgacaccagtgcaccttaccaattaacgccatactcacacgaaaacagcagtaaccactaattgagcaccatttgttctgcccataaattacccttactaatttagttggccacatgcccacatcggcaggcggccgcagctagcagttctactgtttgcaactgccagccaaggccctgagcttctaattttcttccatgcatcaggttcagtaaaacaaattagtggcggtgctattatttacatgtgtatctaataaatttagttcatagtagtataatttaatttcaccaattggacatgcggtatatatagaaactgttgttgaaaatatttttttaaacatggtatttagatataaattgatataaaatattcatttatctatttttaggctactacttctcatgtttgacgtcaactttgaattgcatgtagacatatgattgctaaattatctctctattgcttgatttctagattaataggtgggttcatctcatttctctattgtttaccattaattttaaacttttcatatgtattattgactgtacttagaaaccaagcttcttagtagagttgatgatgacacaccatcgatcaaaaatcctggatccccccctgttctccgcctcacataatctagcttgtgtgacatcactactagagaaatcattattaacgacagaaaatatggtcgttgaaagtccaaatgtggtcgttaaaggtcattaacgaccatattttttgtgatcgtcagtggtcgttaaaggctccgtcgttaataatattaacgagcacgctaactttttttctgtcgttattgtactaacgacggagtttctctgccatcgtcatttctttaacgactgtgacattgtgacatcgttatattcattaacgaccatgatttgtgtcgttatttttttttaacgatgacaacactgtgtggtctttattttattaatgacgatatcacattttttactagtaatggtaatgtatttagattaacgagatgttaatagaccaataaacgaaattattgaccactctttattaatcaaatgcaaataatttaattcgttcattacatataatttggaaatgtacgtccataatgtactatacatctacaactacatgaaaggtcttcaacccagtcgtagaactcttggcttgtttcatccatgttgtgaacactgcaaaatccaaggtttaaaccaatcaatacacaaatgaattgtaatagcgatatgtggagttataggagaacatataattcagcctgtataatagagcagtctgaatgcttatgttatgaactagatactacttttacaccaagctatggtaagtgtaaacctaacaatatctaagttagggtcaacattaatagtccattagtctgttgattattcttattgatttctccaaagcattacaagttggggatgtatgctatcttattgaacttggaaaaaaaaaggaagtggcaagccatataccagactatcagtgcatatcatattgatgttgatcaaatccaagaatgttgatcaacatatataaatcatcctgcaggaaccattggaaataataacatctgggcacacaaaaataagtttttttgcactttagctatgtcacactggaatctgtccatgaagagaagggagctgttatatgagaaactaaacacattttaataaatccaaatggaagcaagtgtgctctgcttctgataacacagaccatggcaaattcataccagatggttgaatgtgttaaataaactatcaactgcctgcaagaagccatgaattgcagtacgggaagataaatgattgattgaaaatgaaattatcgttttgtcagcggtatcagggccatgctatatcttgttactgaactgtaaacattaaacaatatgccaagatgcctccacaaatttgcgtgttcacagaagaagaatcccgtaattttagataaataaaccaatcattgtatattgactagattatcctgcaagaaaaattgactttcctctcaagtattatgatcaaactcaaaatcattcagaaagaaaaaagaagttatgcgccatgttgaaaaaaaatataccttgttgagacttcatggatgaatggacatgagagcatgaatggaggtcacactgccatctataacaaattctaagttcaaatctacaagagtagtacaaatcacaagctcactcagtataactggtaaattaaactgcaatgggcaattgggcatagttacaaattgttcctttgaaaaactagcctgacagatcagcaagaaaaaatggctatgtactacaggtcttatatattccttcatctcatggaaggaacatatcataatcctcaagttaaacaattaaacccagccgtaatttggaaaatagaattacaggacgacaagggatatcatggaacgaacatatcataatcctcaagccacaacgctaaaacaaggcagagaaaaagttacaagggatatcatctgacctagttctgccgttcacgcctcgccgctgttccatgcccaactgctaagccgccgttttcggcgagtcagagctgccccaactgggcaggcgctagggcttggggcttattggcggccaaatcttgtcctcgggaaaagcctggagcgggagcaggcgcgcagggatggccggcgaccgctgggtgcagcggcagtggtgaccatgtagggggcgtcggtgctggtgcaccagtgcagcggatctaagccggcggggaaggggatcggtccaccaatttcgttatctatagaaaattctgaactgacgccttattagcgaccacatacacgcacgtagtaacgaccagcgattacatggccgtcggagggcctaccgcggcttctttgactatcaacgatcagatgtttgttaaggttggtcgtgaataatctaagttctagcagtgcatctgggcgtgaccgatgtatatttagctaactatgacccatggagcaaacaaaaaaaagagaggaaggattgtcgaatcgaagcagtatgttccttcacgtacgaatagccagatttgttccaaggcatgcaacggcatcattgtccgcacaattgcccttgcactcaggcaagctagcgaaattctgcgggcattcgtgtcatccgcacatgcccaagtttgggattatgctttcgactgatcatggtcaaggatcattccgtagatcgctttctccacacaccagcttcaggcacaaaatgctagtggctgcacactgggccaaatttggtgctagaccatgcgaaatgtcagtgtcaaagacatgccctagcccctttccatcccttgacctcaattgcaactcaatcattccatggctgcattctgatgagctcattgtctcgagccactgatcgggttcacagatagtgggtcagttgttccgtggattggtgaattgatgtgcatgatagtgtgtatatctgctgtgctacttttccgacgccacccattcttaaaataaaaatcttctaacatgctctgtgtagcgtacatgcagacatgctacataactgtaagaatcgtagagatagttgtattgttttatatggtagagagatataggaatcaacccctgcttattgatcaacataaatatatataagatgagaagagaggtgaagtatatgaaaacaaggtttggtggttgtagtaaagtatatacagaggtataaaatggacacagataactagaccagacaaagtagatcctagaaagaaaacaaaattaactagaagatgaaatttgtcaagtaaaatgcaaccgctcctacgtcttgcgtactaacaccgatatggaataatagcttttatggtggtatttagtaatagtaaatgtagagttcctattttttaattaaccatatctatttacactaccaaatcaattacttataatagaacgaagggagtacagttgtctaataaggtagaaagtgttagatcaaggtgttttgattcttattctgtgatgaacaattagcatcggtgattattagttttgatatttggaattaatcttcgaagtggttttggagatgtttggatttacaagtgttgctggatatgtggtccggtcagaccggcggtatccgtgcagtcagaccggccgacgctgtgtcggtttcggtttcggtttcgggttgtttctttggatatccgagtttgtttcatatttatgacttctagatggatactatacgtatgtgatactgttgtttgctaacaatgagtcaagttggtgatagcttggtctcggaatatgatttcttttttggttcatgtgtaggtgactcgacgcctcgggatagtattttgcggtgatggaccgggagtcggcttggtggtaagacgatgtccgtggtggttagagatcatgcgggatactcaggctagagttgatgcatgtggttggtgaagattccatatggcatacgatggaggtattgtgtgcgtatgggatgcggagtcgaatttggatggagtccaaatttggtatgattggttatgttaagtttgttttttgtactagaaggtttcctaggtggattaggacatctagtatgagtttggttcgtggctttgggctgcttacctcatgtataaatagagggggagcgtgaggcttcctggtatctcttttgtgttgcttttcatagcgctgtgttttagggtttcgagtttagtcgagattttgtaaggagtgctgttgttgcactttgtaaacaaagagagaagtaataaagttgtcatctacttcgagagttcttcgatttgtgtttcatcggcaaggcggcggtcagaccggcggagcgacaacggtcagactggcggcgtcaggcaagcgcggcaggcaatctcggcggttcgactggagcttctacctcggtcagaccggaggcatctcgacggtcagaccggtacaacatcttcggtcaaaccgcgatccatcgattcgagggtaacttttattttccgctaaaagtttttgggtctttgggtataccaaccattcaccccccctctggttagcttagttcttgtgattcggtcctacaaaaagttggtacaaaatcattcttaccggtagtgtatataagaccatattataaagtagtgataataaaatatgtatgtcatataatgaggatcagcgttattcttatgataagaaatggttcattacttcaataaactgagaattatgtcacatttcaaaatctatgaagttcatgtaacggaaattcgtttatcacctaaaatgcgtccctaatcatgttttgtaccgaaaatgtatttttctcatcattaatttagtgatgatccttctttcgttattaactttatgatgctcatcttttcttccaatataattggtatccattaaa

SEQ ID NO: 22491 - DNA, 6643 bp, Oryza sativa
taaatcgctcattctttttcacgctaattaactttccatctgttacatcaccttttgctaaacaccacgatgggagctgaagcagcccgcggcggatgcatacacaccgctggctatggcgaaacctcagcgaacatgtcttggcttcaggaactgacggagctgctgttgcagcaacacagtaagtaatagagagattgatcaatcttttttctttatgacttttgcctaattggtcgcagctgtggcggttctagggactgaatgcaagctttatagattgtagactcattctattcaatccacggtacatcgctgaaatatgaatttctgtcttggaattaatgtttggcttatttttgtttttgatggcgaaatatatggttgatttaaccttacagcacgcaggaaaatattattggtagaaatgattttgttttttcaattcatattcagggtatcacataactctggcttcttgacatatacaagtctctagcggagtgtgttctcgatatatcagcacagttagtctatccttacttctttttagaaaaatcttattgctttaattgtttgatttgatattcgtgcttccaaataactgtctacgaaacatgtctatagaaatcgaatggactgcaaaaattaagttcctccgctctctttttttttttgctgtttagtttatcttttacaatgtcagaggaattttattattaaagaatgtaagaccaggcatggaaatatgcgtgtattcggtaaaagaacaatgatcactagcatcattttccattacattacaagatattgtgcctaaggttcagcgctgtgggtcttgctacctgagtggcagtgcactggacatctgaccaaccctacttgagtcttttttttcctttctatttacttagttatttttttactaagacttacaactgctatatattaaaatatatagtaatatgtacatgaatatcccgcagcaacgcgcggggtgtcatctagtttcatcattatctaagacaaagaatatcccaaaatggcttatggcctatcaaggtccctatagtgagcaacttgtttatgggctaagcccaattatatgcaggcctggctcatttaaggagtagcactttactcatgattttcagctcaattgtattatatctatttgtattagtatgaaataacaaaagggccaagcccctcgcgcaggctccatcatgctaaaatatgcttaataaacattgatgtgcttatttattaagatcttgtataggatcgcatctattccccttgaaacctgtttggcatgtttatgcaacttctgatttcttatagtaaataaataagtttataggcaaaaataaaatgatttataatcatctagttttagacttgtgttagcagtatcgcacgcttatacaaccatagaatatgatatatcctcaggtccaacttctcgattttaacgtatcccaaccccaaattatgcaaaaatgggcactatatggataagaaccatcttcatacagaatagtgcacaagtcctccgcttcggtcaagtatttactatgtttcgagttaatatgccaagggggcaatgcatgccatatgttacagatttaggccccattaattgcaaactagactgtatgaattttagaacacttttttttaggaattagtttagtttgcacaaaatttaccaagaattctctccattgaaataaggcctcgcatgttgggaaaacaatttgcagttaagtctatggaatgtcctatattgcatcggctatatgtcaacaactccagtcaggcccaatactatgctcgtaccctgctagagctacctaatttcatgcaggtcatggcagcctgacagcctatcgatctgcagtgatgtagtgagtacgcgctgcttggcggcaccccagggtcgtcggtccatgcctctacctttgggttgcctggaattctcgcgtaatccgctggatagcatggaggtgaaccacgtttcttttccggtattgcctattctcatttctcaaatgaatgaactctagtaacatgtgatgctacatcctccctttataaaaaaaacgacgaatcttgtgtcatccaatcctagattagcttttttttttttaagaacggagagagtacctgtagaagttaataaacatgaaaatgcaagaggggaagagatagaaagaagatattgttttatattttatttggcaagcagatggacgctgacagattgcttggatagggaggacagttacatggtttcatgcaattgacgaatgactgatcatggccttggtagacaaaaatgaaagaacacagcatataaataagggaggctggaggaaaagggtacgaagaatccttgtaagttttttcattttctaacttatacttataagttaaaggcatgcaacataaataaaaaaaaaagctacgattactatatgtctgttctcagcggttcaaaactaatactaaaaatataaaagccatctgtcgaaacatgaattcggcaataataaaagggggtagcgcacgagacctaaaagtggatggatacggagacaaaagatttcgacaggtttaggccctctcaatgagaggtaataccctactcctgtttggggatttgaatccgccgggtgtattatagatctgacgatctgattgtgtctcatgccccctagagggcctcctgcccaccttatataggatgggggccaggattacaagatagaaaccttaaccaatacgatatcggtttcctaaatctactttataattttatcaacccaggactttaggccgttccataatatacatggaaacgtaataaccaagtcatgatctgttacaaattctatagatataagttatcccttataacagtcggataaccatgccgtgtgggtatggggtacccataatctccacagtagcccctgagaccttcgcagttgaaaagataatcttctctcgaactagattactccaaagccgagtgcttcaatcatcttcttcatggtcccccgagtacttttaccaaatctgaagactacggagggctgaacaaaaattgaatgtagacttaggtgcatcgactagatgcacctaataggtgtagctcccgactatgtggttagttgaacaaaccaagcatatagtcaaggaataaataatccaaccaacagagtggttttcgataattatagtcaaccaagtgacttgatatcaatatacagcatatgcggtgtgaatctccaaataacatgatccgagtgatataccgacagctttgtaaaatataatgcgtgcaacctaaagctgacaacatcattgaaaagtcatatagcaaaacagctataaaaaagcttgaatgctgtgaataaagaaatttccaaagtattggacatacgccatgtgcacactgctttaacagatgtgcttaagtccctaaaagacacatggtttcaccacacccagaaatatacggcatacgtggtgtaaaatccgagtaaataaactcataaagaatttaccaaccgcctgaaaaatgaccaagatatataatcagcctaagccataatattggtcaataaaaatgcacagttacgtggcaaaaagcaatgatattgtatccaataaattgcttgataaacccaaacagtgccttgactatatataaaaaagtcagcggagcagctatataaagctttactgtttgacaccttttaagatgcattgtaccaactcctaaaaagttgagtaactgcggtataaaaggattttgaggtattgggcacttgatcacgcgcactttggcctaagcaaaaagtgcctaagtccctaaaagaacgtgacaggccacacctgataatatgggctgcagacatattaggcctagggcaaaaaatatgccttcgacaccctttaaagggtgacgcatgtaacatgctcccgagtaataaatcttccgggtgatatagaccaagtgtagctcatatgaatagcttctgatctgagtgattatcctttatgggatactccaaaatagatataacaattaaatcctgattggtgcaagtattcagttgatagcccttacggggaataatgagtggtccagtagttgagcaggataaatcaactcatgaccatgaatccatgttgaatgtatccggaacaagtccaaattgaaggtatgatacttgtgtttgagctagtaggcccctgagcatatagcgtgtccttttgtcgtagtcacaattgtccattgatggtagctgacgcagttggcatagagacaagacaaccaatatagagagaatattgcccactagaggtggcaaaaatattggtggtagtgaaaatagtgataccaatcaaaagtgatgaagttgcacaaccgtgaaggcaaagaaaccagtcggcagcagtcaggtcagccagcaatgaagatgaaggcgcccagcaataaagttgtgtagccatggcagcgaaataattagtcggtgacagacaaggcagctggtgaagaagatgaagatgcctactagtggcgacataataagccatccgtgaaggcgacgataccagtcggtggtgacgaaagcaagccgacggtgaagatatagacacgcatcaaagacgatgacgaagtccaccaatcatgaagatgaagaaaatagtcggcgacgacaaatgcaaccgatggtaatgacgattggcagcaatagagatgatcaaatatgataacgaagttgcgcatcaaacaacagtagaataggctatgttgaagaggtttgacaggatgttgatgaagatgacgatgtcggtgatccagtcaatagcgttgtagcagccgacgataatgatgagatcctctatcggtagttgcgtagtaggccaaccatgaaggcgaaataacaagtcggcaatgacgaaagcaaccagaggcgaagacgtagtcacccattagcaacaacggagacatcaaggctgatgaaatataggtgctggtgatgatgtcagtgacaataatccatcaaactgttgagaagatattgaagctcgagtagtttccttgatgcgagcgtgtgcataacgaagactgatgcaatgccccttgatttataaagacgtcagtagaacttggtgttatagttgttgcagatgctccacttagaggaaagtatatgctattgttcaactcattgaatctgatctgagttgattggttgatgactccaaactcccagacatgtaaattaaatctcaaacttgagaaatttggaatagattgtggcggcgtgaagaagccaaaattgctggtgtaataatcggagtcgctgaaattagatgtcggctctgaagcgaagacgaagataataactccccgagttgactcgttgattgattgattgcttcatcttgacataaagcttgtcgaattttgagagtcttgtatttgtgtagcccccgactctttggttagttgagaaacaactgaacatagagtcaagaactgtagcttcttgtcgtcgagtagtcattgcttcagtgaagatatatgttgaagatgtccgagtagaaatattgaagattggaacaccacttgctgtaataatataacacggcatcatatttggtgacgcatgccgagatgtcgaagctcctgtagacgtcgtggttggtgaagtaggaaagcttgcaaagtaaaggcaatagagtttgctggtgctgaagacaatgaagatgaagccgctccaccatggcgacaaagttgcatagccgtgatgaagcgaacacaagtcggcggcaacagaaacaaaccggtaccgaagacgcgcagccgtggaggcgaacaagccagtcagcgtcagataaggtgaccagcaatgaaggagatgacgtccatcagtagtggtagcggtataaattagccgtagaggcgagggcactagtcagcagcagaagagacgactagcgatgaagacgataaggccaatcaacactggcaaaatcatgcacccatggtagtgaagaaaccagtcggtagaacacgtagacagcttgcattgaaggtgatgatgcctatttgcggtggcggcgacatagccagccgtgaagacgatagcaccagttggcgtcatacgaggtggccggtcggagaagatgcagacgtcctacaatggcggcataataagccagccgtgcaggcggaaacaccagtcgacggcggacgaggcggccggtcggtgaacacatagatgcccaacaacagcggcataataggccagccgtgcaggcggaaacactagtcggcggcggtcaaggcggccagtcggtgaagacgtagacgcccaacaacgtcggcataaaggccagccgtgcaggcggaaacaccagtctgcggcggacgaggcggccggtcggagaagacgtagacgcccaacaacaacggcataataggcgacccgtgtaggcggaaacaccagtcggcggcggacgaggcggccagtcggtgaacacgtagacgcccaacaacggcggcataataggccaaccgtgcaggcggaaacacctgtcggcggcggacgaggcggcc

SEQ ID NO: 22492 - DNA, 1213 bp, Oryza sativa
  unsure (1)..(1213): unsure at all n locations
tggcggccggtcggtaaanatgtanacgcccaacaacggcggcatataggccaacccgtcaggtggaaacatcagtcgtcggcgaacgagacggccggtcggtaaagatgtagacgcccacaaacggcggcataatacgccaaccgtgcaggcgaaaacaccagtcggcggcggacgagacggccggtgaaaaggtagacgcccaacaacggcggcataataggccagccgtgcaggcggaaacaccagtcggcggcggtcgaggcggccagtcggtgaagacgtagacgcccaacaacggcggcataaaggccagccgtgcaggcggaaacaccagtcggcggcggacgaggcggccggtcggagaagacgtagacgcccaacaactgcggcataataggccacccgtgcaggcggaaacaccagtcggtggcggacgaggcagccggtcggtgaagatgtagacgctcaacaacggcggcataataggccaaccgtgcaggcggaaacaccagtcggcggcggatgaggcggccggtcggagaagacgtagactcccaacaatagcagcataataggccaaccgtgtaggcggaaacaccagtcggcggcggacgaggcggccagtcggtgaacacgtagacgcccaacaacggcggcataataggccaaccgtgcaggcggaaacacctgtcggcggcggacgaggcggccggtcggtgaagacgtagacgcccaacaacggcggcataataggccaactgtgcaggcggaaataccagtcggtggcggacgagacggccggtcgatgaagatgtagacgcccaacaacggcggcataataggccaaccatacaggcggaaacaccagtcggcggcggatgaggcggtcggtcggagaagacgtagactcccaacaatagcagcataataggtcaaccgtgtaggcggaaacaccagtttgtggccgacgaggcggacagtctgtgaacacgtagacgcccaacaacggtggcataataagccaaccgtgcaggcggaaacacctgtctgtcgtggtcgaggcagncggtctgtgaagacttanacgtctcacaacggcgggataatatgccaactgtgcaggccggaataccagtcngttgcngacgagactgcccgtcgattgatatgtatacgcccaactaacggctgcataatatgtccaccatac

SEQ ID NO: 22493 - DNA, 4457 bp, Oryza sativa
ccagtcggcggcggacgaggcggccagtaagtgaagatgtagacgcccaacaacagcggcataataggccagctgtgcaggcggtgacaccagtcggcggcggcgaaagcaaaccggcggtgaagatgtagacgcctaacaacggtgttgtgaccaaccaactgtataggcgaagacaccagtcggcggcgacgacggcgagccagtggtgatgttctgactgatccattcgtggagcgtaagagataagcttaaagccatgaatcccttttatgcatatctggatttggatcctgcagaacaaacatataggatgagtagtatctgatgtaaatataatactcgagaaaaattcaagcattttaaaatgtttataaatatgtatttcttctcttgttaattttgatttccacgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaaataaattatcttatctctatgcttttgatttattccgaataatacttagcaccttgcgttactcggtctatccaacgagcccccgggtgctaggaatcggcccaaaggcaactatccatgacaaaccaaacggaaagcataggaagatagaactccataactcgatagacacttttgtactcagattatgtcacaagcaatcaagataaatattatgaaaattattgaaaaatatgttataacatctgtagcccccgactcactactcaatggagaaccaattgatgtagtgaggcagaggaaaaggaaaatatcatataaggaataaatgatgacttagctttgtaatattccccttggtgatagcagaggtggccaatgtgggaataaagtcgtccatcaataacaatgaagacaccagtcggcggcgacgaaggcggtcgacggtgaaagcgaagatgcccaccaacagcggcataataggccagccgtgtaggcagagacaccagtaggcggcggcaaaggcagaccggtcggtgaagacgtggacgcccatgaacggtagtgtgaccaaccaactgtatagacgaggacactagtcggcggcgacagaggcaggccggcggtgaagatgacgattcccatcagcaacggccaatggagaggcgcagccgggtcagcgtgagctatgagaggcgcagccgggtcagcgtgagccatgcaggggcgatagtcgggctcggcagcgtggaagcagccaatcgcgaacttgttgagacggtcgacagtgtcagcggatgtagccaaccatgtaggcgaagatgcccggcaatagtgagtgcgggctaacacgccgacaaatcaagtcgatactccgcggcacggcgacggcctgaccaccacggcgtctcagtagcacatgcaatcaaacaaataattaaattgatcagcagcagcaaggaattaattaaagataaatgcacaaatatcacgtgaggtgtgattggttgctggcttgatgggcatgcatgttgccgatgcatggtcctgtgcatgctggtgacgtgtcatcatatcatttgttggccatgttgccattcacagccttgttgaatttggttgttgatgatgtcgccggtggcgaagacgaggagcttgaggatggcgagagcgatgtcgcggtcgtagcagggatctgtcgacgtctcggactccttcgcgtgatgcaacctgcccgactagttgacgatgacggcgcggcagcagccgggcagtcctcgccgactttgaagcggcggaggaacagatccgcgactccaggaggacggcggggagggaggcgacgtagtcgtcggagcggaggaggcggaggtcgcagccgcgcgcaggcggcgtagctgcgtgcgcggccccggcgtcgtcggtgtccatcagctgcaaccgtctcctatgcatgccgattagatcggtttcgtcatgcctcgtgtctgtagatccatcttgcagcatcatagcatcttcgttggggtagattgattggttcagtaggcttggtagtggatgaccatctgatccatcggatcgtcgctgccctcgtgccgatacgaacaggatcaggcggaggactgcaacggcgattggtctcagggtttagccatctccttcttacttagattgaatctctcctgactggtttggatccaagtcagagagtgaaaacttgttaaagttgtcagcggcgatgacaaagcaaaaatcccgaagcgaagtgaagacgaagccgacgactctttgagatcgatctcagcacatctccagaaattgattccatcgcacttctcgatggaaagctcgacgcagcccctacctggcgcgccaactgtcgaaacatgaattcggcaataataaaaggggatagcgcacaagatctaaaagtggatggatacggagacaaaggatttagacaggttcaggccctctcaatgagaggtaataccctactcctgtttggggatttgaatccgccgggtgtattatagatattatgatctgattgtatctcatgccccctagagggcctcctgcccaccttatataggatgggggccaggattacaagatagaaatcttaatcaatacggtatcggtttcctaaatctactttacaattttatcaaaccaggactttaggccgttccataatatacatggaaacgtaatacccaagttatgatctgttacaaattccatagatataagctatcccttataacagtcggataaccatgccgtgtgggtatggggtacccataatctccacaccatccacacttttgccggtagcatattaatccatccacataaaagtcatcccactaaaaaatatctttcataaaccaaacggcctctatgtgaaaattgtgtatgtgaccaggctaaagagagaaaaaaaaccactcgtctccgacccctcccctacatcactctccaaattagctcaccaaattagctccatccctgcatcactctctaggttcataacggaaaaaggcaatagggacggaagtagtaacatttcactttactctgttgtagaaatgtaggggtagaatttatgggctattatttgttttgtgctcgggtggacgatggaagtcaataatcgatcgggcgtgttcggttatgtttgtctgtccagcctgaactgaaagcatgcaatgttgttttcctgaaggatgcttgcggccttgccccttgaattcgcgtgagcgtcgtgcgggctcatctgtttgtgctcgacacatatgctctgttgatgcggggttctgtgtttttctgcttctggcgcgttgttacatgcgttgtaacctggtccataggatatatggtcgatgttaatggactaatggtcgtcatggcgtgcgtttaggccggcttataaccaccacgatattgtgtttcagtttattttttttaagcaatgaaagaaccacacaaaagctaccaagttttggcagcaccaactcgatcggtttctgtttcttgcactgttttctcgcctataggtgttcgtccattcagtgttggtgtgtgttggacgttactagctaggagagctcatgttgaaccaacttatgctgtgcccatgaaccacacgttgagcggtgctatattttgtatttctttaaaaataattgaacgcgtgccggtgcaagcaaagattcaaagcaattcgtaacttaggggtgtaagtgggctgtctcacaaagccaattatgggctaaataagcaggtaattcgttggtcagcctataaattagtataggaataagtacatctgagtccccttaactttacaccgaatccgattttcatccttcaacaccaaaaccagatataaccggtccctgaactatcaaaaccggtgcaaacaaggtccctctacggtttagaaggcggttttggctgacgtggcgcctactgttggtatttcttaacgacattactagaaatataattcccagtaatagcgcagaaatacttctggtatattatggttatagagttcatccgcaagcgcacggatatactatcgtagcatgtcacccgagagtattccaagggtatcgtatttattttatcccgtgggaagatcatgtagagagaactcaactaataatttatatattacttgtgataattatattgtaagcaggggttaagataatccaagggtagagtgacacacaagcattactactcattctcataataaatatctaaactaaatggaaagaaaagagaaagaatatatcctatacttctatatacatagtatacatatattctagttaactgata

SEQ ID NO: 22494 - DNA, 16212 bp, Oryza sativa
ttccttatgacagtccgtcatgaccatacaacggggcctaaatacggaggaataccctccccaggaaattaacttaggattatatataggcgcgaaggaatacccgtactgagctgttaccatcagcggcccacctctcatccgcaatatataaccccaaataatgatatcccgtaatctagacatcacgcctaaactatcagatactactctaatatcatcgtcatgacatagagtaattgcataagcaaacattatacccgcaccaaagtatctcccagataagctagctgtatattcagtataacatgaacataatgtaaagtaggtactcatatactcggaaagtatttcaataccataaatatatatagaagagtattctaataaaagtacaaagcttacaaaagaggaaaggaaagttgctagagccatacctgaactcttccgaagacttccggactcctattctatttctattccaccagctagatactactaaactaaacttgagagaaatgagagagctattgcttgaggtgtgtgttgaagtgaagagagtgagctccttatatagaggtagttatgacggttgtggaaggggaattgtccgaagtgccctccaaccgtcattgggatgcaatcctggacgtccacgccaaaacctggtggcctcctctattgctccactccgcagacttgagaattttggcctaattcatcatgttagttctgagttcttggcctattcacacacaagtctggttcttgacatcgttcgattgatgtatcgtctgagttgatgtcgattctcctccactttagtgtcattccccgcaagaggttagtatacctaatactagtggagttttattattctaacagatatatgcattgcaagcatcactagttctcctctattttggtaatattgatggtcgaaactgatcgataacgaccgtcagcaaaaccccccaagcttgaacctttgcttgtcccgagtgaaggacgaaaggaaacaatgatcagaagttgctactatgctgcatatctcaaagatacaggtgcaaggtatatgtactctctctcagattaaataatctttggcacggtggcttgctcttacccctgattcccacgagacactgcttctccttgcctcgggcggttgaaagacagaacagcaattagagcaccaatcacctgatctttattcaactcttattccgaaagttttcaaatgattttgaaaaataaagccaagttcctcaaataattcactctgtctctctaagtgtatcaatttgaattcctcaccaaatgatgcctttttaattcctactctaaggttttgatatgtggagctcgatagggatcaaacatacataattgcattcacatttattactaagtcaaaatcttagactaaagcagataactaaacatactcaagatcaaggtcgtgtataatgtgtgtgtggtatatagtggaaacggtatatgaggaaaaataaaagaaaaatgcttctcctttgtgtgtactttcttctcccaaaatccttcttttattgattaggagagggcatggctacattttttttaacatcatgctcatgcttgatggagcataactttatttttttttattttttccataaccatgcctttccctccttcttttctctttttttttcaaaaggacttttcctttttaggagaagaaagcacatgaaagcatggagaatttattttggtggtaatatggaaatggaatagaatattgcttagctcccagtgtaggagtttagcatgtgcatatatgtgggtgtatgatcttgatcatagagcatgacaaatatctacacaagtcacaagagtttgacaaagttcaatggaatgaaaagcaacaaaaatgtaaatggttaaatcatgatagcatatttttggctctggtaggaatttatatcaaatgaggaactttcaatttatcattttgaaaaacaaatcatccggaattcaagtcaaactagtatcaggatcgtagcaactcatatttactatctcatatctcgcaacaacttatacttagatcagcaagtgcagcccatttacctcaagttcccggataatcgttggctacttaatattaatcttcgtgagagcacttaccaagaccccatatatcgaagatataaaacaaatcaactattcatcatttcaacaaagagaactagcttgtcttaactagcatgactcacacctatcctatctttttttggggtattttctattttgcaaatttttatgttgttttcattttttatagggtgcattttgaaagcaaatatgcaattagaaagggaaatatgcaatgtgatacaagttacctcagtggggggagcgatgtctccccccaagcttggctttcgctcagggtccttgataaggattgaagccctgaaatcgaaagtacgcctaaaggttatcatgctgttgctgcatcatgttgttgatgttggcgaactgagcatcagcagattgttgccattcttgcgtttgagccatgtgttccgtgaggttgtactggatctcccccgtctgcacatcaagggtgtccattctcctagtgatttcacccaagtcccaacgagaggaacttgagcgccattcacttggagatgaagacacatcacttgatctgggaggttgattgtcccccctttggatgtcatgaggcgcatgccaccggtcctcactggcgcttgcccaggttgagactccgatgctgcggcgtggagcttgggtccatccgggtgcatccccagttggtgtccaacctgcctcatacatctgcacgggtgtcgaggataatgaaatttctcgttcgttccttgtcatgttgtgcatctccctgaatgttccacctgcacgagattcttctatggtctgtaggggaatggttagttcgtggcagttgtacaaatgataccccgcatttggcaacgggatttcatttgtacaaccagggaaaaagtatatcaaagatccatctgctccatgtttcaaaatatgcgctagcactagataagcctcatcaatacgcggacgagcggctaagataaaagcaatttggtcgctaacgacccctagcccttttgctattcaagtaatcagagaagtgcactcaacaggagcagagaaccttatactttctaaccattgccttatcatacatttcacagtagcaattttgatttttctaaccatggcaaacatgataattaattcatctcccttaatgggtctcagatcacctctaggaaacaaagtcatagcaatccatttgtgcatgagcctaagtgtaggattaaggatatcattcgttcttggtttcttgcaaattggagcaccagaaatgtcttcccaaaacctatttttctcgaacccagaaattcctttctggagatcgattttgcaggaatcgtgaaaaccaagaaatgtacttaagcctttccatgtaaatgtaaactcttcatggaaaaagcgaaaagaaataccatcttctatttctttcaaagtgcacagaaattgcaaagtaagcaaacgagaaccaggctcatctaccacagcaaatctctaccaaccaatagctttccaaatagagcgaaattcaacatccatacctatctttttcagcaaatccggtgagtattctcgcgtgtgagcatactcccggtcattcagcatgtagtaggcttgcctctcccgatcactgacaaggtcaaggtcagtgtcgctcaggagttgtcacgtagcttcggcatcttctattgagacatcggctgatgaacaagtactagactcgtcatgacgacttgatgaagagccggtccccttgaatggacgagacaatcgcctcctcattctgcacaatgaagcaagaacggactaactcggcgggggttagaaatgacaagaatttcacccgccggttaatttcaccaaagcaacttgtatatatgcaactaaagatttgaatttgagggaaactatcaaagcttgaatgaacttgagagcaaactttggagagggaatgaaaatgtgttgaaatgaggtggagttccctctcccggttggttggcttaagtagtgcacccacaacggtcaaaaccgacctgtgtggcccactagccattgcctcaaaggaagaggcagccgaccgttggcctggccggttcggccgaacccctggtgggcccaaccggccccactttcggccgtttgattccaacgatcagtgtggtcggtgcacaatgaatttattttggtttgctttgaaaaatttatttgaagaattccctcaaaattcaaaaatactaaatgcaattttgaaattcaaacatgtgatgatgcaaaaattcaaattgttgaaagcaaatatgtggatacataccaatttgcctgttggtgaaggtcgcgtcatttaaagtccgacgtgcaagaccgtacctccttccaatttagtgcgcggattttctacccgtctccggaggtgatggagcgggcatctttggcttttccttccacaccttctttggttttggtgcagagggcggcttcttctgagccggctgctctaacttcttggccgatacaggtgattttaccggcgtcctccaataacggttcctgggtattgttgtttccttctccaggaagttttgcatgaatttcactaggctgtccgtcttgggcggctccactttgacctcttgaatattctgcgggtttggcccgtatttgattctgaccatggagcattgttccgtcctcggttgaaactcaaacttttcctccttcccgttgatatggaaacagatactccccattcccacgtcaatgttggctcctgcggtgctaaggaatggacgccccaggatgagcggcgtcttcttccccgtgtccatgtctagcaccacaaaatcaaccgggatgaaggaatcccgtatcttgtctggcacatcctccgctatccctgccgggtaacggactgacgagtcaactagttggaggcgcatcggcgtcggttccaacatcgtgaagttgagcttgtcaaagacgtcttttggcatgacgctgacgctagctccaaggtcgcacaaggcctggtcgaattgttgtgccccgatcaagcaggtgatcgtggcacaccccggatctttcttcttctccaggagcatgtggagtatgacgttgctgcattgttccgtcagcttaaccacctccgttgttgggagcggtctcttattgttgagtatgtccttgagataacgggcatatgtcggcacttgcatagcgtccaacaacggcacgttgatgtgaatcttctggattacttcaacaaaacgagcgaactgctcgtccactgacggtttcctactccgttgagggaatggcagcaaccgtgtgttgtagtattccagcggcacggtcttgttgggctgaatctccttgtaagccgagtcattagatggcgcttcttttgacatcccattagttcctgcagggttaggatatggcggatcacgagtggacttacctcctctcgttgtgatcgctttgacattttcaatagaagagtcgggttgccccggaatcctcccagtttcatttgcagggactaaagatgctaactgagctaactgggtttctatcattttattaaagctcgactgattttgaaaagcagaagcaaagccatctagtttgacattaatgttctctaggatcttatcgttagcagcaagatttttgcttagtgcatcagtggttttagcttgtgcaaaaatgagatccttcaaggagggctggttagacaagttatcattattgttacctgcttgataatatgggcgtggttcgttccacccctaaccttcttgtggacggtacccgttgttgttgcccatatacatcgtctcctcacgggtttccgggcagtcattccgagaatgacccgtgccgccgcagacctcacacgtgacgtgtgaatccatggccttgacggtgccctgtggccctttctcgtggtcgtccaagcgtttcatgacgaggtccagcttggcagcaagtaactccgtctccgtgacggtaagcatgcctcgctgacgggtctggagtcgttcctcgctccaacccatattggagaccatcttctctattaattcaacggctccttgaaccgttttagagaagaaagcacctccagctgccgcgtctaggtgatcgcgggacattggggtgagtccattgtagaagttctgcaggatcagccagtcgaccatcccatgatgaggacaggcggccacatgctcctgcagacgctcccatgcttccggaatagactcatcccttgtctgctggaaactggaaatccttccacggagggcattggttttgcccatcgggaagaactttgagaggaatgctgtagagtatttatcctaggtgttgacaacagcacggttggcataaaaccactgcttcgctctcccaaggagggagaacggaaacagtcgcagcctgacggtgtcgggtctgactccctcgatggtgtatgtgctacatatctctaggaattgttgcagatgagcgttggcatcctcattaggcttgccacagaacgggctagcctgcgccatcgtgatgaggttggatttcaagtcgaaatccacgtctcctatgttgacctgcggcccaatggccacattgtcagcagagggagcagcgaactcgcgaagagtcttgctggccattgtcttgaaggtcggtggcgctggtacgactggtttctctgtcggtagaattttctgcagagcaacgactcacggcctgacggtccggaagaaagcttctggattttctttgaagctttctggtaggttgaaaccagtcacgcactaccctgttttcacaacaacaagtgaaaacaaccaaggttagcctgcaaaggaaatgattacatagaggtaaatataaagtattagttcaagcaatctctattatgaatcttccccggcaacaatgccagaaatactcgttggtatttcttaaagacattactagaaatataatccctggcaacagcgccagaaatgcttattggtatttcttaacgacattactagaaatataattcccagcaatggcgcagaaatacttctggtatattatggttacagagttcatccgcaagcgcacagatataccattgtagcatttcacctgagagtattccaagggtatcgtatttattttatcccgtgggaagatcatgtagagagaactcaactaataatttatatattacttgtgataattatattgtaagtaggggttaagataatccaagggtagagtgacacacaagcattactactcattctcataataaattatctaaactaaatggaaagaaaagagaaagaatatattcctatacttctaatatacatagtatacatatattctagttaactgatatactagctaatactctctatccaacgccctcctggtacttcgagaagccacccctgactgccgagttccttatgacagtccgtcatgaccatacaaccggggctaaatacggagaaataccctccccaggaaattaacttaggattatatataggcgcggaggaatacccgtactgagctgttaccatcagcggcccaccactcatccgcaatatataaccccaaataatgatatcccgtaatctagataccacgcctaaactaccagatactactctaatatcatcgtcatgacatagagtaattgcataagcaaacattatacccgcaccaaagcatctcccagataagctagctgtatattcagtataacatgaacataatgtaaagtaggtactcatatactcggaaagtatttcaataccataaatatatatagaagagtattctaataaaagtacaaagcttacaaaagaggaaaggaaagttgctagagccatatctgaactcttccgaagacttccggactcctattctatttctattccaccagctagatactactaaactaaacttgagagaaatgagagagctattgcttgaggtgtgtgttgaagtgaagagagtgagctccttatatagaggtagttatgacggttgtggaaggggaattgtccgaagtgtcctccaaccgtcattgggatgcaatcctggacgtccacgccaaaacctggatccaacgacgccaggattggttcggccgaaccaccaggttcgaccgaacctggggctggcccaatccagcccaattttggctggtggcctcctctattgctccactctgcagacttgtaaattttggcccaattcatcgttttagttctgagttcttggcctattcacacacaagtctggttctcgacatcgtccgattgatttatcgtctgagttgatgtcgattctcctccactttagtgtcattccctgcaagaggttagtatacctaatactagtggaattttattattctaagatatatatgcattgcaagcatcactagttctcctctattttggtaatattgacggttgaaactgatcgataatgaccgtcaacacctacgtggcttgtttgactaggtcttcgttccatgtggcattgacgtggcgcttatgtggcaattctatcgcggaaaaataataaaaaccatgggcccacatgtcagttacaaaaaaattatttaaaatggtggggcccacgtggcccgacatgtcagcctcactcattttatccctctcccttccatctcccctcactccctttcatcacttatttcttcctctccctttcatccctctccattccatctcccctcactcccttccatctccctttcatcactcatttcttcctcatcctcactcctctcttcttccgtctcccctctctctctcttcttcctgttgagcgccggagcggacaggcgggtggacggcggagcaggcgagcgaggagggctgtccgagctccagtggcggcggctgctcgccgtgcgccgcaacagggatccccaagatggtggacaatggcaccagcgacaggagcctcgaccggcggagaggaggcgccgcagtggccggagctgaggcggtgggcgccgtggtgggggccgaggtggcgggggtggtcggcactgcagcgggtaaggtggtggtaagtgcaacggcgggcgcggggtgttgggccccacggccgagtggcgggggtggtcggcgcagcggtgggtgcaggcgtcttgttggaggagactggcggcgtggtggtcggcgcttgttggtatttcttaacgacattcctagaaatataattcccaacaatggcgcataaatacttctggtatattatggttacagagttcatttgcaagcgcacggatatactattgtagcatatcacccgagagtattccaagggtatcgtatttattttatcctgtgggaagatcatgtagagagaactcaactaataatttatatatcacttgtgataatcatattctaagtaggggttaagataatccaagggtagagtgacacacaaccattactactcatcctcataataaataatctaagctaggtagaaagaaaagagaaagagaatctattcctatacttctaatatacatagtatacatacattctagttaactggtatactagctaataccctctatccgatgccctcctgatacttcgagaagccacccctgactgtcgagttccttacgacagcccgtcatgaccatccaaccggggctaaatacggaggaatacccgtactgagctgtcaccatcagcggcccacctatcatccgcaatatataaccccaaataatggtatcccgtaatctagacaccacgtctaaactgccagatactactctaatatcatcgtcatgacatagagtaattgcataggcaaagactatacccgcaccaaagcatctcacagataagctagcagtatattcagcataacatgaacataatgtaaagtaggtactcatatactcggaaagtatttcaataccagaaatgtatatagaagagtattctaataaaagtacaaagcttacaaaagaggaaaggaaagctactagagccatacccgaactcttccgaacgcttccggactcctgattcctattctaattctattctaccagctagatactactaaactaaacttgagaggaatgagagagctcttgcttgaggtgtgtgttgaagtgaagagagtgaagtccttttatagctcagctatgacggttggaatagtcggtaatacctccaaccgtcattgcggcttcatctccaccgtccatccaaaacctggatccaacggaggcgagggaggttcggccgaacctggggctggcccaatccagcccaatttcggctagcggcctcctctgttgcttcacttcgtagacttgtgaattttggcctgattcatcgtgtcaagtctgcgttcttggcccatcatacacaagtctggttctcgacatcgtccgattgatttatcgtctgtgttgatgtcgattctcctctactttattgtcattctctgcaaaaggttagtatatctaaaactagtggaatattattattctaacagatatatgcatcgcaagcatcactagttctcgcctgttttaataatattgacggtcgaaactgatcgataacgactgtcaatagcgctgccgcggggtcctgcgctggccacatccccgccctcagtaccaccgccgtcgccgtagaatgccatctccttctcgagcctgacggcgatggagggcggtgccttcttggcgcacgcggtggcgatggcaccggagtggtcgtcctcgtcgtcggagcccgcggttgagcgttccgaccagccccaccaccccggcccctgccacggtgcccaccacctgggagttgtgctgtaccatttgtagttctcgatctcgttgggattggagaagtccttcttgcggaagtaggggatgacgcctagctcgttgctgtggtcgctcagccagatgccggcgaggagggagacgagggtgcagaggagagtgagcacgatggtctcgcggttcgtgtgggtctccaggcggctgcacttgaccttggtgtcccgcacggtgtagaccgcgacgccgatggcccaggtcgttatcttgagctcgcagttgcggagcatgatgttggaggtgctgagggagacggcgcggtggccgtcgacgtcgacggtggcgaggaagccgtagatgttggaggtgccgaggaagacgacgcggcgaccgtcgaggtcgacgatggcgaggaagccgagggagagggataaagggtggagtgaggctaacatgtggggcccacgtgggccccaccattttgaaattattttatgtgtgaaactgacatgtgggtcccgcgggttttattatttttccagatcgaattgtcacgtaagcgctacgtgaatgccacgtcagttgaagaccgagtcaaattagccacataggcgccacatcagccaaaaccgccatctaaaccgctgagggacttcatctgcactggttttgatagttcaaggacccgttgtatctgattttccggttgaaggacgaaaatcggattcgttgacaaattaagggatctcagatgaacttattccattagtctataagggaattcgtgggttagcccacttacaccactacgtccatttgttgcacgagcgaccttttctcattcaatataatgcatacaccgggattaattgctagagcagcagatgtcgcctcctccttgctatgctcggtgagagagagaggatgataagagtagagagagaggtgagaggggaaagaggtagagagagggagagtatgacatgcagggcccaccaattttttaataaaataattgctgattggactaccatataggattgaaaccacttcagattaagttagggggttatttgtcctgtttatatactttagggtgtaaaatatctcttttttagcttgggggtgggggtaattcgatcgactgtgatagttcaagagggtattcatactcttttttttatccacgataactatctatttcttggactgcatgaagtagatatataagttatcgtggataaaaagttgacaggcctaccagggaagcttatgaaacgaaaatcaaacctatttgatttttttacctgatggaatgattaataatccatatcgacttatacgattaactcatattactttcaactggatataattatcgataaccacatagttaaatcagtagccactactacggacaacatttttccatacaggtatttcgattttttcgtgcgattgtccggcccgtctccagccaatcgtatgggaaaattaatattttcgcgggcggacgacccaaccgggcgggcaggcggtcggattaagtggaccacacggaataatcggtcaaattataccgcccgcacggaacccaaaaaaagcgaaaataaaaaaaacgaaaatcaggaccgggcgccgccgccctactcgcgcgccaacccgctcgctgccgccctgctgtggcaacgtatcgtcgtcatcgtcggagccggcaacgtcgtcgtcgtcaccgtcgagcgggggagggcggaagaggggcgccgccgccggatccgggcgccggccgcctcgctccgcaccgcccgcgactccgtgcgcgccggccatcgagccatgctgaggagcgcgcccgtgcgcctgccgccgcgcgtgccggtgctgctagggctcgccgcctccgtctccgccgcgtcggcgatgtcgtcgtcatcgtcgtccaggcggaggccggcgcgtccggagctagggctcgctgccgcgtccagagctagggctcgccgcccccttctccgccgccgccgggatcggcctcgcctccgccgtgcccccctcgctcggcaagcacatcctgcaggagaggagagagagaggggtgggtggtgagaagaataaggatgaggtggtgataaggataaggacgaaggggaggagagagagagttgagaggatgaaattttttttgaaatttcgagagggagaggccaggagagagagaaagggataggggaagtttttttttcgtgcgagtgagttaagccgcccacacgggacaatatattttctcgtgtgagtgacagcctaacactggtttctctatttttctatatggttgcatttacgaaccgcatagaaataaaataaggcgtcgtccaggaaaatctattacataatagtgggcataaataaagaccattaagaagtagtgataatgaaatatgaatgctatagagggaagatgagtgttattcttcgtcctaaaactgacacaactgaaatttactcaaacaacgcatatactccctccatctcaaaatatttgaccccgttgactttttaaaaaatgtttgactgttcgttttattcaaaaaatttaagtaattattaattctttttctatcatttgatttattgttaaatatacttttatgtatacatatagttttatacatttcacaaaagtttttcaataagacgaatggtcaaacatgtttaaaaaagtcaacggcgtcaaacatttagggaaggagggagtaattaacaaattcatactattcaagaagttgtcaagtgactaattgcaaaaataaaaaagtgtccatgcaaaattctcagctggcgttggctcttggtggcacccctcgcccagaactactaacagcagcgcccaacattcctacaggtgggtgcagccgcaacgatcgcgcagaagccgaacagaaaagaggagacgtgtgatcgcgcagtgaagccgaaacaaaagagagaaggacacgagcgagattgccggctagatcttccaattaacgctatgttgtttcacgtcaaaattaaaaattaaaagtttaaagaaattagaacgatgtgacgaaaaaattagaagtttatgtgtaggaaagttcgatgtgataaaaaagttaaaagtttgaagaaaaaagttaaaatcgaaacaggacctaattaacctattagggccccattgaatccaagtcaaaggggcccttaatgtctcatgtccgagtagaaggacgcgagagtagatacagtgtcagtcggagctggtcctgaaattttggtagcccaggacgaggcaaaaataaagagccttgtaacattagtacatatgtatgtatgacaaataatttatatttcaaatagaaagtaatgtttaacttttagacatcattaagcacaaactattgttaggtgatagttgaatagcatacctaaatactataaaaagacatcaaattaaaattattcaagtttatattatgtctccataaaaaaatactatctgttagtgcagagctacaagagaaatgaatcaaccaatcgagagaagtaataaacccgggcccaaacctgttcattcaagctcctatctctagctataaaacaataggaaatcagcaaaattctatctgatttttatgttcaagatgttattaatcatagaccataggctaaagatatgataagattagttcatggttgccaagagagaccaattgcttaggaatgccaactagtactgatagatgtttgtatcgagaggagagagtagatgccttcgagaggaacgagatggtttcaacggcgggcgattcctgagtaggggcgcaagtaccgatgagcttccgggtttttgataacgttaacgtgcttgtgctagcacataatcagtgatttactactttacgtgtaatggccgtgcaagctaggcagacatattgtgcaaggctggtgtttgcttgaggtaacgggaacaaagggcggttgcactgctcgccctgccccaggatcggccctaggttcagatgacttatagtcatggtcggtcctgacatttgagaggtcctagatgaacttgacacaataggtctttaagaagttgaggctaaatatttttatttttaatatatatactatataaagcacatatacgtcactatatagtgacacaaataaacatttctaacatggtaaataataatagtttacaagttgcaatattgtaatttattattgataaataatattgatagtataattggcaagaaaaaaacaccatagaaacaaagtaatatgaatacttaataggagaccacaaatatcctatctcccttataaaaaagggcttcttcgcacatttcttgaagcgaaatcatttcttttgtgaacctattaattgatcttcatgtttttttttcttttctaagcacccaacaaatgtttttggataacattgtaacacctgaaatagtaaatatattgtaaagtaaattatacagcaataatcatgaaaattatagcctaattaatctaatttttcgagtggaaatatcgtacaatgatgcaagcaacaaacctcggtttattgtttgtctaattaacctaattacttcctccgtttcataatgtaagactttttagtattgctcacattcatttagatgttaataaatctagacatatgtatgtgtttagatacattaacatctatatgtaggtaatgctagaaagttgaaacggagggagtacctaactaacctcagtttgccgagggcttatggccggcaacaccacaacaggagactactagactggagatggggagtcgggaagaggcgtgaggctcagaggctcgggcgctcaggtgttggcgattagaggatagaagcggccctggcatggcggcgtgccggcggccagtcggccactcggccaggcgcccggcaatctggcgccgtcagcgcggagagccggagatgagacgcgtcgcggtcgcggagttggagagttactcgcggaaacggaatcgcgattcgcgaggagaaaaggagaaaacgaagcgaactactccctctgtcctaaaatacaacaactcttagctctcaagatttgtctcaaaataaaacaacttctccaccaacattctcttcccacctacctccactactcagccaatcacaatcctt

SEQ ID NO: 22495 - DNA, 660 bp, Oryza sativa
  unsure (1)..(660): unsure at all n locations
nnnnnnnnnnnnnnnnnnnnnnnnnnnnnnnnnnnnnncgtggggaagaagctagacacggtgcagtgcagcgacgaaagaaagtcatcttcgccgcccaccagctgcaggggcccgcatctctctggtgggaccacttccaggctacgcagccagaggggcagccgatcacttgggctcgcttcaccgccgctttccggagaacccatgtgcccgccggagtcgtggctctcaagaagagggaattccgagagttgaagcaaggcaaccgctccgtgatggagtatttgcacgagttcaacaacttggcccgttacgcccctgaggatgtgcgggaagatgaggagaagcaagagaagttcttggcaggaatggaccccgagctgtctgttcgtctagtctctggggactatccggattttcaacgactggtggacaagagcatccgcttggaggccaagcacaaggagctggaatcgcacaagcgccgcttggcgaacttccgcaatcagcagggtgctaaccagagggtccgctacaccaatccctatccagggggatcctcctcgcaacagcaacaacagcagcagcaacctcgcccagcgccccgaactcaattcgtggtgcgcgtcccacagccgcagcagcagaatcagcaag

SEQ ID NO: 22496 - DNA, 670 bp, Oryza sativa
agttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcttcacgtcagctacgacctcatgagggcaactaccctacgcatgacttggagttagcagcggtggttcatgctctaaaaatctggcggcactatctcattgggaaccgctgtgaaatatatactgatcacaagagcttgaaatacatattcacccagtcggatctgaatcttcggcaaaggagatggttagaactcatcaaggattatgacgtgggaatacactatcaccctggtaaggctaacgtggttgccgacgctctaagtcggaagagccattgcaatactctcaacgttcgaggcattccacccgagcttaatcaacagatg

SEQ ID NO: 22497 - DNA, 15738 bp, Oryza sativa
  unsure (1)..(15738): unsure at all n locations
aggcaagtcatccaatatgtttgatcatattgtacccaatttataaatatcccgcatttctattaaatgttgcattcttttacaatgtcatgtgggatgggtcctactactcagccatatattgatttccttatgccattgacaacttcggtattaaaatgactagatgttggtttaggaagtgcttagccatgcttagttcaactagtacacaaatgggggtcacattattacatagactttgactatgagcatagctttggattggtgccaccgcgatggtgttagttaattaaaatacactgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtctagctgccggattcaccgcggcgcaagaggggactgcccactgccttttgaggggtgggggtgaaaccttagcgtggtgtggatggttaggggagggttatgcggagggtcttgtcacgattttcccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtctcacccctagtttagcttaatgaactgctgtagttcaggtggatggttgggcctgttgcaacgtggtgtagcgttggacagtgattggttaatattgattaattactacagctgttttactgctttcaactactgctttgaaatgcctactttatgcagaagaacccctagcttcctttggttatatcctgcatcatacctcctcttccggtatgacttgctgagtacagtgggtagtactcagtcttgctctcttttcccccacaccagagttgaagttcttctcagttggagccgtctcagaaaggttggtttcgtcgctgccgtcaaggtttgcctgtggagtggagtggcccgctgctgaagtcaagcttcccggtttagctcgctttaatctttcccgctgcatttgtaatcttttatattttttgtaagacgtgggtctgtatgtcaacaattgtcgtttgtgtaccctggcttgtcctggacagggatttaatgcacattcagcttagaaattctggttcgagaatttctgagtgtgacatcacccatcctagccgtgaacaaaagtaccgacccaaccttgcctacggtaggtatcccgaacaggcaggctaggattgagcccctagcaacaggatcttgaccgggtgcgctacacacataggggtgagaccacccgcgtactagtccagtgccatgacatctcgactaacggacaccggcccgtgcagccttcatttgcctagacatctcgattaccgagccgcagctcacgtagccttcatttgcctcagagatatccatcgtcgcaacgaattcatccatctctatccgtgtccttttgttcaggactagaccgagcaccgagttaagccttaccaattagtcatgtggttagtacggtagtgctttgcaacagaggcctgagcttaatccttggccggggttctacttcccacaactggcatgcacccaaaccccaccggaaaacaggttttaggggttttgaaagaggaagagtggggcatgtccaattccaccataagccaaccattccatagtgtccaagtgatatgagaattcccaaagtctaaagttataaaaccacctagtgttgcctaattaatcagcgaagcatctacctaaattcatacaaatggaaccatgaatggagtacccactagttggggttttattttccttgggtgaacaaggtaataataaacaataacaatgataaggctataacaaggattaataggaagtgctaaataaaatagtgataatgcgggaatttaaataaagcggtaatgcaataatttaaatcaaaatagttttatatactaggattcaatatgctcaagggtgatgcgacttgccttgctcagagagaacggccttccgaaccatcggcgacgacagcgaaccacgcttcgggaacctccggaatgacataagctacgcgaagcacacaagcaaagctacaagcctataaagaagcaataacaatacataaaaagaaagcacatggttctttgggttataacaaacattaggagacttgaacgggtcgattcggggttcgtatgaccaagacatggtcatccaaagtttactgctgttacatgaagatttgcggattattataattaggctttgcaactataaaacatgtgtaagcgctagcctggaaaagacaggaaggctgcgcttgtcgacatgcagaccccacatgtcaacccaaaggcccacggtagaccgagtacacagagacggtccacgggtcgacggaagcggaccctgtttgtcaaccaaggtgagtggccgacaaacggactccactagacaccatgcgggctgcacacgtggaaaccacgcgactaccgagcgggcacactaacacggtcaccacatgcacacatgaacgactactgacaccggtacacgggtacctgggtcgacaaccgcacgacgggcacggggcgacaccaaaaggacgagaacggggtagcgagaagagggatccttaccaccacaagacgaggcgcggaacgacgatgacgaacgggcgcggcggagacggctcggggacaacggaggcgaacggtgatggaatgacttcggtggtgatccttggacgaaggcgagacgaggcctgcacaaggcttgacgacacggagccgaggacgaagacgacgaagaggctgcagcacacttgacgaaacgcgatcggcttgacggagggacgaacgccatgacgaccgggaatgacgagagggggatgatgaccgggccggtggggaggcgacgagggcagccggcagcagctgcacggatgcgaggacggcatggaacacaccgctgcaatgccgacgacggtggcggcgcaacaagatgacgtgccggcgaggaggatcggccgaccggaggaggggatggcgacgtcggatggagacgacgatgacaaacaccggcggggtacgggtggaggggaggcgaggccgagggcgacgttgccgctgcgatgccggaggagacgacgacgtcggccggcacacgggcacggaggaaggagtggccgaaggaaacgtcggtgaggtggaaggagaggctagggtggaggtcgatgccgcggtaccgaaggaggagatggcgacgtcggcaactggaggtggtgcagtggcggcaacaccactggacgtcgacgaggacgcgcctccggcggtcaccgcgcgaaatggagggcaggccgggggagaggaggcggctgcgacgccgagaatggtgacagcacggcctaccggtgcatgggcgaggcggcaaaggcggctggaggtggccggcgacacgggagagagagaggagggctgcggggagaggcggtgcggccacggggtggcacgggaggaggctaaaatgagagaacagaggaagaggatcccattttatagcggaggggagctagccgggcacgggagagggcggaacggcgccgagaatggctgccggcggccatggaaggtggccggggatggcgcggccgttccgggcgattgagggtgccattcaaggtggaaattaggggggattgaagaggaaggaaatgggattaattccccctaatcaatttggaaagaagggaattgattcgcgcagatttgagggaggaaattgatagggtttcatgggagaaggaggagccgggcgggaggaggacgacgaccgggtgggtgggacccaccagtccgcgcggtcagcgcgcgtgcggcgcgcgtgcgcgggagggctgcggctcggcttgggccggggcaggcctaggcgggaggaggagaggagggagtgggacgggaaggagaggagagaagtgcggcccgggagaaaaaagggagggggagggagatgggccggggggggggagaggaggcccgagagaggagggaaaatggagggaggagagaaagactttgggatgaactcggcccaaaggcggaaggaggattatttttagttttctttttaataaactttgataaaggttgttgttgcttatagttatttccggtgttctgaaaattcaagtaaaatttgagggctcctttttgaccaaggagaatttaacaaaaattctccgggccacattcgaatttttcttgtttgctttttaaggtttgccaatttcttttcgagttttaattaattctattattccttttagagaatgatttttatttcgagatgaatttatcaggacgtgacacctctggccatagtaaaactattcgaatagccgtgcccgcggtaaatggcgggttgagcaatatttttcgtgattagtctcacacctctcacaataattattgatgctataactggtaataatttgcttagctcctggtttggagttagatctgtacagccgggtatgtttgttcaggatggttgggcctaagcagcatgggtgtgctgttcagtgttgattaatattgatgattaattactctactgttttactactcttaaatgtttgcttaatgctagttttccaaatgagcctatattatgccatccttcggtatccttgtgcacttgcatatttgctgtgtggcttgcggagtattccatgtactcaccttgcaataatcaatcaaacctcagttgaagagaagtcgcaaagaagaggacgtttggcttatacccaagttgagcttcctgtgggagtggagccggagcttcgctagaccatttatccactgctgttttttttttttttgaaagatgcaatgttattattttgatggacttgtatattaaaatgtcagtttgtgtacctcggctgattcctggacgaggattttatgcacaaataacttcagaaattactagtgaatttctgggcatgacacgacgtgtcgtggggttgtgtcttgtgggtacagttgtacacctctgatcagagtaaaaactatttgaatagttgtggccgcggttatgtgcggtcgaccaaattcaccgtgattagaatcacccctagattagcttaatggaactggttagttcaggtggtggattgggcctatctcaacgtggtgtagcgttgagcagggattggttagtattgattaattattacaattgttttactactttcaactactgcttttaaatgctagctttatgcaaatgacccctagcctcctttggatatattttgcatcataccttcccttcctgtatgacttgctgagtaaagtggatagtactcagtcttgctctctcttccccacaccagagctgaaaatcttcccagttggagctctcccggagaagttgggttcgtcgttgccgtcaaggatgcctgtggagtggagtcgccccactgcaggagtcaggctttcaagattagctcgcctttctcttttccgctgcatttgtaatcttttaatgtttctgtaagacatggatctgtatgtcaacaattatcgtttgtataccctggctggtcctggacaggggttttaatgcacattcagcttagagattctggttcatgaatttctgggtgtgacaagttggtatcaaagccgaccttgattgtaggacaagctaactggaaaccctaagagcccttcgaatccttttcatttgcatatgctctttgcaattggatttgtttcgggaaaatgagggtttgttcttgtggttgatgggaaaaatcttgatcgcttgttcaattgaaatttatgaaaatgagatcagtctagggttttagtaaaattctagtttgaatttatttgacagtcaatcgggatttatcggggtatatgcgttaattcgtgtctagacttgatggggcgcaatctttatgcgcatcattactactatgtagtatctattttgggcattaatttattgcttagttagtgtcatttcatgtacaatgctctatgcataaaaaaaatagtgcttggctagatacttgagttatttgttgttttgtttaatttggatttgagcgtgcattagttcctaccccttgtcttccttagatgtcagacctgttccttgatcacaagtgtcgctccaagctttcagagacaccgcctttagctttattgtcttcttagttgtatgcttggtttctgtgtttaggtttgttgcttgtgggttagtcggcggtcgatatcatgtgtcagtggtatggttgcctgaattaggagttgcttgcctcctttgtagtgttttaattcaagtcagatcaattgcagttaaatttataataaagattagtttctaagccatctgttttcttccttttctcttatttctatctatcccctcaagatgaagtcaaggaatggtcgcagtgtctccaatgacgccagtggcagcgaagagcagatcaatggagcacacgccaacggtgcaactggcagcagttcatcgccaccgttcgagaaccgaacgatcactcaggtgctggacaaccatactcagatgatgacaacgatgacgaaacaaatgcagcaacattaccatcagatgttgcagcagacgcagcagaaccaacagtttggtcctccaccatcgcacctgtccaaactgttagactttctccatataaagccactaactttctcaagcaccaccaatccaatggagaccaacgaccggctccattctattgagaagaagctgaaccttttccattgcaacgaccaagagaaggttgcttttgctacacaccagctgtagggttccgcttatgcctggtggtaacccgtccagctgcaatggaggttacgtgggtagagtttcgtcaaagcttcaggaaggcataggttcctgaggggattgtggcacaaaaggagagttctgttctttgcaacaaggaaccagcatagttacagagtatttgcacgagttcaaccgcctcgggcgctacgctccttaggacgtgtacaccgatgccgagaagcatgagaagttcatgtcaggtcttgatgatgaattgaccaattagatgatctccagagactctgaggactttgagaagcttgtggacaaggctatccgtcaggaggagcagcacaacaaaatggaccgaaaaaggaagactagtcagttcagggtttccccggggaacaatcagaagcctcgcttcatgactggacagcaggttcgatcttccaccatgattatctgtcagcaccatccctacaacagcgtcaaccacaacagtagtgggcagcaccaccaccaccaaactcctcacccactaatggctccaattcagtcaggtctgccagctatgtcagctaagttagaacagcctgttgacggtcgttaccgataaatttcgacagtcactataactaaaataatggagaactagctatgcatacaatgtatgtttatttccaaataatatatttccacttgtacttggagaataacatgttgcaggaatttatcaaataaaataaagagaaaatggagaaaacctcactcctaagcaagcaaatggataagatgggcccacatgtaatacgagtaactgggaagatggcaagacagaatctgtctcgcaacttttcccaactaccgtttacacatccaacggtagaggtgtaccattgcttcgctctctcttgaagggtgaacggaaataatttccaccatacaatttcttgtctcatgccacgaatcttaaggcatgagtagacttgttcaaagtcccgtagatgatggtggagattttctagatctaagccagaaaaagggtttttccttaaccatgctgatgagttcggcgcgaatttcatagctagttgtataaatcggctccgatgaaggaggtggctcatagaattcgcccctaggagcagacacctcgaagagaggttgctccatagttgagaagagtttaaaaggaatgcttctctgggtagcaggggtggaggaagaataaaaaacaaaaaagagatccgaggatgaactgggttcggaaatgattagcaaccgttccccagcaacgacgcaagatatgcttgttggtaattcttatggtcatggataaaatccgcaagcgcacggatataccgatgtctaagggaacgtgtacggtcagatcttcttccggttcatccaaggacacctagcaaaggataggctaggatagagaggatttactagtgagaaacagtgtcaagggaaagcttatgtttaatcctaacacaatacttcaggtactggcaacccgctgttcctagatgtcgctctactacgtacccggtcagggaggacttaagtgatcttgagggctgtcaccacctccacacctatgttggtatttcttacgatcacagatagaatccgcaagcgcacggatataccaatgtagcacttcccctatggagtattccaagggtatcgaatccaagggaacgtgtgtgattatctcttcctccggttcatccaaggacacaaagctaacgtgggcagagggcagagaggatttcctaatgagaaacagtgtctagggaaagcttaagtttaatcctaacgcaatacttcaggcgctggcaacctgctgttcctagatgtcgctctactacgtacccggatagggaggacttaagtgctattgagggctctcaccacctctacacccacctcaaacgtactgtgggatacgcagcaaccactggagattaattacccagacaccacgtctacgcaattaataactactctagtgccgatcaaacactaaagcaatcactataaataaatggactacagtgaacaatgatcccgtatgctaattaggaactaaccaaaatgtaattctcactaagtaaatcttaaatactcataatgatatttctattaaagcagagtaattaagaagatacaaaagtagaaagagattaccgacaactccgggattcctccgattccttctaccttactctctcgctattctaatatgcaataaagtacactagagcctcttgtaatttagctcatgctttggtgtgtgtgaatgagggagaggagaggggtatttattggtggagagttgccttgggagagtggagatgctctaagcatcctatgagcatattccctctagctttatctcctcttgacaagtgtcctctctatgacggtttccactggtagaaatggccacaaccatcattgggatgagtagtacaaccgtcatactgaatatgggctggactgggccagctaggggttcggccgaaccaccctggttggctcccctggcccacatctttcttcaggatgctgacatgtgggccccacttcttgatgctccattttttggctcaaaatgattgcacattttatatattgtagctcaaaaccatgtgagtttatcagagcaaaatatatttccattctttatgctcattctttcccaacttaggtggttgatcacctgcatataaatatacaccaacactcatggaaattgttagaaataaatcctacaactatgttagaagtttcacatttatggttttatgcaggttttgacggctttattttggcacttaactgccgtcaacaaaaccccccacactttgctctttactcgtcccgagtgaaggttaaggattaatgtggaataaaatttcccaagatataatacaagtacacaaattattctaagccatacctgtacctgtgaactattgaagtgtctaacttaccatcttgggcaattgatgaatggaacgatcgtgactcaagtcctccttaatcctcctatcaatctcttgggatttttatatattttcgcaaagtagctatactcttcgaataaatctctcaaatcactcacgtggtttgatttgcggatcctcaccaaggcatggttgccgatttgtccctattctaaaaggctatataggtggagctcggtagggatcaatcggggcatacctgcatcaggtatattgcaaagccaaaataccagaccgaaggagatagcaagtcatactttctgatcaagaatgtgcatgtgtgtgatatgtgtatgtgtataaaaaaaatgtgtggatggaaaaggaaaataaaagataacaactcctttggtatacctcctcctccaattctttctcttggaaatttaagagagtgcatggctatttcttttcctctttttatttcatcatgccccatacttcgtatgagcaagattctctttattattattattatttttttcatcaatgctccattcttgtatgagaaagactttatttttttccttctttttcatagccacgcctttctctctgtttctttttttctttgaaagaattttgaaagaagaggcataaatgacatggagtatttattttgtggataatggataaaataaatgatggatgagggatgctagcttccagtgtagaagtttagcatagtgtgtgtatgtggagtgtggtgtgatcttgatcatgaaagtatgaaagcatctcacatgggtgacaataatttgacaaagctgaatgtaatgccaagcagcctaaacatatatcagaattttgcaatgagaattatatatggccttagtaggtaataatatagttactaaggagtattgctcgaaaaagtttttattttcgcaaaataaaatcccaagtatcatgacagttgtataggaatttcttttgtcataaccatatcacataacttagattagcaaggttccctatgatagatgttagttcacaagtgacaagtgttagcaaagaataaaaagtatacatgattaatcataggagaactttatttgttgagagttaaggttttcaattttcatttggagtcaaactaaatttgtattcaatttttccgcaaaagtttaactcacaaactagggaggataaggaaggagacatgcaaacctgaccacacggtagaagggtgacagagctggtccaagcaagggtcgggcgaacacttggttcggccgacctagccaggacatggttctgattgccgaattttgtgcgcggccgtcagctggtgttcatcaggttgtcatgttgagttgatgctattgcgcgtcgggagttccgaaaagactcccccacacttgttttgtaccttgtctttattcaacaaaaaccataaaaagcaaaatgggcttccaccgggttgaaataccggtgagccaaattttattcaaataactctaggcgcatgaagtgcctattttttatttcattttcatttttttatttttttatggcaacaatgagaatggtggttatcctagcagggcggatatatgacgtcatgattcacagggtgtttgagattcttaccagattgtacttaccaagctttgaaccaaatcgatggtaacaaagtgttgcatttgctttgcttggttccctgtgcatctctctcataaaccaaggatcttggtatggatgttggagttattgtacactgctccttagttgtcttttttatttcctgcaaaatgttagtggacaacaaatacccgagggactacaaagatttgaaaagattttatcatagcctcaagattagttgttcacatccatactaaaaaggaattggattctaaacttaaagcgcgtggatcccaccaatttgccataattttattttgtcatttttatttctttttactcgagagtcatttcttttattattaaaaacatttttttcaaaaaaaaatttttgttcaccaaacttttattcaagcaaaactcatacagggctgagataaacttatataacatagaaaaggagcatttggaaatatacgtaccgtgtaccttgagaggtgatatgtttctcctttgtatgttttggcaattgatttgttcctggcccttgacttacctccagtgtgactcgtgcttgagaactcacccatcagattgaataatttcctgtaggggttagtccacgaagggtatacatccaaagtccatgaaagtactggctctacggttcatttaaacaaacttgacaccatgtcaactttgattaaagcaagctatttatcctaagcatcatgcttaatttgagaagcctatgaatgtcgacgaccacccaaaccataacatatgaaaatagaccgaggacgcataaccatgcatgatcaagccagactcaactagagataagtatgagtaatagtaatggtgaatcttttgttgtatacctgagtatatttacagccagcatgatgtatatgttgaaatctttggagcggtggcacggtcaaatgtgattgttgttctttcctccatctggatgcaggttgtggcggaggaaggcactttgaccatgccaactcaggcgagtggttcggttatgcacacatcttgggtgcaagaaccttatgccttgaaggcatgttccgtcggcataatgctaaagagacataggatgcatctcttttcgggcaagtatgcaagtgctaactagagtggagcagcaaacagctcgaaaagaagagggcatttcctcttggttgtatgtatgtaggtgttgcgggagcgagaagttgtgcacagctaggattggatgaaggctaagccaagtcgacacatgagctcaagagaggggctgggtatagcctggcagcatggttactactagcaaggtgtatagccatattttaaagactcgcacataatgcggtctttgatctaaatgtagtccgtttgctctcttgctgtcctcttctcccatctcttttttttatatcttccgtctctcttttcttttcattttttttcttgttcttttttttcagcaaggtaaaactaacaccaactgcaaaccaagatggccttggttgatggaactcatcatacaagctcgtcaacctcccccacacttggactttgatgtcataagacatcaaaaaccatgtgtgttatgttggagtcttcataaagtgtgtttcaacaccaaggatcaccaaaatgtacatttgatgtagctcccgagttcttaggcatcgtacatccctcgttcttaatctcaacctgaaatggttagtgaccaagaatacccgaaggtgcataatatcctaaaaattggttttttcttttattggaaagacaacttaccaagataatccggggtatctcccggcagtgctttctttatggtcacaagctcgaccatggagacatctcgttacaagattagtgccacaaacacatacgagatttgcaatatttatgataaacaaaagcatccacaaccaaccttctaaacatgttagagataaggcccgaaaggtggttatggttctcacacaaggaagtgatactaatcggatagaactctaaggattctttatgtaagcatgaatcctagggtattttgaaagagaagttttcatgctcatttgtggagttctcatcctccagagttgatgtctctaacttgtccatggcttgcagtttctccttctcaagagatgcatcgtgcaagaacaaggttgtttcttgacaaatgtcgagaacaacattttgatggccagagggacaaggttcaggctcgataggaggttgtgatggtggttctttggactgcaattcaacggtcttgccagaatctttttgaatgaaatgaagatcatcctgttctataatagactcaggggactcatgaagcagaactgccattgcttcctctatcggtgcatcatcagggggtatgtctgtcaacgagttctcatgatcgttatggagatcacccctgaagtctagagcgcatcccgaagtttgaaattcttcgttcttcggtgctgatggctcgagagaggataccttagctgaaactgatggtgtggaaggatttgattcagatttggctattgaaggttcctcttgttttgacaccgataccttctggaggggttcagaatgttgctctatgaaggaggtgatttctagaattcggtctagaatttccttgccttcggatggagttttgtgcatgaacgtccctccggcagtgatgtcgagatggaatgcagactccctacctaaacccgcatgaaaatgctgtaatagcacgtaattgggtatagacagggttggaccagactgaactaaattagtgaatctgaaccaggctgcaccaatcgattctttatttatctgctggaaactcagaatttctacatgaagagtagtaatacgggttaattagggggcanangcactattgcttggnaagggggggtcccccaaangggnttaaaaaaacccccaaaatttgggggtttttcccctttttttaccccaaaaacccattttctagtaccgtttacacacccaacggtagatgtataccattgtttcgctctctcatgaagagagaacggaaacaatttccaacgaacagtttcttgcttcatgtctcgaatcttaaggcacgagcaaagcttttcgaattcctgaagatggtggaaggggttttcctggcctaaaccagagaaagatttctccctaaccatactgatgaattcgatacgaatttcatagctaggtgttaaaattggctccgatgaagaaggtggctcgtaaaattcgtcccgaggagcgcacaactcgaagagaggttgctccatggtcgagaaggattgaacaggaatacttctatgggatagcaggggtagaggttgaataaaaaggtaaaaaggataaggatgaacaaggttcggaaataaacagcaaccgttccctagcaacggcaccagaaatgcttgttggtatttcttacgatcacagatagaatccacaagcgcacagatataccgatgtagcacttcccttacagagtattccaagggtatcgaatccaagggaacgtgtgtgattatctcttcctccggttcatccaaggacacaaagctaatgtgggcagagggcagagaggatttcctaatgagaaacagtgtctagggaaagcttaagtttaatcctaacacaatacttcaggcactggcaatccgctgttcccagatatcgctctactacgtacgtggacagggaggacataagtgctcttgagggctatcaccacctctacacccacctcaaacgtactgtgggatacatagcaaccactagagattaattacccagacaccacgtctacgcaattaataactactctagtgccgatcaaacactaaagcaatcactacaaataaatggactatagtgaacaatgatcctgtatgctaattaggaactaaccaaaaagtaattatgactaagcaaatcttaaatactcagaatgatatttctattaaagcagagtaattaacaagatacaaaagtaggaagagattaccgacaacttcgggattcctccgattccttctaccttactctct

SEQ ID NO: 22498 - DNA, 7557 bp, Oryza sativa
cgaaccctggttggctcccatggcccacatctttcttccggatgctgacatgtgggccccacttcatgatgctccatgttttggcttcaaatgattgcacattttatatattgtagcttaaaaccatgtgagttcatcagagcaaaatatatttccattctttatgctcattctctcccaattttggtggttgatcacttgcatactaatatgcaccaacactcgtggaaattgttagaaataaatcctaccactatgttggatgtttcacatttatggttttatgtaggtattgacggcgttatttgtgcacttaacagctgtcaacaacctacctcaaacgtactgtgggatacacagcaattactagataacaataaactaaacaccatgtctcagcaattaatatctactttagtgtttataattcaccaaagcaatcactatattttagttgattatggtgaacaataattgtaacgccccgattttcgttcgggatttaaaatcaattaataatgtattttctagaaattaaataaaagttaaatcaatttaatcaagtgaaatattgagggaattaaactttcctttaaaaatcattggccgagaatattttgcaatattttttgtgccctgatatactaattttcggaattttcggagctcaatatctaattttaaaagtcacaaagttcatttaatcaattaaataaatctccccttcctccttgggccatttttggcccatgatcttttctccctccttggcccgctcgcacctctctccttccctcctccctctcgggccgacaactcccttctcggcccgatcgactccccctcgcgcaaatcgagccccactccgcccacgttgagctccgcgtcgccggccgttgccgccccaaattcgccactccccggcctccccgtgctctccttatccgtttcccccatttttcccaagcccgccacgccctccctcgctctccccgcgccgatccccatcgccgcccctcgctggcgaccttccatccacacgccaccaccactggcatcaccgcgctcctccacgccccgtcccctactccattttctctgttagcatccgaaacaatgccgccacgcgcaccacctctctccaccgcctttgccgactccgacagcgcgccacccctgccatagccactgctaagccgcgccactgccaccatcagcttcgccgcatcgcgtagcaccccggcaaccgctcctctccctcaaaccgcctctggaacaaccattccaccgcatcacccgagctccaccatacgccgcctccagccgcgtgccgccctcgccttagccatcgccgcgttgctccgccctcacctcttgcctacagcgccgtgcagcacctcggtcaccgttgttcatcgccggaaacccaccggagctcggtatctctcggccaccggtgagccccaccattcctcaactctccggcgtggtattctcgccgctccggttgcctattttccttcctaaccactccatcttcttccccaggaaatcccggcctccatccgccgcgggccgtcgttgaagcaccgccatcgccaccaccccggggagcccgcggccgcctaatccttgccgctggccgcctcctcgtcttcgtctcgccgccccgttcgcacggtgagaaccgcctcctcctcctctcccttttgccgccctccgcgcgtcgtcccacgtcaccggtggccactcgccggccggctttgagccgtgccgtgccctagccgggccgcccttggccgttggatcggctcttggccgatccgagccgtcggtcccatggaccagtcccgtggtccgggtccacggtgccgcctaggccgcggtgggcttggtccaccgtgtgtcctccccttggagccgctgatgtgtgggcccgcctgtcgacgccggccctttgctgacgtcagcgcttaacttgtcctttgagaaaataaataataattgcgcaataaatcattaataattctataaattcatttaaatggctcaaaacatctaaacttcatttctaattcatacgaactccgaattgagccattcaacttgcaaaattcatctaaaatatagatctacatgtttgtttactttttatgtactgttttcttggtgtttattagtgtttttccttgttttgcgtgccagcgtgtagcttttgccatttcggaagtccgcggtcgctaggataagtgttcggaagatcaaagtgaagaagcaaggcaagtcacacattccccttgagcatgttgatcccaatttataaatgttttaccgtttgcaaataaatatgcatgttttgccaattacatgggaatagggtttacctatctgctcgcttgtgccatgtttacttgttatctgtcctttctcaacccttgggtgataatttatctagctcgtgatacttatgttgatcttgctagaattatatgtatgcttagccttgcttaattaccactagctcacaaaatgggataattacatcattagacatttagtttcttgacgagctgcgtgctcgagacatctacccatgtttcatggtcgtaattattgtaggatcgagatgttgactagaggggggtgaataggcgatttaaaactaaatgacacctaatcgaaactaacctaagttgctaggcttggtgagggtcaactctaactaagtaactaagttatgttttgcaatcctagggtgatagtggctctattatatctctaggaaagtaaatcacactcctatgtcaatgtttagcaatcctagggtgaaatgatctctagaaatgtaaattgcacaaatgtaaatgcaacaagtaaatgagacaaggagacaagagatttttcaccgaggttcggcaacttgccggtttcctactccccgttgaggcgatcccaactccagtgctcaacctcgaagccaccgcacgcccccttcgtcaaggggtgggcaaggcgggagccggcccatggagaggactacccaagcctcgatcactagggtagttcttccttcactccgaaggtggtgtactccagaccactcacaaatcggcgccgggcctcctccacaatcttctcggagaggtcaccgggcaactcctccacaagccgtctaggaggcggcaacctccaagagtaacaagcaatgacccggcgtggagatgatcaatcaagtgccacactagctctacaatggaagcaaatgcacttgactcttggctagaacaacctcaaccactacaatggatgaacactaagctcaagggtgtgtgagagaggtgcaagggatgtatgcaattgaattaggtgccaagagagcccccttgctgctggagggggagtatttatattcctaccaaccaaaactagccgttgggggcgaaatcccccaactctgtgctctgccggtctgaccggaggtatgtggccggtcagaccgtgctactctacaacggctagaaaactagccgttgtagccctgtcagagggcccatcggcctggccagtcagaccgacattgagtggctagtcagaccggcctcggctcggtcagaccgccatcagctcggtctgaccgaatacggctccgtcggctctgtatcagccaccccgagtagcaccatcccggcctccagcgggctggtctgaccgcgcatgtgccgccggttagacttccgtagtatggccggtcagatcggccagggcacacctgtcagactggcactgtgtggccggtctgaccgcccctgtcaggccgaacccagtgaaatgaaaagtgattgagtgtgtgagatgaaatgtgagcacaagtctaaatgcataatgacctaatgtggcaattaaaatcatccctttgctaggtcattacccctacggcgaaactaaaaataaactagcaaatttaatcgccctacacctcgatcaattcaaaaattaaagcactagttttaccgtcttctttccctttgctttgcgccgtcaattttaatccatcgataatcatccatgcgcacatatgacgtggacctaacttaaaatatatagctcaaagacaacggttagtccacaattagtgcttgttattaattaccaaaatttacaacgggggcctacatgcttcaatctccccctttttggtaattgatgacaaacaccacaaatatatataatcaaacatagaacacatggacatatattgcaatgacaatcaaaagctccccctaaacgtgtgcatatcaatcatagacaacaaatatggagccaatgcacacttcaatatcacatttcaacaagcacaaacacataagcaatatttcaatgtgaacttcaagaaatattcatccatgagcataagatggtcacatatatatcaatatcacatacaccatccatcatcacacaagttcacatcacttaaccattcaaatcagataagtcacaaatcatcctaaaagggctcacaaaaaaacataggctattacaagaccacgaagggtccaaatgacatagagtccaacaaaacgataaagaacacacaatatagagtaatagcccatatccatacataatatagcacaaactaccttaacctattaaatatgaggtgactaaccttactagcactagtcccaacccacaagacataaagcacacctaaggacatctttctcctccttttggcatcatgtaccaaaaaggtcttcattcttgtggaggagaaggaggacgcgccgaagaggaaggatgaggagcatcaggaagacgatgatatagaaaagcttgggtgctctccaacatttggactcgagaatccaatgcacccactctagtgtgcaatctccccatggaagcattcaagtctccaacatcggtgcgcaagccacaaacatcctcatgcaatgcttcttgcccggtagacaagcgttgaatgctttcacttagggtattaatagccccaagtaccgggttgaagtattcattgggttgcgttccaaagtaagcaaactgtggatggaagaaagcatttggatcatactcaggaggaggaggaggtgctgagcttgagctagctccaggatgagaagagggcaccgtcctaggagcacggggagctccaagctgaaggcggggcttgtactgcttgtgcttcttcaaattttgcccagcagccccaagcttgtcttgaatcaacctcatgatgtaaggggcataatagattccctgagtgaaggtccccttggagatggcaatctcttgcatcatgagagacacaatgtcgaactgacgaccctgaatgattgcatcgatgacgtgccaagccacccccctaatgtcatcattgttgccaaggcgaggaaggatggtagctctcacaatcctgttaaccacactgggatagtcctcaagccggcaaccttcccatgtgtgtaccacactcaatcttcataaaactgagagagatagtctatggagagtgaattgtgagtgtgctcctcatgcaaatcatctccaaagtccaagcgaatattgaggagccgccggaattgcctccgagagatagaacactggagggtgttggacatccacttcatctcactatagtctccagccacccacactgtagcatagaactgccggatcaaatattcattgtagtcttgcttgagggtcacaatccggtcaataccaacagtcttgaagagatcctgcaagctctcaaactctggagtctcattgatgtctctccaagaaatccacttatgctttgcaaatgctttccctgcataaacctgttcatacacagtcttctggaaagcggtgtgaaaacggggatccagggtgtctcgaggcctcaagaactgatcatgatgcctcaagatggtatactgcgatggattcctcatgttcaccacaaactggatgaagggatcaatgtgcatatcatcatttccttcatcctcatcctctccacttccactgacatcatctccacttgccacctcactagccccctcaatatttgcttcaacctcttcatcactttgagcgtaatcctctccgctcgattcctcagtctcactcacgggatccggagtgggcgtacggtgaccatggcgagtgcggggaggcatcactgtcaaagaacaaaggatgataggatattagcaataattctagaaacaatttggagaggtaaaaatttgcctacatcctgtggaggggtggtcagaccgcagccagtagggtggtcagaccgaaggcatcaggccggtcagaccgcccatggtggccagtcagaccgacggctgccggccggtcagaccggcggctgacccatggtcaaaccgcttgtgtctccaggcagacctcctcccacaagtttaagcatccaaatattttcatatctacacatttgagtctaaaatttgctagaacaatatagcacaggattggaacatgaacatcaaagggttgaacctatttcatcaagattggaacaatgggaaagtaccctaaaccctagagattgaaatagaccgatttgagagcaatgcaccagagggagagagatttaccggttggaggagttgaatcacaccaagaaactaccctctattggtgcaaatcgaagaacacctcgtgcttcacctagggttccatgccatggatcaaaaactcaacaaaaatacaaaccaatccatggaatagagagtggaagcggaggagagtcacttacagtgtaaccggagagaaatccacggtcaaaccgaggggatttggtggaggaaggagttagggtttgaggggaggtgagagagagttagaaatttcgagatggggaagtgaggggatgagaaggagagaggtaggtgcgggtagaaaaagagggggaataaaaattccctgggcccacctcggccggtcagactggccctatgtggccggtcagaccaccacagctggccggtcagaccgcgcatatagcgccggtcagactgccaggcccccagctggctgtgcacagcccttgcacaagccggcaacccccacacaatgaaatttaataaaaatttgatttttggagcaaattttgaaatgtgtgagtttaaatattgtgaaccatccataatatttgaagattatgatgatttgcaacaaaactcacttaagtgctaggaggtgaccttttatggtctataggggtttttgcgccaaattggttttcaaataacttttgattgatttggtttttgaaataggtttgaataccaaaaacatttcaaaacctcctctctaccaatttttttttgaaacttttctcaaattccttctcaatctcaatttggggataaatttcattttggccagaactaagaatctagtgtcttcaaaagagggccaaaatggcattttcattcaaaaataatttttcttgcaatgtgaggcttggaaaacatatagggaaccttttgaaacattttccaagagatagttttc

SEQ ID NO: 22499 - DNA, 1930 bp, Oryza sativa
aagtagagcacatgcaagagtgcaaaactcccccttaatgtgacatgctccatttttgcaatgaagaaccaaatggcaataattccaaagcataagcgcgaatgagagcaaatatacacactgcaaaagaagcaaccatggtgcaccatctcaagccacattagagaaatctatgacatttaactcattcctcaacttgcaaaagcgggtttcatcaagaggcttggtagagatttcggctagttgatccttggttcttatgtggctaatgactatgtcacacttggaaacatggtctcttaggaagtgatggcgaatgtcaatatgcttggttcttgaatgttggaccgggttatgggctatctttatggcactatcattgtcacataggagtggggttttggtgaaggatatgccatagtccaacaaggtttgtttcccaaagcaattgggcacaacaactacccctcgaaacatattccacctcggcggtagagagggctacggagttttatttcttggatgaccatgacacaagggatctaccaagcatttgtcaactaccggatgtgctctttctatccaatttgcaaccggcataatccgaatcgaaatagccaacaagcttaaacttagcaccttttgggtaccacaagccaatagtagaggaatactttaaatatcttagaatccttttcacggccactaagtgacactccttaggagcggcttgaaaccgagcacacatgcaaacactaaacatgatatccggcctatatgcggtaaggtaaagcaagctacctatcgtggaatgataaagcattaagtctaccggtttacctccctcatcaaggtcgagatgcccgttggttgccataggtgtcttgatgggcttcgcatcatccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccctgcaaaatacctcattagtagaaccgaatatgatatcatcaacataaatttgacacataaagaaatcagcaccaataatttttgtgaaaagggtggtgtcaacttttccaattttgaaatcctttgacaaaagaaaatctctcaatatttcataccaagccctaggagcttgttttaaaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaagcatgatgcaaatttaagaaggatgcgaatagcctcaagtcttgccacgagggcaaaattttcaccgaagtccaaaccttcaacttgtgtgaaaccttgtgccaccaaccttgcctttttctcaccaccaacccgttctcatcttgtttgttcctatagacccactttgtccctatgacattgtggcctctaggtctttcaaccaaagtccacaccttgtttcttgcaaagttgttgagctcttcatgcatagcattcatccaatccggatcacaaagagcttcaactacatgttttggctcaagacaagaaacaaacaagtcatgttcacaaatcaaatcgacatgagatcgagtttgaacacccttagtaatgtcacccaacacttggtcaattgagtgactcttggaaagagcggtgtgtatacgtttatggcttctgcccaaaaggaatcggaaacaccatattcatcaagcatagtccttgccatctcaatcaatgtacgatttttcctctccactacaccatattgatgaggtgagtaggtag

SEQ ID NO: 22500 - DNA, 4126 bp, Oryza sativa
cactggcttcataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtagagattgagaggggaagcatacaaggaaagaatagaccagaactagggataagaccttaaaggaactaactctttttgttgatgtgttgtttgttttgcttattctgcaggttgattaagcaaacaacctagcatggttacatcaccacccaccgatgcaatccacgcgctacacacacaagcaaggaaacacacgacagacgaaacactagagggtggcttaggttctgcgacgggttctccaagatcttcactccttcacagctggcttcactgcttcctgcacttctgaagcggatcctccagtcttccggagcttcggcaaacaattggcgacatcttcttcttcgcaaagctggccatctagtactagttgaaatttgaagaaggaagaaaagagtaaaccttttgcaaatagcattaggggaaggagaaaaagaggaactttcgcaaatagttttatttataaaatatgtccttaggttttatccacttggcttaacctacagtcgagatggctctgataccagcttgtcgcgaccgggaaaatttcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataaaataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcacagctcgtcccaagccaaccgaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggtcggaacctccgggacaggtaggcaggattgagcccctagcagcaggacaccagccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccatagtgtccaaatgatatgagaattcccaaagtctaaagttataaaaccacctaatgttgtcctattaatcagcgaagcatctaccctaattcatactagtggaaccatgaatagagtacccactagttggggttttattttcctggggtgaacaaggtaataataacaatcacaataataaggtcataacaaaggtaaataggcatggctaaataaaacagtgatcacgtgggaatttaaataaagcggtaatgcattaatttaaattaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacagccgacgggaggcgacgcgcccgcgccccgatggtcgccggcggcgacctccggcgcgacggagcggcggccgagagaggggagggaagggggaagtgaaacggcggtcctcggctcaccccgggtcgacggcgacgacgggaacggcgaccgaagcggagagaggcggcggcgcggctcgggtcgacgaggacggtggtgctccggcggtcggcgggcggaacggaggagtggacgaggtcgacgaggacgtggcgaagccgaaggaggcgatgccgaagcgggaggaggtccggggcgacgacggcggcgaaccgaagctcggcggcgacggcggagagagaggacgacggcgcgagctcgattccggcggagagagagagcggcgagtggcggaaacggaggagggaggcacggggagtgcttaaataggggtgggagtgagagagggcggccggagaggaatgaaatcggcgcggcgatctcgggctccattgatgcgccggcgaagatttcgggagggattccaaacgaatccgagggagagagagggaaaagaggggggaaagagagagggaatcacggggagtgatttccccctctttattgcgcgcggggacggcgggaggcggcggaattcgcggcggcggcggcgctagggcacgggcgcggcggcgggagcggcgggaggaaagggatgacaggtgggccccacccgtcagcgagggtggcgggcgggcccacccgtcagcggcacgcgcgcggggaggaggccgattgggccgcgggggagaggagagagagggagggaggtgggccgagccggcccaagaggggaagggggggaaaaagaatttttagggtttttctttttataaaatcattttaactttgtttatttcttaataattattatttgtgctctgaaaattccactaaaatttgagggctctttttagaccaaggagaatttaacaaaaattctccgagccacatttgaatttttcttgtacgtattttagtgtttgccaatttcttttcgaattttaattaattcttttattccttttagcgaatgatttttaattttgggatgaatttatcaggacgtgacaaatccaccccccttacaagaatctcgtccccgagattcgaggaggctagcaagaagataggttgggcggtcttctcttcttggtggacttctttcgtcgcgtcttctataacaaacttgcctagca

SEQ ID NO: 22501 - DNA, 3195 bp, Oryza sativa
caaaaattctccgggccacatttgaatttttcttgtacgtattttagtgtttcccaatttcttttcgaattttaattaattcttttattccttttagcgaatgatttttaattttgggatgaatttatcaggacgtgacactcgacaacaatagacttatcatgcaaaaagaacacccaagtatagcgagaataatcatcaataatcacaagacaatgactatttccaccaatgctgctataggttgttgggccaaacaaatccatatgcaagagctccaatggtctagatgtggacatgatacttttagtagcatgagaacatgcaacttccttgccggcttgacaagcactacaaagcttatctttctcaaacttcacatctttcaagcccacaactagatcacgttttgaaagtttgctcaattgattcatgccaacatgggctagcctcctatgccaaagccaacccaatgaagtttttgcaattaaacaagttgtcaaatttgcttcgctagaattgaaatcaaccaaataaagatttccatatctagaaacaaaaacttcttgtgggaagaaagcacatgacaagccaagatcacaaatttgagtaaccgaaagcaaattgatatttagagatttagcaagagagacattatcaattgccaaatcattggagatagcaattttacctaacccaattagttttcttttgctattgtctccaaatgtcactttctcttattctttcccttctacttcaaatgtggtgaacatagccctatcaccggtcatgcgttgagtgcatccactatcaagcacccaatgactccaaccggtgcggtagttcacctacaaaagaagatcaaggtcttttaggtacccaaacttgtttgggtccttggaggttagagatcaaaactttgggcaaccaaatggcattctttttaccactgagtataggggaacccacatatctagcaacaatgctaccatcatgagccttcctaagcatataatgagaatcaaacatgcatgtcatagaaggcttaccaccggggcaatcattcaccaaatgcccaacctcacggcacttggagcaatacttaccattgctcttgacaaaacgagtggcacagtgagaaggtttcttacccttctttgaaatgaatccaagtccctccttgttaaggatgcaccgttgctcactcaaaatcttgtcaagagtgttcttatccttgaagcacctctccaaactcttgttgagcttggccacttgctccttacgctcattgttctcaacaacaagtgaggcatcacaaatagaaacacaagagctagagctagagctaggcatatccacatgtcacgaccggaaataacccaacgggcgttccttacgtgcgtgcattattccttgtcccaggaggcaaggtacaccaaaagttgatacaactcagagtttaacaagctgaagcgtaattaattaatttattacataggcggcgaaggcccagcacacacaaagacaaatgggaaacagcggaaggctagggcgacgaccacaggcgcttgacggcaggcacgagctagacaccaaagccttcatcttccaggaattcctcttctgagtttgggaaaaattgagcaagactgagtacaaccaccgtactcaacaagacacacccataagtgcagaataaatgcaagggagtacaaggggggttgtaatataaagggttagggtttgcagtaaacagcattaaaagacacttagttgctcaaagctattttgtaaatacgatcctagagctatacaagattattaaacaaggccgtgaagccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattactcggcttgcccataaccgagggcacggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagtccctagcagcaggacaccggccctgtgccatgacatctcgactaccgggtcgcggctcgtgtagccttcatttgtcctagagatgtccatcgacccccgacttcgtccatctccatctgtgtacttttgtttataaccagactgagccacaaactaagccttacccactagacatgtgcaagtacggtagtgctttgcaacaaaggcccgaagaccggtccttatatggccgaggtgctactatcaaaaccatgcaccccgagcccagcctaaaaccattttgaggattttgaatagagggggaggtgtgaatccaattccacaataatccaaccattccatagtatccaggtgatatgaatatcccaaagtctagagttgtaaaaccacctaatgttacctaattaagcggcgaagcatctacctaaattcatactagtggtaccatgagcagagtgtccactagttggggttttgtttaatctagggtgaacaaggtaataataacaataacaataataataaggtcataacaaaggtaaataggcatggctaaataaaacagagataacgtgggaatctaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactctatataacaagcaggaacaaagcacaaaaatgggttcttgacttcttaaggaaaaattagagacttgaacggtccaattctgagtttaaatggccaagttatggccatttgaagtttatatgctctttaaatgaatatttgcgaatttcttcatttaaaatttaatttaaaaagagtttattgc

SEQ ID NO: 22502 - DNA, 2851 bp, Oryza sativa
tgcaaaaacggattacccagttcctggtcctgcgctccatggtgtccaggattttcactggcttctccacatacgtcaaatcttcgcgaacttcgatttgctctgagtcggcctgctcggatggcactcgaagacatttcttgagttgcgacacatggaacacatcatgcacgttgcccaaggaggcgggcagctccagctggtaagcgacttctccgcgtcgagcagtgatacgaaagggacccacataccgaggtgcgagcttcccttttgtctgaaacctgtgcacacctcgcaatggcgtgacccgaaggtacacaaaatcatccactgcgaattccagatcacggcgacggttatctgcataacttttctgccgagactgtgccacctttagattatcccgaatgattctgactttagcttcagcttctctcaggatatcagtcccgaacacttggctttccccaacttggtcccacaatagtggtgtccggcatttgcggccatacaacgcttcgtacggtgccatctgtatgctggcttgatagctgttattgtaggagaactcggcgtaggggagactcttatcccatgtcttcccaaaatctaggacacaagcgcgaagcatatcttctaggatctgatttagacgcccggtctgtccatctgtctgcgggtgatacgcggtgctgaaatttaagcgggtacccaactcttcttggagcttcttccagaaatgataggtgaactggcttcccctatcagatacaattttcttaggaacgccatggagactcacgatcctagcgaagtagagttcagctagtttgttccctccataggtggtcttcacaggaataaaccgagctaccttggtttgtcggtccacaactacccatatagaatcataaccgccctgggtttttggaagtccggtgatgaaatccatcccaatttcatcccatttccattctggtacttggagaggttggagaagtccggccggtcgttggtgctctgccttgacacgttagcacacatcacaaagggccacgaactctgcaatttcccgcttcatactaacccaccagtatttccctttcaagtctaagtacatcttcgtactgccaggatggatggaataaggactttcgtgagcttcctgaagtatcagctgtttaagttccttgtcgtccggaacgcatacacgatttccattccatagggttccatgttcatcttctgtgaaaccagcggctttaccttgtttcatattcttgaggatcccatgcatatctggatcattcttctgagcctcgtggatttgatcgagcaaggtaggcttggcttccagcgtagccaagaatccacgatcaactatgcttaggttcagggcttccatctgttgatgaagttctggtggaatgccacggacgccaagagtgttgcaacggcttttccgactcagcgcgtctgcgaccacgttggccttaccagggtgatagtggattcccacatcataatccttgatgagctctaaccatcttctctgccgaagattcagatccgactgggtgaagatgtatttcaaactcttatgatcggtatatatttcgcagcgattcccaatgagataatgccgccagatttttagagcatgaaccacagcggccaactccaaatcatgggtagggtagttgccttcatgaggccgtagctggcgtgaggcataggctaccacatgaccttcctgcatgagcacgcaccccaatccttggcgcgaagcgtcacaatacaccatgaagtccttgcgagtatccggtaagattaaaactggcgaggaaaccagcttttccttgagagtttggaacgccttctcgcattgcgggctccacacaaatttttcttctttcttcaacaactgtgtcatgggtcgagcgattttggagaagttctcgatgaacctccggtagtatcttgccaaacccaaaaagctgcgaacctgagtaactgtcttgggttgcttccaatcagtgacggcggtcactgtttcggggtccacagcaactcctttagcagatatcacatgccctaagaatttgactttggacaaccagaactcacacttgctaagcttggcatacaattgatgttcccgcaactttcccaacaccagacagagatgttggcggcacaacgagacgaggagccggcgaggaggagcggccgacccaagggacgtctgcgatgaccaggatggagaggaggcgatgccgaagacgacgtcgctggctcgccgctgcgatgccggaggtggtggtggcacggccgacggcgcacggggatggcagaaggggctgccgaaagcgacgtcgacgaggaggaaagagaggccggcgcggcggcggcgggctccggacgaagacgggcagcggtcggggtggagggtgaccccgtggagccggggaaggagatgacgacgacggctgccgcaccgatgaggaacagtagccggccggaggcaggaaggtactggacaccgacaaggagaccgctctggcgagcttcgggcgaggaggaggtgaggccggagaagagggcggcgtcacagagccgagggaagcgacggcacggccgaccgacgctcacgcgcggccgcacaggcggttggaggcggccggcgcgggggaaagagaagggcgacggcggggaggggtgatacgaccatggggaggctcgggatgaggctaaaactatagaacggaggatggggattccattttataggcgcggggagggagccggccaggggaggagcggggaacggcggtggagtatgtggccggcg

SEQ ID NO: 22503 - DNA, 9541 bp, Oryza sativa
ttgaattatgtttcttaaaagaaccaacttatcccactcgacatgctttgacgtcttcccaaatgtctttactggtggacttgtatttttctgattattgacctgccaaatctgaaacttctttggtggatgtgattttaatcttgactctgtagattatctttgaacatatcacttggttcataactgggaatagctctcacgaacaagcaactcggattcactttttttacatttggttcacttcccactattctcttcatgttgtcctcagttagcattcaacgtattcctttacacctttaaccttgatgtgttctttcccgatttctcttatcaatcacgtttcgacctacttctttgcccggtaataaacatctttttcgatatcttctatcaatcatcttttgacctttgtcaactaagtactcttcactccgagagttgtggatgcttctggtgacgatgtggtacttgagcctgctgcctttcagagaaaccttcaagtggttcatcaaaagctagactggcggttgttgcctttgatccaaagaagacacatctgaaactcttagtccaaacaaaagtctctttggctttttaatctaacacagatcgcttcattttcttttctatcaacaactaggttacttgatttatcatagattatgagcttacggatatgagaccctaggtctcctttgtcagtaaacaattacgcacataatcacatatccgcatcttccaaaagaatccacatagatcttgtctgtattatacatttctcccttattacatgaatactaagcactgcctaaaaaaaaggaaaggtgcttagcatcggtacattgtttctgctatgggttatgattagcacgaggcctcacaggtatggcgtttgctccagtgaccacaaggcgagtgacttgtcttcttcttgcataatggccggagtgatgacgcaggttacgcttcggttgtggacaatctgtggagaaatgacctggttctttgcaattgtaacaaatcaatgtcttctttactgagctgttcgtctgggaacgatcattctgacttggagttggaattggtggttggaaatccttgctaacattggcatcagtggtaccatagttgctatcaccattggagtctttctcagagtcaaaattgctagggttgtcattctgggtgccttcattgatactatcgtcgatatcttggtgaatgctattgacatcgcacgcttgatccgagtggtccctaatggggcaagaaccatggttgttggtggtatcatcagcattagtattgctaatgttgttgtctgcattgtgtccatcttcttggggtaggaactcttgatgcgcaacagaggatccggtgatctgaagtggctcaatgcgctatctttggttaccacgtggaaatactgggatgttgacaatccttctcttgcagttcttcatccgattatgatcactttcgagttgtatggcttgtgtccacaagtttctcaaaatcttcataatcctctaggagtagttgcactgcaacctcatcttttaacccctggagaaacttctcttgtttgtcttcatccgtttccacatcttctggtgcatagtgagccaaacgatagaactcgtgcaggtactctgtgacggtcaaatcttcttgcttcaggtagcgaaactctcgttttcttagtgtgatcattcctgcgggaacatgtgatctcttgaatacagatgaaaactcatcccaagtgatggtatgtccttctggccgtgatgcttcgtagctattccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctaataacttgcactgttgctagactgtaggtacttgaacgttggttgcccctgctgggttgttccaattttgtaatagttgaaatgctgttgccaacatgttggtttggttaaccacaatttggattagctctggtgaggtttcgttgatgcttttctcattcccattgactgtcggatccatcattcccatagcctttgttaccagtgttatccatctgtcacaatgtagaggttgagagaggaagcatacaaggaaagaatagaccagaactagggacaagaccttaaaggaactaactctttttgttgatgtgttgtttgttttgcttattctacaagttgattaagcaaacaacctagcatggttacatcacaacccaccgatgcaaaccacgcgctacacacacaagcaaaggaacacacgactaaccacactaccctagagggcggcttaggttctgtgactggttcccaagatcttcactgcttcttccactttgctagcggatcctgcactcttctggagcttcagcagacaattgatgacatcttcttcttcgcaaaactaaccatctagtactagttgaaaatccgaaggaggaagaagagaataaacattttgcaaatagcattagggaaaggaggaacaaggaactttcgcaaatagtttcatttataaaatatgtccttaggttttatccacttggcttatcctacagtcgagatggctctgatactagcttgtcgcgaccgagaaaattgccttttcccgaacgctagtgtattaatccccgtcccaggaaaagccggggtacaccaaacaaacatgatacaaaaggcacatctttattatatcgataatatttacattattacaaaggcacttcaggcctgacaatcaaaaataaacagcagcggactagcaggcctacggctccatcttcacaggcgctcaactggggtataagccaggactccacctaagacttcttctccaaagcttctcttactgaaggggggaaagatagagcaagaatgagtacaaccaccgttttttttaataaactttgataattgtttttgttgcttaataaatatttccggtgctctgaaaattcaagtaaaatttgagggctcattttagaccaaggagaatttaacaaaaattctccgggccacattcgaatttttcttgtacatattttagtgttaaccaatttcttttcgaattttaattaattctattattccttttagagaatgatttttatttcgggatgaatttatcaggacgtgacatgggcccttccggcctggccttcggcccatctcctctcctggttcttctctatccatttctcggagttttgtgttgattctatggtattttgatgaagttcaaaaaccatccttgtatggatacatattttctctcactttagtatgattttcctcccaactttagagtttatcacttgcatacaaatatacaccaacacttgtgaaatatgtgagatttaacacctatcactctatgttggatgttttattgtctggactttatgcagatgttggcggtatagaattggcattgaataactgccaacaaaaccccctacacttagctctttactcgtcccggagtaaaagttagtgtagaataaatttctccaagatataattcgagtatataaattattcagacccatacctacaccgtgaactttaacagtggttacttgccatctggggtaattaataaatggaatgatctcgactccagtctttcttgcttctccggtcagactcatgggatttttatgaattttcacaaactaactcttttcctcatattgaccttatcccttgtcactcaagtaaataattttttttcttgtggatcctcaccaaggcaaaaatgtgccaaacttacccctattctaaggctgatatatggagcttggtaggggtaaaagtgtgacatacatgcatcatatatattgcaaagccaaatatatggactcaagaagattatcagtcatactcctagatcaagggtctttatatgtggtggaaaaaggaaaagtgaaatattttgtggaatgatggaataaagaaatgtgtctccttttttttcctatacctcctccatttttttttcttgcatgaatgtggaagtggcatggctatatgcatatttttttttcatcatgctcaatgttttgagagcaagctttatttctctctcttttttatagccatgcctttccctccttttctcattttctttcctttttccaaggattttctaggagaagaaaacatagtttaaaataggtgtatattttaatggaatttttgtgggaagccaacttccagtgtagaagcttagcttaattatatatatggaaatgaccccttgatcatgagagtataaaagatatctaacatgagtcacatagatttgacaaagctcaatataatgtcaagcagtcatatgcataataaagtttatcattgatatacttgcatatggccttggtaggtataaaataaagtcaattggaggaatgagctctttaaaacaaaattttattttgaaaaacaaattcccataagtaatgacaacagttgaagaacttccttcatctttaaccatctcacatataacaattactttgatgcataacgttccctaaacatggatgttcgttcacaagtacaagttcagctaagaataataaatatacaagattaatcataggaagaatttcattagttggaaattttatctttttaattatgcttgaactaattaatttctgaattcacagctctagtactataccatggtggagatatacagataatagacgtgctcacctgcttacctaggaaaattgagagggattgggactagcactggttgggttcagcccaaccaccttggtacccaattcctctgcaattccctgcagagttcagtgtacctcaggtgtttagatattcagcaaatttcagagtatgtgcacgtcagaagctaggatatctcccccacacttattcaaaacctgatctttattaaacaaaacaaaaacaaatcttggcaaacattggggttaacaccaatgagtcacattatttatagcaagtgcttacatgattggaaaataaatgaccaagcaccaattacatttattcatgagaaaggagacatttaattagcatcatacttattctccttccccatctctacgaatgcacgcttgatctagcgcatgaaccgcgactaagagtatcaaaattattcctaagctcagcaagctctacccctagttctgcgttacggtccctaagctcaatgttctccttgcggagcttcttcacttgtgccgctagcttatggaccgagggttccggcgacttcacttcttcctcttgaaattggccaagcgcccttacaattggagggggcgtcaaatgacgcttcaccgtcataggtggagggcaacgggattccgctgcccctccttctccgatgccgtcaacggccggagcaagcctttaccatacctaccgccgggagttcgcactctccgaatgcaaaaccaatcctccttgggggtggatggagtggcggtgggtgtgatgtagttgtggagctcctcatcccctgccttggtgtagagggtgcccacataccgctcagcaggaggcggagtggccttgtcatcgtcttggaaaagacgtctcgctttaataggctgagttcacccgtcgttgttcgtcgtgcaggctaatacccccggattttggtcttggtgacatgacgaggggagagggatcgtgctgccgaacggggagccgaacggggccgagacgggttcgaccgaacccctggtttggccgaaccagtgagtttgccggccggctccatatttgctggggagctgggcaccgtagcaaggggtgaatgcccccttccattgtgtagttttccactgggatgacttgattcgccggtgtttctccttcaaggttgtaggtggagtttgaggaggagccaatgtatggcatcagggatttgccagccattggtgagttgagggtgtaaatcaaggaattgagctaggatggagagaagagttgcaaagatggaggagaggaggaagaagggtcttatggtgctgatccaaaagttctacctccgaatgcgcatctaaacaaactcaaacgagcgcggagaggaagctattcaaacttggggccgattgggtgctaccctggtgggagcaggagaatggaatatggactttgaaggagaatggaaccaggggttcggccgaaccctagtgggctcagctggctaccaaaattttcacacgctcaagcaaacttattctaagctcagaaatgacaattttacaggaaattaagcatgctttagatgagatcattatggttcataatcgattaattcaataatatccacttcttcatctaaagattcattaggctcatgaaaaatttttaaacggtaactgcttaccttaaatatgttatttgagtcgtcgcaaagtgtgattgccccgtgccaagaggtgtcgataacgtcgaacggtccttcccatttactgcgcaattttccgtggccgaaaagcttaaccctcgagttgaacatcagcagtttgtctcattgcttgaatttcttgatttttatcctcttatcatgccagcgcttcatcctctctttggatatctaagtgttgtgatatgccttctctctccattcttcaagttcagcaatttgcatcatcctccattctcctactccttcaaagtccatattccagttcctgatggcctaatatgctctgtcctcaagttctacagggagttggcatgacttcccgtagacaatctgatagggagaaattccaatgggtgtcttgtatgctgtccggtatgcccacaatgagtctggcaatttctccttttatcctgttcccattttgttgaccgtcttttgcacaatattcgtgatttgtttatttgacgtttctgcttgactgctggtctgtggatggtaaggtgtggccacgttgtgcttcactcccatgtctcgtaggaggtctcaaaaggttttgtcaatgaagtgcgaacctccgtcacttatgaccatccttggggtaccaaaccttgggaagatgatctctatcaacatcttcttggtatgcttcgcatccgcagcgctgcacaacatagcctcaacccacttggagacatagtcgactgccaccagaataaacttgcaactcgcagttacatgacttagaaaaaggtcaataccccaaacatcgaatatctcgacttgcaggttgtatgtgaggggcattgcatcacgagcagtgattcctccttgcctctgacaacttggacatcttctgacgaattcttttgaatcttcatacatcgttggccagaagaaaccgcattgccaaatcttggcttgggtgcggaatgcgccataatggccaccataaggtgaggcatggcatcgttctataatcttaagtccctgttcagtcggcacacatcttcttagtaaaccaacggagcagaccctatataggtatggctcatcccatatgttacggcggctatcgtatttcaacttcctttgattttctcccggtggtatgtattttgataccatgtagttcactatgtttccatccacgggttggagtcacgtaccgtcatcagcatgtcgtctctcaagaaatcatttatcagttattcctgcatgtcagtgatttgcagcctagaaaaatgatctgctacagaattttctactccctttttatccttaatttctaagtcaaattcttggagcagcaaaatccatcttaagaggcgtggtttagcatccttcttagtgagcaagtattttagagcagcatgatcagtgtaaattatcacttacgtcccatcaagtaagatctaaacttatcgatagcaaaaacaatcgcgagcagctctttctcggtagttgcataattcaactgagctctggttaaagttttgctagcatagcagattgcatgatgttttttgtctttggtttggcccaagaccgcgccaacagtgaaatcgcttgtatcacacataatctcgaagggcagagtccaatcaggaggttgaatgattggagcagagatgagtgcctttttgagaatttcaaagtattttaggcacgcgtcatcgaactcaatgggaccatctttggctaacaggttggtcagaggtcgagcgtttgcagacaatgaccgaaggtccttccatagatagagaagtcatccatgaagacttccataatgtcctcgatcatattcgagaaaatagacatcatgcacgtttgaaaagatgcaagagcgttgcacagtccgaaagacatcctacgataagcatatgtgtcgtacggacatatgaacgtagtcttactttggtcctccgtatggatgggaatttgatgatacctgcaatacccatcaaggaaacagaaaaaggaatgatttgccagccgttccaacatttcatcaaagaagggtagcggaaaatgatcctttttcgtagccttgttctatgcacatcctccatccagttatggttcgttgcagaataagttcattttgagcatttgcaacgaccatcattcctcccttctttggcacaacctggactgggctaacccactcactgtatggtatggggtaaataatcccggcatgcaggagtttcaggacctctttctttacaacctctcgtatcgcattattgagtcgttgttgaggttccctggagggagtactctcaaggtcaatagggatacgatgagtgcaaagtgcaggattaatccctctgaggtcttgaagggaatagccaagaacaacacgatgcttttctaacatagacagaagacgttgagtctcgtcttcagaaagcttgtcactgattatgataggggcttctctgtcattgtgcaagaaagcatagcgtaggccttcaggtagaggtttaagctcaaacggaggtcgaggtggcagttccatgattggaagttcgagagtctcactaggttccgcttcttccttgatgaagtcagggacttcattttccagaagggcctcgggagactcgtgagggggaactgctctaacctcctccgcagactcaatctctaggagagagccggtcaaggcgaaccatgcccgcgagaatgcaactgagaattcgtttcctcccaaagttatcttgaggctatctaatcagggcatgtttattaggagtttctcaaatgggaagcccgattagaatgtcaaaatcttagatttcaaagtgaaagtatcaattaggcatagaggcgggtgaataggctaattcaaaaattcaattaaaagcggaagcagtaattttcggagtcagcccaaactcaaagtaaatcctagatctagttgcctataacaagaatatgctagcacaaacagcaactagacctatag

SEQ ID NO: 22504 - DNA, 2136 bp, Oryza sativa
tctactctctgttgaggagctcactaagagttgggtcttagctaaccctttcctcaagaggttgcactaagcactcctccttccactaagggtatctcttccctttcggaggtgagatctgaccatcacaaacttctcccggccaatcacaagtagatcgggggctcgggagcgacacctagccgcctaggagtcctcagcctccaagagtaacaaatgaagcaatgaactcctggagatgatgcaagtgctcacaaatcttcacgaagtcaacaacaagcactcacacaaactcgaatccacaactctcacacacaccaaatccgaatcgaacacgggtgagaggggaaacaagaaagcaaggctcaaaagtgaatctcaacaagagcaagccaagagcacaagaatctccaatgtgaccagcagccctcacaagtgaggggagggggctatttatagccacagcctaaattatgcccgttatgcacaataattgtgattttcagatattccgaaagatttttggacatgtccgaaaattctctttcagacatgtccgaaaattccagctcggcaccgacagtaaagttaactgaagatatttcggacattccgaaaacttttcggacaagtccgaatatttccagaaccaaaaacacccttctggacattttcgaaaagtccgaaaattcctttcggaaaactccgacaatttacagaagcgaaaagactctattgatgtttttcaaaaaatccgaaaatcagttttggacaagtctgaaaatatgcagaaccatatttgccttctcagtcattttcggaaagtccgaaaatgccttttggacatatccgaaaatttccagaagcgaaaaactggctctgtgtattttcggaaagtccgaaaatgaatttcggaaaactccaaaaaaattccagaacacaccaaactaaggagaaacacttttaaaaattgattttgagcactttgatcactcctcgtatgtcaatgcatcatccctcttaatagtgcggctttcctattaactcaaggaaaagaaaaggtacaatatagcatttgctcatttgccgcatcacatcatgtcaatgcattgggtgggaaatgcattactttaactcattgaggacataacaaccttcacatttacgtgaataaaaattttaatcctctctaatcgcattgtaattaatcaccaaaatcactaggggcctagtcgcactttcacaaagacgtggaaatccaagactgcctccttgtcttcaaagcagacaggtacatcttgtacaatcccaaatccttcaataatatttccgttcgggtgtttgaagaatttatttgtcggggttactgccttaacaaggcgcaagtgaagctgggaatgagtcacatcatgatgaaactgaagctgagtgacagtctcgatcatccgcataatgtgaggagcatagaccaaccccttcttgtactgaatggaggccatgcggatctcctcccacacaaagtgcaaaacatgaaagcgatgaggaggggattgaacctgagaagtacggtcctggagaggtggttaatgctgctggcatcaccatccttaggcacaaaggaccggcaaaacatccggttcaagcaggcaaagtacggtttgagaccgtcgactttacccaacaccacattaggatcatttggagtgtaaagagggaggagattagtgttggcaggaatgggaagatcatgcatatcaggaaggtttagcaaggaacagacgtcaaaaccccaaatctcaacaaatcgcggacaggagacataatagtaagagccttgggtcatccaatgcatggcacaataaggatcaaagaaaacggtggcatataattgagcgatgacttcgctgcaccaattctgctgcaaagtcacgaaagagcgaattcccatgagctcacaatttgcaatcacaaagtttagcaccggatcatcatgcgcctgcagctcctcctagttgatccattgcatgggaacggtgggatgagctttggacttgatcacagactcatcaaagtcttgttgaaagagagtccaaaaccgcgaatccgtggcggtgcggcgaagggggcgcggatcct

SEQ ID NO: 22505 - DNA, 30021 bp, Oryza sativa
agccacacgcgcaacctgaggaaccgcatcctctctcccggaccaatcactgtccaaatcatcatgagaggatggggtgggagagcggtccctttggtgcttggacttgtgggaggtttgcttgcgtggaggcatccttcaaacaagatatagacaatgaatcagtgaatggaagccaaagaagcaaggaccaagtaagtgaaggcaagaatcgtgcaaaaccgaggtgataggggtcggccaggaattttcggatatatccggaaacaattttcggattttccggaaaaatccggccgaaccttatcatccggatgcagcacaaatccgccaacaaaaacttgggaaaatgaatctgcaggtcctagggcactaggggaacatctccaccaaagggaatcacaagataaaacttgaggaatcaaaggatttgattttagggcggatacctcaagaacacgaagaacacttgaagaacgcggtgatgatcgacaacgcaagtcccaataagtgccccaaacgcgctcccacaatgttggagaggaggggagccgcgggaggtcgccggagaatggggtcgccggtgcggagtggaggagggagtcaaacccgttgggaaaaagtgaggaagagagagagagagaggagtccacgggtcaaaatatatgagccccgaaattttcggacatttccgaaaattttcggataagtccgaacggatctagaggggaagcacacggttttgatgattttcggatatatccgaaaatttttcggaaagtccgaaaaatcctggaatagcatgaatagaagagcgacaggatgggaaattttcggaaggtccgaaaatttttcggaaagtccgaaaattcctggaaaacacagttttgcaaggggatttcgccgggaattttgatgaaactattttgcaaacatttgaaaggaattttgtaggggacaagcaccgggaaatttttttcaaaaacacatttcacaaagatttttgataggattaggaaaggagggatggtcgagctctagagggtccacttgaacttgtgactagcacccaatcaatcacacaaaccaatagccccaagtcaaatggacaatccgagggatcaaaagagagggaattaccatgagacaagataattcaccctcgagagagggaatgtgtgaatctatttcaagttgtgctacgaccaaaatttgttgaaaaatgagatcccaatacacatagattcaagttctccacaaaagtgactagtgtccatccatgagttgaatgaccattttgtcacaaagtagtatgcaaacctattctaccaagcaaacatgcatgcaatagatcaagccacattccgagaatccaagatatttagttcacttctcaactcacaaaacctaacttcatctagaggcttggtgaagatatccgccaattgtttatcggttctcacatgttggatatctatgtcgcctcttgtggaatgatctctcaagaaatggtggcgaatatcgatatgtttggttcgggagtgttggacggggttgttggctatcttaatggcgctctcattgtcacataggagtgggattttggatacattgaggccatagtctctcaaggtttgcttcacccaaagaagttgagcacaacaactcccccgccgaaacatattccgcttccgtggtggatagggcgacagagttttgcttcttggaagaccaagaaacaacagacctacccaagaattggcaagtacccgatatgcttttactatccactttgcacccggcataatccgcatcggtatagccaatgagatcaagcctcgctcccttaggataccaaagaccatggttaggtgtgtgcactaaatatctaagaattctcttcacggccacaaggtgacactccttcggagcggcttgaaatcttgcacacatgcacacactaagcataatatcgggcctagatgcacaaaggtaaagaagtgagccaatgatggaacggtataccttttggtcgacgtctttaccttgctcgttgaggtcgaggtggccatttgatggcatgggagtgtggattggcttggcattttccatcccaaacttcttgagcatgtccttcaaatactttgtttggcaaatgaaggttccttccttgagttgcttgatttgaaggtcgaggaagaacttcaattcacccatcatggacatctcaaatcgtatggtcatcatcctactaaactcttcactaaaagacttgttagtagaaccaaatataatgttatcgacatatgtttggtagacaaaagtatcattatcatgtctcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatagttcggatcctcgaagcccggtggttgctccacgtataccaactcgttgataggcccgttgaggaaggcgcttttgacatccatttgatatagcttaaaattgaggttactagcaaaagcaagcaatatgcgaatcaactcaagtctagctaccggtgcaaaagtttcaccgaaatctaatccttcgatttgggtgaacccttgcgccactaaccttgccttgttccttattacgaccccggcctcgtcttgcttgttgcggaagatccacttcatgccaatcacgttttgccgaggtcgctccaccaaagtccacacttcattccgggtgaaattgttcagctcctcttgcatcgccatcacccaatccggatcattaaaagattcttccacccttaaaggttaagagaagacacaaacgagtaatgctcacaaaaatttgcaatacgagaatgagtggatactcccttgttgatgtctcctaaaatgttgccggtgggatgatctcgttgaatactttggtggattcttgggcgagctagattgatcagtgagggtggcacttgctcgccttttgttaacaaccaaatttggtaatatcagcattggaaaagaagattagatcgaaacggaatctaagacgaggattgtcgcggaaacagagcaagaatcggcgggagtccggatcggatacgattgagatcagctaagtccgagtcagactgggttaggtgatacagccgattccgacaatacgacttggtgtacgacatcatgtcgagttgatttgtcttccccgccaaaaccttcgccactttccccaccctcagctacaatgcaaaaccacaccagcgaaagctagggctcacaaatccactccaatccatctctctagaacttcacagcttccacaaaatcttccgtgcaaccaccgcatcaacctcccatccattcctcgccacttccaaatcaaatcgcatcatcccacttgcatccatggcagaggagagagagagcttcgaaagtcagtgggcgccctccgatgttacggaggaagatttgaaggagatggtggcgcatggtgttcttccggcgaaggagatcatcgggtggcgtccggcatgcggcgaagcatttccgacccctgacacacatgaggtcgtggtgttctctcatttcttctatgggggcttttctcttccaacctcaagattcttccgggggattctggagttttacgggattagtttgcatcacctaaaccccaattccatagtccatattgccaatttcatccatgcttgcgaggctttcctaggtattagaccgcattttgccctattccgccacatcttcttcctcaagccccagccaaacaagagcaagccatgcattgttgggggagccggttttcaactaaggggaaccttgagccagaaatatttctccatgccctctaaaacctcgaacaagggttggcatgcaaattggttttatgtgcagaatcctgaaccagcgcttcctgagtacacctgtcttcctccagtatatcaagacacctggaacttgcttccaattggagatgaggctgcccaagcactcctccaccggtttgtatctaacatctcggcctctctgaaaaacatccttttgtcttctgcaaggttgattgaaaacttggaatatcatgcataggaattttccttgatgaagtctgatcctccgatcgctcaacaccgctcaccctgtcggcaggctggtcaggctagtggaaggccaaaaatccggtccgatgctcaaccaaacacctcgaagccgactaaccagtcagactctcgtaagaggaaattagttctgagtgacgatgagggtgacgatgttgaaaaggctggcagcaaaggggtgactggaaaacagccaagacaagctaacccgaagaagaaaacatccagtcgtcccataccgaaaatcaggaagtcatccaggtacatgtcacttagcattttctcttgtatcgctaatcattcactattgaagtattgttaatagcatatctcaaatttgcaggaagccttatgacatcgatccttctggaaaagactctgaaccaactggcgcggagactagtcctacgacagaaaccgggccgactgccaaagatcgcctgagtagtaatcaaccagcaaccgacaatgtacaggccagcaatgaacctcgactggaaaccagtcggccgaagctgaagtcagtactgatcaggagcccccgactagaaatcagtcgggtacagaacgaaatgaagacatcccggaagcagaggctcaagcaagcagccctccctaaaaaggtaccaacgccaaccttcagtcctgcctatcttactcaaagccgctatccatatgtaattgatcaatggaaaataatacagtgcaagctaccaagatatccgagctagaaaagcgaatcaaagctctagaaaaagacaagggcgaattgaccaaacaaagggactcggctctgaaagatgtcgaatgtacttgttgctgaaacttcaaaccattcttgtcttcttgcatagtcgttgatgtgaaccatttgcgcagatcgcaaatcaaatctcaagctcaattcgacgtcttggtcaacaaaattaagaagcttgaaggagccggagatgaagttgccaacgccgccacaccactcatccaagccatgtttttcaataataatggtccgagttcttttgatgctgttgaaatcttcgacaagctaagagctgctccagatacatattttaagaacatcaaggaagcgggatgcatgggggctagcctggcattggcaatgaccaagtccttgtacccgaagatcgatattgatgctgtcgacgactttgcagatgggacaagtgaagaacatgcccttgatctcatcaatgatgcacaaaaggctgcagacaagattactgctgatgtagttgagaggtttcaggacaacaatctcgggccgactgggtctggtaattctgatgatgaaaaaactgagtctgatttacattgtatagtattaacttatgatgatggaggcacaatttgtacaatactgatgaatttatgctgtgcttgataatttaaactcagctcctgatttcttaaaagttttcgtcaaaccttattgagcctagaactcgcaaaagttgttaaaaactttcagtcctcattgactaagccaaaagatcaaacaaggcaatgataaatcaagtaagaaaattgaattgataataatcacactccattattattatagtagcccccgactggtaactcaaggaacaacttgatgttagcagtcaaagaggaagatacaaaagtaatgcctaagcataaaaacgacgaagatactcaatattccaagagttgtcaacatgagtatcgtcttcacgcttgagtctgtaagaacctggccgagtaacttcaaaaattatgaacggtccttcccataagggagataacttgtgccgatctcgtgtagtttgaattttccttaaaaccaggtcttcaactgagaaagcccgcgatcgaacattgcggttgtgataacatcgcatcccttgtaaataccgagccgactgaattaaggctgcttcacgggcttcctccagtcggttgagatcatccactcggtcttctccctagcgctcctctttgaagttacgaaatcgtaaagattcgaattctacctcacttggcaacattgcttccgtaccatagactagaaagaacggtgactggcccgtagcccgactgggtgtagtgcacagagaccaaagtacagacggcagctgatctacccatttgccagcgtacggatgcagttggtcgaaaactcgtgctttaattccttgaagtaccataccattggcacgttcgacttgtccattgctcatgggatgcgctacggaggcataacaaattttgatgccgaagtcttcacagaaatctttaaatactccgccagtgaactgagtgccattatcagtgatgatccgattaggtactccaaaccgatgcacgatgttgatgaaaaaatctctagacttgtctgttgtaattgtgatgactggtttggcttcaatccacttggagaatttgtcaaaagctacaaagagatgactgtaaccaccggtagcctttttgaatgggccaacaatgtcgagcccccaaaccgcgaacggccaagataacgggatggtttgcaactcctgagctggtaaatgagtctgtcgggcaaaaaactaacaaccctcacacgttcgaacaattttgtcagcatcggatacagcggtaggccagaaaaaccctgtcgttaggccttaccaacaatagtccgtgcggcagcatgattgccgcagatgcctgaatgtatatctcttaacaattgccttccttcctccaaagacacacagcgttgcaaaatccctgatggacttttcttgtacagctcgatctcatgtatgacgtaaagtttgctgcacctggagatccgctcggctttgtctttatcttgagggagctcttgcttggtcaaaaatttgatgaggggctctctccagtcggattcgatcatgattacttcttgagtgtccgtagcctcggttgtttctttgcttggtacggttggttcataaagatgttcaacaaacacatcggaaggaggtgcttctcgttttgaactgaaattggccaatctgtcagctgccttattgttatgtcgaaaaacatgggttagctcaaggccatcgaacttatcttctaacttgcgtacctcctgccgataagcagtcaaggcaggaccactctttcatgacttgattaacaaccaactaagaatctccacgaactattagatgctgaattcccaaagatatcgcgatccttaatccgtgatgaagcacctcatattccgccatgttatgggacgcagaaaaatatatccacaatacgtaactcagcctttctccagtcggggaaatcaggacaacacctgctccggtgcctaaaagcctctttgactcgtcaaaatgcatggtccaatactccatcttttctatcggcatgtcttcttggaactcggtccactcggcgacgaagtctgctaaggtttggaacttgatcaaagttcgtggtttgaaagatagatccaaagacatcaactctaaggcccactttgcaatccgtccatttgcctctcgattatgaagtatgtccccgagtggaaaacgacgtgaccaccgtgaccgagtgaccttgaaaatagtgagataatttcctaacggtaattaaaacaccacataacaatttttgcacctgaggatatcttgtcttggagtcgaccaaaacctcgctgacgaagtaaattggttgttggactttttaaacatggccatcatcttcacgctcgacaaccaggaccatgctcacaacctgagatgttgtcgacacatataacaacagcggctcttgtggatgcggtgaagataagaccggtggagtagtgagaagtttcttgaagtcttcaaaggctttttgtgattcgggtccccactggaaattgtcagctttctttggcaacttgaaaaagagcatcccccactctccgagtcgtgaaacgaaccagctgagtgccaccatgcatccagttaacttttgaacgtcattctgggaactcggcggtttcatgttgaggatggcgttgattttctccgagttggcctgtatgcccctatgggacgccataaagccaagcaacttccctgacgttactccgaagatgcactttttagggtttaatttcatcttgaagaagcagatgctcgcaaaggtttcttctagatccgcgatcaaatcatccctctgcttggtcttgacgactacatcatcaacataagcttcaacgttacgaccaatctgagttgaaaagcatctctggatcatgcgttgataagttgctcctgcgttctttaatccaaaaggcatggtgatgtagcagtaggccccgaagggcgtgatgaatgaagtcttcaagtagttggactcctttaaatggatctgatgatatcctgagtagcaatccaaaaagctgagtagctcgcagccggccgttgagtcaactacctggtcaatgcgaggtaacccgaagggatctttgggacaagatttgttgaggtcggtgtaatcaacacacatacgccattgtcccgtcttcttcagaaccaggaccagattggccagccagtcgggatgtaggacttctttgatgaagcctgttgctaacagcttggtcagttcctccttgatcgcatccttcctatcctgtgcgaagcagcggagtcgttgctttatgggtttagcgtcttccttaacatgtaaagagtgctcaatcacctctctaggaataccaggcatatcagatggtttccacggaaagatatctttattattttgaagaaaggtgatgagcgcgctttcctatttacaatctaactcggcgcctattacaacagttttagtgggatcagagggatctagaggaattttcttagtcttggcatcgccctctccgttctttggcatcttggttgcaggcacttctccttcggttgctgtggatgcagccagtcggatttcctctcgagcgagcgtaatctcgcgggtctgggccatctcgcagctttccttgtggcaagtcctggcatcttcatcatcatgtaggtatagtgcgggacggccaagaacttggctaacaccgggcgttcgagtatagcatggtacgctgtctcaaaatcaacaacttcgaagcaaatgttctttgtgcgaaagttctcccaagtgccgaaagtaaccggcaaagtgatctggtcaagtggagtagaagatagcccggggatgactccgtgaaagggcgcattactcggcttcagttctgtgcgagggatctgcatgtcgtccagagtcttggcaaaaaggatattgagtgcgctgccaccatcgatgagggatcgtcggagcttgacgttacgaaccactaggtctagtaccatggggtaccgccccgggtggaccactcagtcaggatgatctaagcggtcaaacttgatagctgtctctgaccaccgaagatattgtggcgtatcgggctgaacggcgttgatctcccgctcggttagcttttgctttcgcttacattcataagccaggggtccgccaaagatatggttgagttccttgcgtgagtcttggaaaccagtaggggcatcatcttcatcatccttcttcttcgacgtgctttgaactccgtcagtcggtttgcttgagttcttggcgtattgctctgcgaactatttgtagacgaagcaatccttggccgcgtgatttgaattcggatgatgtgggcattgggagtgcatgatcttgtcgaaagtgttgacgcgcgaacgctgtcgggaggatggtgtagtagttgccacaagttcttcgggcttacgcttgcgatctttgtaattggtacttccactcccccttgtcgtcggcgtatctttctttggcttccaggtggtgcctgactgcttggatgcggtgacgacgtcttcagcttttgcgtactcattggccttttcaaacatctgcttgacagtcctgggaggcttgccgactaagagttcatgacgaatgcccttggtgaaggcggcaatgatgacgtcgtcggtgatatcagagatcttgttatgttgctcggaaaaacgtcggatgtaatctcagagggattctccagacttctggacaacgttgtaaagatttaactgagtaccagggcgttcaaaagtgccctggaagttggcgatgaagtggtcgcgaagctccgcccaagatccgattgtgccacgggatagcccatgaagccaggaccgagcagagtctgctagggccacaggcagataatttgccatggctttgctgtctcctcctgttgtgcggatcgcgagcctatagacagtgagctaagactcaggatttgtcgtgccatcatacttctcgattccagtcggtttgaagccggtcggccaatccactcgacgcaggtcacttgtgaaggcagcatctccatccacatcgtcatcgtaatgatccagtgaatggtgggggatgtagcctcttgccgtgcggcgctggttgatagtttcgcaaagatcgacgggacgactgcgacgtggggagcgaggctgttcggctcgacgctccctgtgtcggtcaggaggcgagtggacatatcgttcgccatgatccctactcctgcggctagatccggcgccgacgacgctgaggcttggttggtgatagtcttgagatcgaagaggcggaactcggctgccagtcggcgtacggacacttgcagagttcaccgggactgaagcgacgatcatggtcttgatctgatttaagatgttgacgacgtgattggcctgattgagtgcatcttccttaaggagagtgtcgagaagggtgatcgctgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattgatccgtcgagtgatctaggagaaaaatcgtgccccaagagacacccggacccctccttatataggagaaggggtccgtattacaaagtacagcccatactcctaacggaataggtagttacagataagatacaatcgtaaccgactaggatcccgggtatttccttgacataaaagtttggaatttaacccgagtccctttaaagatattctatctatacatggcaccccatacccagtcggatatacatgccgtgtaggtatggggtatccataatctccacagatagagtcctgagaaggcaattgtatctatcaattaggatattttatgtaatttccttagagatatatttgggcaaaagtctgccgcaaagacttatggtatcttagagtttgttagagataagagtcgtatccgataaggacatagtttgtaattctcgggtataaatagaccctgaaccccatgtaatcaatgaacacacatgttcaatacaatctcggcgcatcgccaccctttttactttcgttttgtttcgacgagttcttgctttcgggttgagctgtatcggtttcgatctttaacaagaggtaaaacttgttatgacggcttgcgttctcgggattagtgcttccatctttacgacactctaatcttgtttatgtaattcatcgagttatcatatatcctgcataatctctggcaatatcgttatctggcctacaatcggctaacatctatcggtagaaggcagccgattaggttaaatagtgacgttggcttggattatataggatatctaccactctatgaaacttctaatggcttgattgtctagatatttgtcacgcccggaaattcactagtaatttcaaacttatttgtgcataaaatcctcgtctaggaatcagccgaggtacacaaactgataatttaatatacaaatccatcataataataacgttacatacatacaaaagaaaagaaaacagcagcggaataacggtctagcgatggcttcagctccactcccacaagcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagtaaagatttaagagtagtgaaacagtagagtaattaatcagaaattttaatcaacactgaacagcacacccatgctgctcaggcccaaccaaacctgaacaaccaaccccggtcgtacagatcaaacctccaaaccaggaatttaccattccaaaccaggagtcaaatttattatcacattattatcattaatgagtagtgtgggactaatcacgaaaaacattgctcaacccgcccatgaccgcgggcacggctattcgaatagttttactctggccagaggtataccactatacccacaagacacgattccacacatgttgccatgcctcgaagtaccaccacggcactgcaaagggggaaatcatgacaatacccttcgcacaacacaactcaccacagtgcaccattcctgaatcataatcaacccctctataaatataaccagaggcatggactccctagcgatccccacggacttctcaccgcttctcagtctggtgccccgtaatgaatcatgctatacaaaaggtaaagccgttgcccacgctggcttgtggttggcacggttaatgtctcacaacagtagctcgcgaaccggtccttaattgccataagcacgaccttcaaaaccatgtgctgacaacccaccattaattatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgtacagttgaaataaatagagaatttaaatataggatcaacatgctcaaaggattgtgtttaggatctgtgtgacttgccttgcaataatcgatcttcaattaatcttcttgaacacttccgacgcactcacgaaccttcgcaacgacggaaacgacaaagctagcacgcaaaacgaagaaaaagactaataaaaaccaaataaacagtacaaaaacaagcataaacagtatatgtggatatttttaacatgtagatcttgattttagaaaaatttagcaactagaaccagtcgaatccgagttacgacgatttagttatgaagttccgaagtttaatcgattttcatctaataaagaaaacctagaaaaagggatttatgacgtcatcgctgacatcatcatcgccggccatggcacggttgacacgaccaccggcaaaagagggctcggttgggctatccgaggacacctacgcgtagaggacgacgacgcgaactcaccggtgcaaagaacaacgaaggacgacgacgaacgacggccggcgacgaggttcaacggcggctcgactcgggtccccgacggcgacgctccggcggtcttcggcggctgcgaaggggcggacgggattcctctcctcctcacgaacccgactgtgacgacggacggcagcggcgacgatactagcggcagcgcgacgcgaccggaggatcgccggcgacggcggcggctaaaacaacgcggcggcaactctacgggcgacggctcggttgggacttggggtaaacggaagaggacgactaggggatgctttatatcggcatgggtggaggagatcggctcaggaacggatggatttggtgaaagaagagtcgggcttatcccgagttcacccgaataaaaacggccaaaattcgtgagatagataacgaatttgatgggggtttcttcgggattaggtggaggagatagagaggaatccgtttttgcaatcaattttggaagggaagcaacggatgcaccggatttgatggaggaggaggcgactgcacaggttggctcggctctgtctggagctggaagacgacactgtagcagtagggaggccaactagactttttgggctgggccggaagggagcaacaaaggacttccaatttaataaattaatcaatgagatgagctttgaattgttaaaaatacttccaatgctcaaataatttcaagaaaaatcctgaaaatacttggacactcaaagtatttaacaaaattaaaatcagatcattaaatgattaatttaatatttaaataattgctgaactgctctttgtatgattaaaattaatagttgagctccgaaaaatccgagaaaattccagagagtataattaaccatggagaatttaataaaaattaaatccaaccatgccttatattgaggaaattttatttcccacatttaacttcacttgtaaattaatgaacatttaatataaattctaataattatttattaaataatttataaatcctgaaacgaaaatcaagatgtgacaacacgtttccgtgcgtcgacatgccaccatgacataacaaaaagagtccgtgacaggacccttcacataaccccctctaactaattggaccacacctcaggtttcgccccgtccccagcaggcaacgggtagccccctcccccctcgtgccacggtgaattcggcagccgatcaaccgaaaaccccgaccgacccaactccatcacacccaccctagcctgggtacgtcggctagaggaaagctatactacaagcctagccgttgcccacgctggcttgtggtaagtacgataagttcttccagggtttcccgcgaaccggtctttaattgccatggcacgactagcaaaagtatgcacccacagcccaccatttagtgtattttaattaactagcaccattgcggtggcaccaatccaaagctatgctaataaccaatgtctaggctttaatgtgttttccccttttgtgtactagttgaactaagcagggctcagcaattctaatccaacatctaggcatgttacatcccaagttaacaaagcaaaatggcatacaaataataaggctgagaacagtaggtaaaaagcccataccgtgacattgtaaaacaatgcagtatttagagcaaagtagagcatttgcaatatgggagcaatatggtcaattaacaagaatgacttgccctactctcgcactgatgagatctctgcaacgacttcgacgcaccacagagtgacgaaacaaccgaaaactacgcgacaaacaaacacccaagcaaaacatgctataagtctactgaaacatgaagcaaaaccattttcaatggattctagggatttttataaatttactgagacttgaattgacttaaacggagctcggatgaattagttatgatttttagaagattatctctgtttttactataaaaaagaaaaagccttaattatttattgcgcaatatatcccaggtgatgacgtcatcaaggggggactggcatgcgggccccacatgtcagcggctcaagggacagtcggtccaccgtggaccaggaccatgtgggtggtccaccaccggtccacgggaccaacagcccggatcggccccaaggcctatcggacgactcggtttcaagacggccggccggctatggcgtgggcggcggcgcgcgcggcctccgatggcggcgaccagcagcggcagacggcgcataggacggcggcgtcggccgagggtgatggcaagcgtgcggaaagcggtggcgcatacgggagagagggaaggaggaaggagagggagttctcaccgtggggctggccggcgcgggaaggtgcgacggcgaatgacggtggcaagcggcggacggcgagacgagcaggtggacgacgtccgaagtgacctagggaagcaaatgagaggatttagagggagagaggaggtccacggtgagcggcaatgccagccaaagggggggaaatggaggggctcaccggcgtgcgaggaaggatgatttccgatgggatttcgacgatgggaggcggcggccgaggtagctctcacgacagcgatgtaggatcgtaaagggcctttcccacccccaaaagctagccattgaggtgaggggctccaccacttatatcttaggtcctttgcccttccacaaccaatgtgggactattcaacaatctcccacttcacatattggtgtccctcagcccttcaccgccccttcaccatttcaccatggtccctcaggtatatgggccccgcaagcacccacggtccatcaagccttcacgcactgtccatcgggccagagatgttaaactagccaggctctgataccaattttaggatcgtaaagggcctttcccaccccaaaagctagccattgaggtgaggggctcccccacttatatgttaggtcctttgcccttccacaaccaatggggactattcaacaggcgaagctaacggcggcggcggccctagcggcggctggagttgggcggtaggcggcggcgctaggggagatcggcgtgggagcggtgggggcacaggagagggcggtgaaaaaaaggaaaacagtggaggagagtacgggggagctttataggtgcttgggagagacggacgtggccggtgggcggccaattgcaccggtgacgtggggagggggagagagggggattcaaatcgaaactcgcccttgcgggcgcgggtgtatgggcggaaaccgggggcgtgggtggtgacatgggcacagagtgggcgcggccggcacgcgccggcgattgggatggcggttcccgctggttggaggaaggggaaggggctgcaggcgggccccatccgtcagcgcccgagagagaaagggggaggtagggttgacttcgggagggtgcaggaaagatgggccggcgacccatgaggtagggagagggagaaaaagaaagaaaaagaagggaaaaagaaaaaaaggggggattttccagggacttatattgcatataattgattttaattggttaaaaattatttaaaaggctctgaaaattccactaaaaatcatgttagcatattagagcatggctaaacttcagggcgtgacacttacttatactaaataattaaataacataacaaagtatcccgaatgctaacttaatagaagaagtttctccgaacccggagcagagtgtaccggcagctctagtactcctcccaaattcctcctagaaagctacactcgccgaggaagaagtcagagagagtgccaaacttccgggcactcctccagagcttctcctcactctctacctattttctaatgtacaaaagatacaatagagcctcttataattcagctcaaagttgtgtgtttcgaagtgtgatggagtcctccttttatagctaccatatgacggttatggccatggtaaatgtcctaactacccttcaaccgtcatcaggaagtaatcaggagagtacacgtggagccctccgagaacgtgcaaacccttcgtggaggaactcgaggtgcagctgtgggcggtgatctcggatacaggccagcacatgccctccgacatatcggctcgaccgacgacactcctgtttcaaggcctcgtcgatacgcttcccgatgccttcaagcagagtgcaggccccgttcaaccacgagatatacccagccgctgactcctcgagattcccgcggggtacttggagctctctacagactccagccatcgctgtataacaactcctgaggtacgagttgaaccacacctcgcgacctcggagtgcttccacggcttggtccttcttcacttccaccatagtcctctcgagttcggccacctcgaacttcgtcctccaatattggattcgacgatctcggtcggccaacgtactctcgaggtctgctcaatacggaaatgactaagtcaggtcgttctcctctttcgagaacacagcaaattaagtcgatccgaacaaaagaataaaggagatgaaaaccaaagtaccaacctaaggaagtcgtcgccacgtccgccttcacagacaggctttgatcgacatcgtcccgcggcacgtacggctcaagcgcaagtgccggaacgactaccggcgactcaggctgcccacgctgctggacatcctcgatatcaacatctctacaatgacagcaaagtactcggaatcaacatgctaaagaaaacgaaggaaacaactgcatacacaaaggcagtttgaaccgacgaaagttttacaagcataattgattaaggagtacaagggaaatacaaccctactcttcaaaaagggggagaatggactcccccaagtcaccgacttctttcatcacgcccttgcgcgcgtcattggcggccccctgatccagaatcctctagaggtcgagttcagggtatgccagcttcacgcaagcgaggacgtggcacgccccggtgtaaatcctatttgacgtctccttgccgatcctggccgcatgcttggaggggatctcctccatcgccgcagcgagctccgcgagcgaggacgtcagcgagaactcgttgggggttgccgggatggtggtcgtgacgccgcactccccggcgagttggtgtaggccggtgtaagacacccgcagcaagccacggatctctgacaggttgttctcgagctccgacatccggtgttcgagcccctgccgctgcctttcgttgccggccaccaactccctcatcttgaggaggtcctcgcgggtctccgacagatcgcgcgccagttgctggcgcgttgggttgccgacaacgtcaccgccctggctttctcgatctcgtagcccacgccgcgagcaccagcctagaggatgcgctccatctcagcttggagctccccctaggtgagggcatcaatgggcgggccccgagcgggcacaagaccgccagcgggtccactcggcgtcgcctcccggtccctagttgtgaccacgacatccgtcgaggccgccacaggagacacgctggaggtcgcaccggacccgtcttgcgccgccttcacccacgccgccctgcgaaggatttctgcaatttcatgaagacaggcaagcaagagtttgcgaataggatgacttctaaaacgtctacctacttctcgccaagcgtcaccagcctttgccttcgcagaggcgggggagacgcatccgaggcctgaacaagatagcacgatatgaggtcaaagtattctgactacatgattaagaaacaagagaggcttaccgacggagtaggcactttccaacagtttccaagtacagaggagaacttcctccctttcttcggaacgttgttgccattcatcgtggcagcagcaacagcaatatcggacgcctccttggcaacgccctcctttaacgacgcctccgccttgtgatccgcgagcggcccgatgacgtctatcaaagggagagcttgcgtacatgaaggcacaatgcgatccaaggaaagaagaagtaaaggagccatcgagtacactcatgttgattgcagcttcgcactcggtcgtccccttcttgcaaaggggaacggggacgttgctcaccgtcgtagggccgctgactgacgcggcgctccacggttttgctgttcaaacctgtaggatcgagaaccagaactcgataagtcagcaggaacatgcacataaaaaatgaaatctgaaatacaagaaaaataccccgagaagaaacccgggtcgcgtcctccggcccagaatagtcaaaggctgggtgggctcgagcctggagcggctggatctgcctaccgatgaagttgacagcaacttcataccccgacaactctcgtactcggaggtcatcgatgatatcgatgaaagacttaagggagggagttagggcgggtttggcggtccattccggaatcttgtctggttgttcctcatggacaacaaagactggatccgaattttctatctgaagatagaaccacatcgctcgccattttctacgagaagaagggcactggaaggggatgtatcacgacttcaggccatcctgaagttagaaaccgacacatccagatacctttttaggttccatccagcgcaactcatagtagaagtaaaagagatcaagaaatggctctaccccaatgtagggcccacaaagataggaaaaaatgctaagaaatgcgatagaattggggttcagatgaagcaaggaaaggccgtagaaattcaagacaagaagaagaaactcagaaggcggaggaagaaaaccgcaaagaatgtaatcctcaaccgcaaccatgtggcctaggacaggtttggggtcagtacctcctgtttccctctgcatggtcccacgaccagggagggcaccgtcgtcctgcagcttcttcagggacgcattggtggatgtggatttgtcgaggtccatcactgccggaagatcgccggagaacaggacaagatgggaaagctagggcttttctacggaagcggagaagacgaggggcgtttgaaggccggaaagttttgcagcaaacggacttcaaaatggatccccaaaactcccgtaaataagcgcactaccgatggtgcgaattccaaggaaaggagagagatggccgccagaagtttctgggtccgttacccgcagcagtttttggacttcaatttaaattcactcatgaccgttgaacttcatgcaatgttatcgataactctacgtctctacggttctcataccaagatcgaccagttgagagcgataatgattccgagatcagaagtcgcgatcggtcacatgagttcatttaagcagaagtcgggggctactttcagggttacagaggtataccctctacccttggatgtatgttgtatattgatacggtatacctgcgcgtatacggatgttgcgtacacgttaaggaaatccatcacgtaacagaaacagagtccacggatggaaggagtcctactcggacagaactgggtcgttactgtatcgcgtggggtccgatatctccaagttctacttggagatcaactgacccgcggtataaaagggaccccccgggagggcctaaggcatcgaatctcaccgccaatacaaccaccacagcctacgaaatcgaagccaacaggagccaagttgccgggtgatctagtcgaaccaactcgactacggtctcgtcggtatcatcgagttctgctattccctttgtaatctgtggtttctaccatataatcccataccaactggattagggctattacctatcaaggggcctgaaccagtataatccttatcttctatttgcttgatgtcgtattacgtagatcctcataccagcgtaccccaataccctctatatccggtctatgggtatcccccgtcgacagcagcgacggaagattgcctcgggttgacagcgacacgtagccctagtgatttgcagtggcggcgaaggggtgaacgggcttcggcttggtgctgcgatgccggcagagactgcagcgaggtccggcgaccacggggtcgacaaggaggtgcggctggagatggtggcggctgtggagagagagggggagctcgcggggaggcggctagggttagggaaaacttcgggaaaaaggggaaaacggaagaggatgccgaggggctgctatttatagctggaagagggagagatcggctcggaaacggatggaatcggcgacggattagtttgggttcgacgaaaaaacggagctcgaaagcgcgtcgaatccacgcaatttacaacgggattcaagggggtttcttgtgataagatagaggagatcgaggggaatatgttcccgcaactaattttggaacgggagcaatgcagcggcggattcggtgcgggagcggcgctgcacacgcacggctcgggatggaggcggccggaggaagatggcggcactgtagccgagtgggccccatgcgtcagtgagaaagaaagaggagggagctaaagtagacttcggtcgagaggggagagaaaggagtgggtcggattcagcccaagacaagagagggaatttaattaactttttaatttaaataattactgaaatgatgtttcatttattaaaaatacttccattgctcaaataaatccaagaaaaatcctgaaaatacttgggcacacaaagtatttaataaaattttatctagctcaagtttatgttcaaatttttcatagattttattcacacacttactttaatcattaaataatttctaaaaattcctttttcacaacgatttataatttagcgattttcagggtgtgacaccctcccccgccccaccccctccctcccggaactttttttcttgcgtaacaggcgtagtaaaagttttactcattgagaaatcatcttcaaatatatctgtggagccaattgcacacctccaggcctccaccaccataaccaaccacccaccccctattttcaccgatttttttggatccgagggaagcagcttgagtagataatatcttgtgtgcattattcacacaacatcttaactcgtgcgcgttgttttaaatcatttgttgaaagttttctatttttcgagtcgaaagtattttagatttggacttgacaattttaaaatctatgccggaagtttcaaaaaaaatcttgattcaaaagtttttaatttgtttacatttgaaagttttcaaaactgagttcaaattcttgaaaaaaaaaatcttgagttgcaagtttcacatatagactttgatagttttcaaatccaacttgaaagtttttacattcgagttgaaagttttaaaatatcaattgaaattttcaaaaaatctttcaatgaaagttttcaaatttgagttcatagtttcaaatcattagtttaaagttttctattttccaagttgaaagtatttagatttggacttgacaatattaaaatctcagtcaaagtttcaaaaaatcttgagttgaaagtttcaaacattcactttgaaagatttcaaacccatgtagaaaaattttaaattttgactttcgaaagttttcaaatctcatttcaaatttttcaaaaaaaaatcttaagtttcaagtttcacatattaactttgaaagtattcaaatatcagttgaaattttcaaaaaaatcttcagatgaaagatttttgagttcatagtttcaaatcattagttgaaagttttatattttccgagttgaaagtattttagatttgggcttgacaattttcacatatatgttgaaacttcaaaaaatcttgagttgaaagtttcaaacattaaatttgaaagatttcaatcccaagttgaaagttttcaaatctaagttcaaatttttgaaataaataatcttgagttgcaaatttcacatattgacttttgaaagttttcaaatccgagatgaaagttttctaatttgagttaacagtttttaaatatcagttgaaattttcaaaaaatgttccgatgaaaagttttcacattttagtttattgtttcaaatcattagttgaaagttttctattcacaagttgaaagtgttttagaattggacttgacaattttcaaatctcagttgaaagtttcaaaaaatcttcagttgaaagtttcaaatattcactttgaaagttttcaaacccgagttgaaagttttcaaattttgacttttgaaacttttcaaatttaacttcaaacttttcaaaaaaagaatcttgagtttcaagtttcacatattaactttaaaagttttcaaatacgagttgaaagttttcaaaatcaatttgtatgttttgaaattttcaaaaaaatatttctatgaaagttttcaaattggaattcatagtttcaaatcgttagttgaaagttttatattttacaagttgaaagtatttagatttggacttgacaatattaaaatctcagtcgaaagttccaaaaaatcttgagttgaaagtttctaacattcactttgaaagatttcaaacacgagttgaaagtttttaaattttgacttttgaaagatttcaaatatcaggtgaaattttcataaaatcttcagatgaaacttttcaaatttgagttctattgatgcgaaaaacacactagcctggaagatctgcttaacttcagtgcgggtccaaaatcttacttttaggttcgtgagcctgccagttgatttgatcctgcaatcaacaagaaacaaagatgagaaaaaccgcagttaaatccataaacgatagccgatcggccagtcgttgatgacatatcatttattttcgagccgatgtcatatgtgaatcgatcggcagttataaataagcaagataagactaaatctactcgatcagctatagatattaacgatatataatctttctgtcgatatatatttaaatcaagtgattgggatagatcggtcgccatgccgagacaatataaatcacttagatcaaagtatatattaacatgaagattataaacgcatatagcatagccgatcaaatagatctagcatgtatcggctaatactccgataccactctatattaagatattaaaacagatagaatatatcaaacagaagcctaatatactttattgcgataagatcttaatataaagggcagatctagcatatcaattaagcatataagatataaagctaaatcaggtaagatcggctgaaaccccgatactatctctctcgatgatcataaaacaagccagatatcataattatagatattacttaatagatcgaactcaaccgatgcagcattaagcataaagacaagtataagatctaggcaagatgatgaaaacctataagagatggtagatacacgatacaatctaaattaataacaaaacataactctatcggtcacttcctaacaataagaatcagccgataacaagttatatagcgcaactaacagagattgcaacatgcatatgataactcgacgaattacataaacagtattaaagtgtcataaagatggaagcattaatcccgagaacgcaagccgccataacaagttttacctctagttgaagatcgaatcgatgcagctcaacccgaaagcaagaactcgtcgaaacaaaatgaaagtaaaagggtggcgatgcgccgagattgtattaaactgttgttaattgattacatgggttcgggctctatttatacccgagatacaagatacgtccttgccggacacgacacttatctctaacaaactctacgataccataagtcttcgtggcagacttttgcccaaacatatctctaaggaatttacatgaaatatcctaattaataaatacaattgcctatctgagagctttatctccatcgtggcaatccccgtgaagcactttgatcaatccctgaaacagccctgaaaccatcttcatcgcaatcggctgcaccacctctatcagctgtgtcagctgtcctctgtccgatccttctcagcctatgcagactccagccgatgccttcgcagccgatgcatactctgttcttgtaacatcctgaaaattcctgacaataaaaatcactaaaatttcgaacttttaaaaacttttgcatcatgctggtgttattcgtttctctgttgcaaaatgtattgtttaaattaaataatgtgagaagacaaatatattggtatgacaagacaaatactaaaaccttaaatatggggaaaatagaaacatatgttggaattagaaaaaataattattaatatatggtgcaataaatcacaagattggaagtgttgaaatataggtaagtatctaaaagaaataaggagattaaaacatctaaaacttattcacacaaaaagtctaggaaaagccctaattgtgatttttcccgggttgctactgttcattacgcgctaggtgttcgatctgtgcctaacccgaccgaacacccgacgccgccctctccaatcactgccgtgccgcgcggctgcctttccgactcgtgcgccgcactggtcgtgcccgtgcgccgcaccgcgtcacgccacgccgcgtgggcccgccgccgaccgaggcgccgaagacccgcgccaaagctgcgccgccacgagagcccgcgtcatcccgtcccctcgcgcgtcgccttcgggattgagggataacggtcgccacgacgaccgcgcgtcaccctagggcatagccctgcgcctcccctatcaaggccgctaccactgcacatcaccgccaatcgagtcaccatcgtgtcgccatgccgtcgcacataaccgagaccgctggatattagggtgttccctccccagctaatgaaccctctcctggaaccctatcatctaggcaatcatgccgcgccagtgcatggaaccaaacctgggagcgatcgaaacaatgccgtgtcatcggttattcttatccattaaggaatccctctccctctcgcttttataagcttatgtctggctcgttctcatccaaacccaacctcccatttgctcttcctctccctaaaatttttgctccaccgaagaggaacaagatcgcgccgcccgccgggtgtcgaacacctggtgagcgagggctgcgccgccgccacagggcttctcagccggtgtgggtggcggggtgtggagaggagttgctcgcgttgctgtagctgctgttggagggagccgggagccgctgaacgagggagaccaggcgtcgaacacctgcgactgtcgtcgacagctagccgcccctgtttcgtccgcaccgcgccgcgcccgccgaaatccgccgtctcgccttcccgtggtaagccctcgcgcctagagcaactcccagaaacttagtaacttgcggccccgtcgatttggggtgcgcgccgccgtagccatgcctaccccggccaccacggcgccatggttgagctcgccgtggcgggacctcgttccaatgtagaatcggctagatttttgcttttctatactccatgtgaaccctagatggttaaatcgaagtcttctgtgcttgaatcgacacccattgcgctgccgccgttctcgcgatctcggtgccgccacgcgccgtcgcgccgcgcgtcgggtggccgccgtgcctcgccgccgccgccgatgggtttccagtgatgcgccgctacctttctccaccgcgcgccgagccgtcccggctcgagccgtcggaccgctgcgtgccattcctctgttcggccgcagcgagaggtagaagacgacgggaaaaagaaaggaaggagagagagagagaaaccgtgcgggacccacatgtaattagcgcacagtaatcctccacctaatgatgattagcccactcaatggcatgtggggtccctgttattaaaatctaagagaacttaattatagactttgtgtccatgacaagcgggacccactggttattaaacaagccagtttgaccctagtcaaccagggctggtcccacatgtcagtcacggtggttatggataatgttggattaaaaataaacagtatgcgcacagtaactttttacaatttctcggattaattcaaatttgaatctttaaactacataacttattcattttagctccgatttgagtgaaacttgaatctaaattcataatctttccaatggtatataactcactaattaataaaatatatttataattattagataattaatatcatatgattaggttatggtcaacttaaaaatgtgttaataaatacaattgatattttacagtagagtagatgtcaaataattatatttaacatgttttgtcactgtaacaaccacataaattaattataaatattgtttcaaattaattgaagcatagaaagtaccattgctatttattaatcactgaccatatatgtagatgaatccatgatttataaattatttacataaagtttagcctcatattttgtaactaaaatatgaatactcatagatgaatctttaacttgtttatgagaaataataacagagctagttgtagttggaccgtgacttaggattatttattgtaaaattatgcattgagataaactttaactataatattatggaccacactaatcaaacctacagagtatggtaattcattggaacccttatatagtaatatttgtagagccatgcctaggcaatccattccgttagaactactgctatgattaaattatccactgagccttggtaaacctcctacagggtgtcaccatttaatctacgatcaaagctagtttagccatgaactccccatagccatagttgatagatatttgagccgtagacccgtagtcctgagtattgagttctgtatgtgggcagcccttagtttagacttcgtagcaccttacaatccattagcaaacatgagtggtatgaatagccctaggtatatccccaacaattatattttgcttgtgcatatttgcttgttgttgaatattggtttcctcgcgtattatagaaattgtatatcggttagtcgcgaggcaacgtatgcagcttccaggaggtgaaggttgatcaagattatatcaagaataagaactatcctgagcaggcaagtcatcaccccatcccttg

SEQ ID NO: 22506 - DNA, 8833 bp, Oryza sativa
  unsure (1)..(8833): unsure at all n locations
gcttgggcaactaccttggggaaggtagttgagatacagcatgtggagacatgagcgccacattgccatgacattgatgagatgatttgtgaaagaaagttaaaactaaacaaatgttttcgactggggcggctggaggacttgggtggtgtccggtaaaggctagtgccgtccctagtcagttaaggaccgagccatgaagttaagcatgaaacaacccccgtacaaccatacttctcgtgtgggtatagacctagcggagtaaatagccgagcggatacccaggccgtagtggttttcttgttgtgtgtgaggcagggcctacggtagggcagccattggtaggaccgcgtggggcgggtgcctacagtggtgtcgccatcggtaggactaccatgtgtaaacctaaacttaactataacttaatgaatgtgtgagtctttccccctcgggagcgccagaactcctctcactgctaaaaaccttggacgcctagagtgcatgaggactaaagttcatggagcaggtactgccaatgtgaggttattgaaaggctttgccgtggcaagtctcattcattgagacgtaggctcatgtattgggcaagtcgcggagtacgggtaaagtgcacatccactgcagtgtgagtaaaccaaatctattcgaatagccgagctcgcggttattgagcaccgggacatgtattacacttggctagactctaatttcttaaactgattgggtgggatgctgcacgatgattttgttctggtggaacaacttctcgagaggcgagaaggggtagaccccagaaaaccatgacgaccagtggcgggaagctatccttgggaacacaatggatggtggacagaactgtcgctgtttaatgaacaacggaattaaaacttgatcagtttatgctaggtcttaggtttgtgaaatgatatttgaaaactcagctttacgcaaagtaaccatagccactccttgtattatcctgtacattactgcattttgtgtggtggcttgctgagtacttttgtactcattggtgctctatatatatcttgtagcagagtgttgaagagaagcccttggattgcggttccattctaggtctcgttcccagtcgactgcttgtggcatgtcaaccgggcccttatattattttggcttctgttggtgttctctgatagttggtggcctgcctagccctaatgtaagcatttaactctcttagtctgaattcattcgtgatatgttgtgattcggctatgtatgtgtgaaccaactactgatccagggattggtactgataaacacggaagatttctgatttacataatcggaggtcgacagttctttgaatcgatctctttattgaatccgcctcgatccaaatgtcgaacctggttcacaatttacaaaatttagtcgtcaacacaagccccccaagtccactatatttgtaatgtggcggatttgctcaatttccttttccgagccgatctagggtttcctttaccgactctgntttggccggtaccgcgttctcttttaaatagtaaccaccgctttgcacttttcacggcgtcagcttccattttaaccgctctaacaacaaactttccccaatccttctcctcgagccctctagcgacgatttcgagctttccgacgatctagagacgatcctcgcaggtatcaacttccgctagcgacaatgtcgtcttccgccagacctccgagcgcatcaaccgtggaatacgtcgaggtaagttcccatcggctaaaactcccttttttctgcatccgactggttcttcttcctttatcaatcctcgatttctcctcttccgcagcatctcgctcatctgattgctgtcccaagcattgccgataacctccagctcttccttggcccaatcggcaacctagatcccactgagttcataaatggtgaaaccaaccgaatccccttcagattcaccaacccaaatctcagtacttggaagggtaccttcaaatcctggccatcagccaaaaccaccaggcctgcttggtacaagaggatgtcggtcagcaaatcggatcactgggatgagatcggcatatcccaagctctggcattaactgcagcaaacatggcaaggaatgaacccatgatggcaacagctacctatttctggtgcacagccatgaatgccttcctgttctcacaaggaccgatgaccccaattttactagatatcaccatgattactggcttagatatcacctcatcgactaacctatccagccttaacacccaactcactcacgagtttaaaactagaagcataggcggttggggtggttatattgctaagtatatgggaactgggtcggttactccaagggaagaaacagcttttatcatgatgtggctagaaaagttcttgttctgtggcccaagatgttgtccaactgcaaactggcaaaggatagctgaaaacctggtggaaaagaaacattttccccttggcaaatatttgttaggctacttgtatcagactctcaatactgcaatcgacaagatggcctctggaaaaataatcggcataggaggtccatggtagttgctccaaatttggctgaatctgcacaccagaaaagttgccaatcggccagaactaaccgatgtggaatttccaagattcgagccgatcatcaagaacgatggagaaaaaagcacgacctgcatgataaatacagggcaagaatatcatatccagatgacatatgaattttatcatccgacaagtgttgcaaggcaatttggcatgggtcagctgtcacatcctgattttcgctttaggattcataaattatttaataaattatttttagaatttatattaaatattcattaatttacaagtgaagttaaatgtgagaaatcaaattttctaaatataaagtatggctggatttaatttttattaaattcgccatagttaattatactctctggaattttctttgatttttcggagctcaatttgtaattttaataatacaaacaacatttcagtaattattcacatattaaattaatcattaaatggtctgcttataatttttttaaatacttatagtgttcaagtactttcatgatttttcttgaaattatttgagtaatagaagtatttttaacaattcaaggaccatttcagagattaatttaattggaaaagtaattaaatcctcttttccttttcgggccgaaacaggaaaagtcctctctctttctcggcccaatctctctctcggcctgcagcccctctccctctctctgtcgaagtctgctttgtgtccctctttcaatcaggccttggaagaagaagcctagccgaaagtctgtttctcctccctgtcgctacagtggcatcttcaacctccagccagccgtccagagcccctgttcttcccgatccggcgccgttttctcctccaaatccggcctcttctttcgatactttgcaaaaaaaaatttttttgaaacgtaattaattgatactttgcaaaattaattgaggggatttgtttcccttatcctcctctatctcttcccccaaaaatctagttttatccctttgaattcgacgcgaatttggattcgttttcgagtttatctctccaccaaaccctaggttttcccggcgcgattccttgcgttccaagcccgatctctctctcccgtggctataaatagagtcccctccctctcctctttcgtttccaacccctaactcgagctcccgtgccctagccgtctctccccacgctcgccttctctctccaactccggccgccatcttcagccgccttttcccgtcgcgccggctgttctcgatcagtgacgccacttccctccgctccgcaaggttgatctctaccacggccgccagttcttttgcgccaaatcccgccggaaggttgccgtcaccgtgaacctgtgggttgttgccttggttcgatatccagccgtgccgttcgtcgtcgtccgtcgtcgccttcggtcgccgtagccttcatcggattcgcagctgtaaggagaacatcgtccaccacctcttcttcgccaaagatcgccagaaagccgttgccgtcgttgatcagtaccccgtcgccactcctgatctcgtcgctggccatctccttcgttgttcatcgctgcgtaagtgttggtaaggatcgtcgcgtcctcctcttcctccccgtgctaccggtttctgctgtcgtgctgccattcaccagtgtaggtttttccctagggtcttaatccaatctaacctaatccgttgtttgtctagcgtcatcgccgtctccgtgtattgccgccggatcatcgtcgtcgtctctccctctccgatcactttggttcggtgaggcttctatctgtgttccctcggtttaggttttaatctctcgtttgtgtcattgagtagcccccgtcgtgccacgcttagctgctgccctagtgtcaccgctgcgctagccgcctagccgtcgttgtgccgctccatgctacagccgtgctgctgctgctcgtgagtgccaagtcattgccgtcccgctaccgcagccaccatttgccgtcgctgctgtgccgtgtcgcattcgtgtaatcctaggttcctaccggtctattgtttgccgtaccggggctttactgtgaatcgtgtcgagctcaacggtttagccgcagccgttgttgagtcgttcactcgttcgttcgaaagaggtgtcccctgtgcttcattcgttcgtccgtgttgagtcatcctttagtttagagccgttcagagccgccggcgttgatcctgcgtggttgccatgtcatcgccttgtcagctgccgtccctgccatctaagtgtcacgccgtctctcagaacccacatggcagccatctaaaaccttagatcagatcaatccgagccatccaattttggtctcagccgtccaaaatcaatataaatcctgttattccttttcaatagcatattagttctttttactatatgttgtatactaaattcattccaataattttccagaggatgctttagtcttatatctcagatataaattatttgtaaattgtttaattaatttggaatagtcttttctttaataggtttaattggaattaatcttgtaaaattcataactaattcatatgaagtcagaatgaggccgttcaagtctcataattcatctaaaatcatgatctatatgtttgtttacttttatgtactgtttatttggtttttattagtctttttcttcgttttgcgtgttagcttgtcgtttccgttgttgcaaaggttcgtgagtgcattggaagtgattcagaagaataattgaagactgattattgcaaggcaagtcatacagatcccaaacacaatcctttcagcatgttgatcctatatttaaattctctatttatttcaactgtgcatttatattcgaatgtcaccgggtggtgtgaacctattcctttgttatggccaatttgcattgattaccttattccttgataccttgggtaataaattgattagcttgaaccttatatattggtttggttcagctaaacgctttatatatataattgcttagccatgcttagaaacattagcacatgattgggataactaatgttacactatcacttatgattatatttaatggtagctcacgatggtcagttgtgattggttaattaattattttgcaattaaaacttgtcaatggtgggttgtgagcacatggttttgaaggtcgtgctcacgacaattaaggaccggttcgtgagctactgttgtgagacattaaccgtgccaaccacaagctagcgtgcgcaacggctttaccttttgtatagcatggttcattacggggtgccagactgagaagcggcgagaagtccgtgggggtcgctggggagtccatgcctctggttatatttatagagggggtgattatgatccatgaatggtgcactgtaaagagttgtgttgtgcagagggtattgtcacagcctctattcgggtactttccagtatcgcgacgcatggtagacatgatgttaaggctgtgtcttgtgggtacagtggtatacctctggccagagtaaaactattcgaatagccgtacccgcggttatgggcgggttgagcaatgtttttcgtgattagtctcacacctctcacaataattattgatgctataactggtaataatttgcttagctcctggtttggagttagatctgtacagccgggtatggttgttcaggatggttgggcctgtgcagcatgggtgtgctgtgcagtgttgattaaaattgatgattaattactctactgttttactactcttaaatgtttgctaaatgctgcttttgcaaatgagcctatattatgccatcctttggtatccttgtgcacttgcatatttgttgtgtggcttgcggagtattccatgtactcaccttgcaataatcaatcaacctcagttgaagaaaaaggatccagaaggaaaagaaatttggcttataccccagttgagctgcctgtgggagtggagctgaagtcatcgctagaccgttaattccgctgttgtttttcttttcttttgtaagtatgtaacgatgttattatgatggatttgtatattaaattgttagtttgtgtacctcagctgattcctggacgagggttttatgcacaaataagtccagaaattactagtgaatttccgggcgtgacatcagctgccaatcagcctattcttttgcgacaagatccaaagcagaggagagattacatcattccttatgatggataggctactgaacctagaaggaccacctttaggcagtattgagaacatcaagctaaagatattcaggagtgcagccttcgaccgatggtggatagagtggaaaaaacatatgttccatcaatcgccatccatgtatcttacaaaccttttccctgacgatgtcccttaggtaaaaatcatctccttcaattaattttcatcaaccaccagccgatgcattatcttatatgatttttgtttcttgcagacaacagaaacttctcctcctcaccaaagcataagtggtgttgaaatcgaatatgctccaggactcctccccaatggtggtggactaacacctccagtcatcggctataatgcccccaagacctccacactgctacatggtctatctcgtaatattcccaagcaaagcaatctctatactccttcgaaagctctattaacttggttctaaactctgccgataattttttattgataaatgtctgccttggcctatctcctgggcctatgtcaatctcttctaattcattagccgacatgaccatgtccttggtgtagaaattcgaaccctccacgacgctctcaaaataataatttggggtctccatcttcacttggctgtatatcacaattggacacttttagaaaatctccatcccaaacttttccagacagtcaatcaatcccatccatctcccaaagagctaaatcggcactagcaactttaactgacctgtcggctggcacgatctcaatcttgttaccttgccattgaatcaagtactggtgcatggtcgaaggaatacaacaattagcatgaatccaatcctatcggagatatgggcccgggggtatgcgaaatgagggaaatctaccttcccatcttaccacgtgtccctacagcctggccctacccccgcattccgcgagtcgcaggagcggccgggagggggggcctcggggtgccacgtcatgcccctcgggcccttgcaccgctttgccccgaggccctcgcccagccgccatttggcggggggagcaagcaaggagggggcccaggctaaacctcctttaatgcacgcagcgccccaactgccccctgccgcatttaatgcagtggggcagacgtgcggcgtgctcgactggcgcgcgatagtcaagaatgaccggtctgtgactggcctgacgccggtcacgtctgactggacggacaaccgtgctcccacgtcgcatctgcctccggcggagtggaggtaggaatgacccgtcccatcggagggtcattcggagggcggtcacgacaagtcttcacccattaatgagggaatgacagggttgtcccccgtgtcaggcgagggacggcgctgggccccgctcaaggacaagctgtggtttagcttccaggcaaaggcacgggtagagttccggtcaaggtagggtgggtccccacctgagagaagagtaggtagaggcggtgcatgtggtatccccttgaggtataaaagaaggaccttgcccaccaggaaaggggatgactctgagaaaacctaagctcggggaggagggaactaagattgttctccggagtttaggaacccttgtaactctcagtctaaatcccataaacaggagtaggatattacgcttcatagtggcccgaacctatataatttggttgtgtgcgagctagctaggagccttgggaacagatacgtgatttccagaggcgagctttttcccccggccgaactcacgaaaggggggtctcatgatctcctgctagagaggatcactccttgacaaatcccttccaagcaacaggctataggaacccttcccatcgatgacaaaaaatgttgtagggacagtcttgctgccgactgtcagctccacatttaaaactcccttgatctccgatggattgcggccaaa

SEQ ID NO: 22507 - DNA, 822 bp, Oryza sativa
gaaatcctctctgccttctgcccacattagctttgtgtcttggattgaaccgaagaaagagataatcacacacgttcccttggattcgatacccttggaatactctgtaaggaaagtgctacatcggtatatctgtgcgcttgtggattctatctgtgatcgtaagaaataccaacaagcatttctggtgccgttgctagggaacggttgctgtttatttccgaaccttgttcatccttatcctttttacctttttattcaacctctacccctgctatcccatagaagtattcctgttcaatccttctcgaccatggagcaacctctcttcgagttgtgcgctcctcgggacgaattttacgagccacctccttcatcggagccaattttaacacctagctatgaaattcgtatcgaattcatcagtatggttagggagaaatctttctctggtttaggccaggaaaaccccttccaccatcttcaggaattcgaaaagctttgctcgtgccttaagattcgagacatgaagcaagaaactgttcgttggaaattgtttccgttctctcttcatgagagagcgaaacaatggtatacatctaccgttgggtgtgtaaacggtgactaggagaaattgtgagacatgttctgcctcacattcttccctataacccgtattactactcttcatgtagaaattctgagtttccagcagataaataaagaatcgattggtgcagcctggttcagattcactaatttagttcagtctggtccaaccctgtctatacccaattacgtgctattacagcattttcatgc

SEQ ID NO: 22508 - DNA, 8542 bp, Oryza sativa
gtaagagaagctttggagaagaagtcctaggtggagtcctggcttatatcccagttgagcgcctgtgaagatggaaccataggcccgctagtccctgctagtccgctgctgtttattttttattgtcaggtctgaagtgcctttgtaataatgtaaatattatcgatataataaagatgtgtcttttatatcatgtttgtgtgctgtaccccggcttttcctgggacggggattaatacactagcgttctggaaaaggtatttttccaggcgcgacaagctggtatcagagccatctcgactgtaggttaagccaagtggataaaacctaaggacatattttatacatgaaactatttgtgaaagttccttttttctccattccctaatgctatttgcaaaaggtttactcccttcttccttcttcgaatttcaactagtactagatggtcatctttgcgaagaagaagatgccgtcaattgtctgccaaagctccggaagactgttgggtccgctagcgaagcaaaggaagctgtgaagccagctgtgaagcaggagtgaagatcttggagaacccgtcacagaacctaagccaccctctagggtagagtcatagtcgtgtgcttccttgcttgtgtgcgtagcgcgtggtttgcatcagtggggtgtgatgtaaccatgctaggttgtttgcttaatcaacttgtagaataaacctaacatacatcataacagaaaaagattagatctgttaaggtgctatccttagtttctgatctgtccctccccttttgttttccctctctccctctccaaacctggtaacagatggctgacaatgaaaaaggcagtaaggtcagaaatcaggacaagggtgcctcatgctcccaagtgaataaagcaccagacaccagttgtgtggtagtggtccaacacctaattaaccagaacaaattgctcatagatctattacaacatcatcagacgccaattctgaacccgagtcagatgcaacctcaagtgcaatttgaggcagatcaagcacccacatcgccagacaacgtgccactagcatcccaacaggcccattgtgccatgccacatgtggactcaaaagaagctataatcatttgtcttatctacgatgaacaagggcactatgcaaggaactgtcctcagcagaaaagaaaagcaccaatgcgaaccgatgatgaagtccgtaagatgaccattaccggcacagaatggcctccaccaggaatgacaaaacgtcagataggaaatttctttcgtggtgcaccacagttgacccaacattttttagctaatggaggtagagtgtctgatagtgaagattcagatcaagtctcctcaggggatgaagatgagaagtctccctaaggtttcaagcagaataaaatggaacataaggcatgctctcgttgtggagaaatcggtcatgttgctagctcatgtgtcactacctgccttcattgtgagaaagaccatccacccggcgagtgtccaatgagcaggatcacttgtttcttgtgtgaaggaactgatcatgtaccaaaagattgtcaattcagttttctgctgacgaagaagatggccaaccaccccgccagttccaacaaagagaagcatcaagaccacgtaaatcctcgacaagaatacagttttcagcctaactccagagtaggacagaggaatcaaaatgggaaaagcaaatcccgagttcggcaagatatcagttgcttaaattgtcaagaaattgggtcatttcgccgccaggtgcccgaaactgagaaacatagctgccagcatgtcagtccatgcaactccccacaatcagaagcttgttccttagcgaattgtcatccatgcatcccgaagcagtcgtatagcctgagttgcaacaactgagtgcactaccacaaaggtgtcaatgcttaatttcagccccagccaccagttgacaagacagaggccaatatctgcgttgtacctttggatgttccagtacagcagccgagaaattaagtacttgatgaagaacttgggcgtaagaaagttattgtttgttacaactgcagtgaagaaagacattactccagaaattgtccacaaccaaagcgtaacccgcgccatcattccggtcgttatgcacgaagaagacatgaccacaatatcagggtcactggagcaaatgcagtacctgttaagcctagtgctagtcagtagcaaccataatactcttgtatcggtgttcaagaacttttgttttatagctattccccgtcaaccatgtaataagagagaaacatgaaataatgaatgagtttggcatgtttatgaaggatccatgttaagattgcaagtgctgtgagttatgtacgttttgttgatgattaaggagacctagggtctcatttccgtgagctcctactctattatgaatcaaataacctagttgtagatagaaaagaaaatcaagtgatcaaccaaagagatatttgtttggactaagagtttcatatgtgtctttttctgatcaaaggcaacgacagtcagtatagcttttgacgaactacttcaaggtttctccgaaaggcagcagggcccaaggacctcattgccccagaagcacccacaacacccggagcgaagagtacctggttgagaaaggtcaaaaggtgattgatggaagagatcggaaaatatgtttggttactgggaaaagaagtaggtcgaaaggtgattgataaaggataacgagaaacatgatttgtgtcactcgaggaagactcccgatagcaatcgaccctacaacagtcaccctgtcattaaggtagaagaatttgcgagtaagcaagatgaccacaggtagaagtacttctatgaggacaaggaagtcaagaagttaacctaaacagttggaatctaaagctcggttcaaccttcagctctatgtccgttagtcgagatgtcatggcactggattagtacgcgggtggtctcacccctatgtgtgtggcgcacccggtctaggtcctgttgctaggggctcaatcctggccctgcctgtccgggatactggccgtaggcagggttgggtcggtacttttgttcacggctaggatgggtgaagggttatgtcacatgtttacgacaggttccaaggccatggaatgcggagtaaagatgtgtctttgggtaaagatgcacacctctgatcagagtaaatctattcgaatagccgcgctctcggttatgggcaagcctagcaatgttcccaagttagtggtttaattcttaaaacttgcttaacaactaaaatgtggaatggttggcttgggttgacatgggacgagctgggacccaggtcgggttactagtttggtctgaatcatcgtaggcctttggttaaggcaggttcgtgtgggttcacagccttgattaataatattgtgtagctctaggatcgtgtttacaaaatagctttgagcaactaagtgtcttttaaatgctgtttactgcaaaacataacccctattattaccccttgtacccccttgcattaatcatgcatctcccggtgtggcttgctgagtacggtggttgtactcattcttgctctatctttcccccccttcagtaagagaagatttggagaagaagtcctaggtggagtcctggcttataccccagttgagcacttgtgaagatggaaccgtagaaccgctagtccactgctgtttattgttgattgtcaggcctgaagtgcctttgtaataatgtaaatattatcgatataataaagatgtgtcttttatatcatgtttgggtggtgtaccccggcttttcctgggatgaggattaatacactagcattctggaaaaggtatttttccgggcgcgacaagaggtgtacaaatttacccataagactcaactccacaatatgtcaccatattaccatgtgcccatgctgaacatgtcaccatttgtgtagttatgacaagacccctcgcatagctcaactcaaagcagcgcacctttcctggataataatcaccccctcaaaaaaaaccagaggcatggactccccagcgacccccacggacttttcgctgcttctcagtctggcgcaccacaacaagccttgctataccatgtgtccagccgttgcccattctggcttgttgttagtacggtaaatgtctcacaacagtagctcgtgaaccggtcattaattgacataagcacgaccttcaaaaccatgtgctcacaacccaccattatcaagttttagttggcaagtaattaattaatcaatcatgatttgatgcgcactagagttcccgatcttccaaaaggttctgataaacaacgatttgggtggagtcacgacacaaatagatccggcttcttgaacgcgcacactcttgagccccgcaatcgtagcaccacgtctcttctgattatcacccgtgtcaaaacacggatgacctcgccgagaaggctaatccctgtttgccaatcgaagaacacaaacaagaacgagatagaaaacaaccaaaattacagatgaatgattaagctcacgagttggggtcttacaaaccgatctagcggcgaaactgttctcgacagaataatctaagcaaaacgcaactctaaatgatgacagctactgaattaatatgattaggttcgtcctagagttgccctagggcccacaccccattgggctaagcctacgacacaattacaaggcccaaaactcaaatcagattcggactagatgaggtatgtggcttgttttgcagattcctggcagctcggtaggaattttgatgtgggaccaaaaccatcttaaaatagactccatgagctttccaacaagtacttatgggccccgaaattccttctagatcagcagctaggtccgtttgaaattgatgttgtcaggaggcccaaatccgaatccaaaacgtgtagaactttatctattgtcttctatggactaaaagtgacgtggtgagataaaagaagacttggagaaggtcttggtttggtccccaatcaacttctttaatcatccatgcattagttatgctcgatctcttttccttcgcccaagcaagtacctctacaaacgaaaacacacaaaactcattgtgtagcaacgtttgttcaaatatataacaagtaaatctaatgtagaacatatgcacctttatttgattaatacataaggtagtcatggttatatccgagctagttatgtcctcatcacgattgaccatcgagagctaccattaaatataatcatacgtggtagtgtaacattagttatcccaatcatgtgctaatgtttctaagcatggctaagcaattatgtctaacatctagctgaaccaatatataaatctcaactagtcaaattataataacccaaggtatcaaggaatagagtaatcaatgcaaagtggccataacaaaggaataagttcacaccactcgatgacattcgaaaataaatgcacagttgaaataaatagagaatttaaatataggaccaacatgttcaaaggattgtgtctgagatctatgtgacttgccttgcaataatcggtctttaattagtcttcagaaccacttccgacgcactcgcgaaccttcgcaacgacagaaacgacaagctatcacacaaaacggggaaaaagactaagaaactccaaataaacagtacataaaaagtaaacaaacatgtagatcatgattttagatgaatttataaactttaacggcctcatatgaattagttatgaattttacaagattaaactgattttagccttataaaaaaaggaattacgatttaaataaaggattaatgatgtcatgatgacatcaccactgagcatagcactggaccacaccaccgctggcgatctagggcacgtcggtgcaaaccgagggcatctacgtgaagaggatggcgagacgaactcaccgagggccggcgctacggaggacgacgacggaaaacggccggcggcaaggtcgaggtggtggtagtattcgggtcgatggtgtcggcggttctccagcgggtttcggcggcaacggaggggtggacggggttctcctcgcagctgcgaatccaaaggaggtggcggcgaccgaaggcgacgacgggaggtgcagcagggcctcgccggagatcaaaacgcgacggtgaacttcgggttgatggtgacgatggagctccggtggatttaggcttcggggaagtagaggctggtcttctccttcttgcgaacccaatggcagcagcggcgatggatggagcggctggagcggctggagcggctagcggcgacggagagagaaggcgctcgcgggagaggcggctagggcacgggagctcgtgctaggggttggaaagaaaagaggaggtcttggggttctatttatagccacgggagggagagatcgggcttggaacacaaggaattgcgccaggaaaacctagggtttgcaggagagataaactcgaaaacgaatccagattcgcatcgaattgaaagggataaagtcggatttttgggagaaaagatagaggaggataatgggaatattttccctcaactaattttcgcaatacaggagagaggaggccggatttggaggcgaaaaaccgggagggcctgatccgaaagaaaaaaatcgggagccatccgatgtgggagaaaaaaatcacaggtcccaaaactactacaggcatgcacagaaatattatttgtactcactgcatacacagaacatgcagccatgcatgtgtccactattttaaataaactttaaactactttttctctcaaattacttatctaattaacgatccgattgcaccactaaattcgttgcaattaaatctttaaaacaagaccacacatgaatataatcgatgaaatgcattcacagaacatgcagccatgcatgtgtcaagttttttaaataaactttaaactacattttctctcaaattacttatccaattcacgatccgattgcactactaaattcgttgcaattaaatctttaaaacaagaccacacatgaatataatccgatgaaaaaaaattttagcttattattgaattattacttttccaattaaattaatcactgaaatgatatttaaattgttaaaaatacttccaatgctctaataatttcaagaaaaatcatgaaattacatgaacactataagtatttaacaaaattataagcagaccatttaatgattaactaaatatgtgaataataactgaaatgttctttgtattatcaaaattagtaattgagctcagaaaaatccgagaaaattccagagagtataattaatcatggagaatttaataaaaattaaatccaaccatgccttatattgaggaaattttatttcccacatttaacttcacttgtaaattaatgaacatttaatataaattctaataattatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggtttctttgtctttgttcttgttgattgcaggatcaaatcaactggcacgcttgcatacccgaaggcgagttttggacctgcactggagttaagcagatctcccaggcctcgtgttttacgtcaacacgcttttggcatgcccggtgggactgattagaagtcagagttttcctcatggatgagaagccgccagcatcgttgtctcggctggtgaacccggctctgttaaagctaagatccagaagctaggtctatctgaagtcgaagaaggcaacatcgtgaatatcactccggacaagttgacacctgatcagcagaaggatcttgaagcaatgatgcaacaagcacgtaacctattcttga

SEQ ID NO: 22509 - DNA, 914 bp, Oryza sativa
tgtgtcttatgggtactgttgtgcacctctggccagagtaaaactattcgaatagccgtgcccgcagttatgggcgatcgaccagtttcaccgtgattagtcccactttattaataacctgacataatgaactggtgtagttaaggtggtttggttgggcctgttcaacatagtgtagcgttgttcagtggagatttaatcctgcctttcaacaataaaataatttaccaccgcctttatgcaaatagccacagacctctatttgttacccattgcacgcctgcatcattggtgtggcttgctgtgtacggtggttatactcagccctgctattatacccccttttcagatttgtagtgcttctgagttggtcctctcccttttcacttaaatggtccgcacgcgaaaatgagcatattttcgcgtacggacctattaagagagccgcacgcaaaaatacacaccctctcttttcctcctacccactttaaataattttgggaaaattggaaccatgccattataattttgcaaaattccgatattgacggcagggggcactgggcggtgactgatcaggctcttccgatgctttgagagcacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacga

SEQ ID NO: 22510 - DNA, 727 bp, Oryza sativa
  unsure (1)..(727): unsure at all n locations
tagcaaccagcgtatttataatagggatcaatgaaggtgaagatatccaggtgttagataaatacaatagttctcttgttaattaaatgtagaagctggtgatgggattacaatttcccgcagnatttgcggatttctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgactttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 22511 - DNA, 1143 bp, Oryza sativa
gccccccctcgagggttttttttttttttttttttttttttttttttttttttttttttaccagggattcattgggtatttaacaacataggcatgcaatctggcaaatttgaaaaacttttaacatacaccccaaatccctgcccaaatttaagaactaggggggacacagggcgtttttccatgtcgcattttctgtgatggggctaccatacgtgggagcaaaaaatggggagggtggagcgcatgccaaatgaggatctattagcaatgggacggggcctccactttagcatttccaccctgctcctttaagaggaccgcctttcattgcattcagctgtgatggtagcacgaacacaggtgcaccgaggacgaggagagcaggagccttgtgctctctctgcatttgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaacctcgtgccgaattcctgcagcccgggggatccactagttctagagcggccgccaccgcggtggagctccagcttttgttccctttagtgagg

SEQ ID NO: 22512 - DNA, 916 bp, Oryza sativa
agaattaaaacgctaacttgggtacattactcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagtcacaaactaagccttacccattagacatgtggaagtacggtagtgctttgcaacagaggcccgaagaccggtccttaaacggccgaggtgctaccatcaaaaccatgcaccccgagcccagcctaaaaccattttagggggttttgaatagagggggcggtgtgaagccaattccacaataatccaacaattccagagtgtccaagtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatg

SEQ ID NO: 22513 - DNA, 795 bp, Oryza sativa
tcagttgggaaccatgataatctcaggtctaaggattcaacaccaacactaaatgagataactgatgacacaacacatatggctcttgcagtgtctcatgttgggtctatccaacaacatgttcactaacatgtgtccacattattaatttggtatctctataccatgatccatgagacatgatcatcaattaatacatgtgttgatcatctaaacatatttgttccacatatgatatttgatcagggatcctttagaaatagcaacacataacataaaaagtcttatgaaagaatcacatattcattaaccaataatgagtttatctatttcaaggaacaaaatcggaaaaatatgtaaacatagtatgtgatacaatcatctctatgattgcctctagggcatatcactaacagcggcagcataatgcagaagaccgccggtagcagcttccatggcatgagcactgagagctacaatagagagcaattagccgacaacaaggtggacacgtagactaaggtcccctttgatttataggaaaagtgtagaaaatttgaaggatttcaatcctatggaaaaaattcctataaaagcctttgaaacaaaggattgaatcctatactatcctttaaaattcctatgaaatggctaatcctatagtgattttagaggaaagttagcaagaggtctaacctcttgaaaaaattcctttgagtctatctatctcatccgattcctacgttttttctgtggtccaatcaaacggtcattcctgttttttactgtattttc

SEQ ID NO: 22514 - DNA, 920 bp, Oryza sativa
ccggttacaataggtccttcggtggttttgacaccagttttgtcctacgtgacggctgatttagcatgggacccacgtgggtcctacatgtcaggctgagtccgctgagtcatctatcttccccttcttctcttccttggttcctcctctctctctgcgcctgtaggtcggtcggcggagcgaggggggaaaggaggagcgcggcgccgcaatggcggccgccggcggcggccacagtggggatgcccgacggtagcccggcggagctccacgacgcgggcgtgcagcgaccttgcgcaggcgtcgacagggaggcgcgggcgtgtgcaggcgtcgcgggcagctggaaggcgcgaacaacgcgggcatcgacggggcaaggcgggagagaaggaggacggcggcgcaacggcggccggcggtggccggtgggcggtgggcacggaggtcaagctcccagccctcaaccgagctcgagcagaagggaggtggtgctcaccgacgctagttcatggtgctgctcgttttctcagctcgatactctcccgctcgtcaagctccaccacttgaccgaacaaatcgcggccacgctgactcaaaacagagcgagcagaaaaccatgggaggagggaaaatagctaacaaactaacagaaagtaaataagagtataagatcaaatcccaactgacagaagttcatttatttaacacataccaccttccccggcaccacggcagcatcatgatgggccagatcaccccacggcgatggcggcagcgccgctttccgccgctgacattccaatggacggtgcaccccatcgagctgtggagctggttcggcgtctccggcggtgagcagctgagcttggcgtccgctacaccaaggtcaagctggtcggcgagttcctccagcgaag

SEQ ID NO: 22515 - DNA, 464 bp, Oryza sativa
ccgtaaccgttctgtccaccgtgcgagatcgtcgttcagaacgggatcgtagggggtttccgtcagtattgtgttgacggccctgatgtgctgggccagtgtagtcacttgattctccacttccgcattagcgtgcgctgacgtgccgatctcatcgatagccaatacctcgcgcggcgtactcgttgacgatgagccatagtcttcgagcaggtgcaggactgacggttcgtggggatcgatgtcgattaccccaacgaatcggtctgaggttagcgtcgctccttgttccttgtcctcatcactgatggggatacgtgactgctagaccttaggaggtgacgtcttcacggcgctgagaaagaccttgcagcttgagaggtcgtgattctttgtctagtgaataggacagtagacatcacgagttggagaagtatgctgaattccacgctctttgcaggcac

SEQ ID NO: 22516 - DNA, 2748 bp, Oryza sativa
cccctacctggcgcgccactatcgatggggaatacccgtagaccggatatagagggtactagggtatgctggtacgaggatctatgtagtacgacatcaagcagataaaaaaacaaagattatactggttcaagccccttgataggtaatagccctaatccagttgatatgagattatatgatggaaaccacagattagaaagggaattgcggaactcgatgataccgacgagattgtaatcgaacaggttcaattagatctcacggcgacttggcttctgtaggcttcaactccgtaggctgtggtggatgtgttggctatgagattcgatgccttaggtcctcccgggggtcccttttatatcgcaggtcaaccggtctccaagtaggactcggagacatcgaacccgacacgatacaatgacgacccagttctgtccgagtatgactccttccatctgtgaactccgtgatgaattttcttaacgtatgccggaaccgtccgtattcgcgcaagcatacaatatcgatatgtgacgtatatcgaagggtagagggtataccttacctataaccctgataacaaccactatgcataaacttgtatggtagatgcaaatagatgcaatatctatttggccggatagatagagtaatatgaaataaagacatgtgaattgggtgaaaatttcttaaaaccctataaattggatgacaaattatcggtctgaatataggatacctcgtactcatactttgagtacaaatataccaaaatatacaagtacaagtatgagagatatcccatatccagaagacacaaatagtaaacaatgattacttactactatcttcgttttttaattagtttttactaatacatttaacggttggctttctcaagcaccaatattttgagcaaaagtctaagaaaagcattccgtagcgacaagagccgcagaaagtgaaaaactaccgtagtgaattaggagcgcaacaaattaaggggtaaactgacgacaaattaagggatctaaggtgaacttattccataccgtaggaggaacccgcggaagagatccagcccagtagagcccaacctggtacttagcagccctgaccatcatcagaagcatggggctgcaagttttccctgttataattaggagcgcaagctgcgcaacaaatgcgactgtaaattctgtgattaagtattaactagaaaatcagcatgtttgttggcgcaccgaccagttttacttttatataagtttaaggatcactgcagcatatgagttttcgtaaaattcgttaaaaaaatcattcaaacatctctatggattttaattcttcgtggaactaatcaaattacagtggggattgtctacagtgttacagctgtagtagcagccgctgacatgtgaaaccggcactgctactgcaaatacagtactgcagagcatccatatccatcaaattaggatagtaatatatggctgaggatggcctgtttaatttttacctagctgtgttcggtactcttcccaactctcctctctcgttttccgcgcgcacgtttttcaaactactaaacggtgtgtttttttgcaaaaagtttctatacgaaagttgcttaaaaaatcatattgatccatttttttaaaaaaattagctaatacttaattaatcacgcgctaatagaccgctccgtttccgtgcatgggagatgggttcccaacaccaacctccgaacacagctagagtacatttctctttacgcaatcttttattagatatttctctttaaccattctttagccaatatttttgttttcaaccagataattttacctttgttacactttggatcaccgtgactattcttaaccgtacggatctcaaatatactagccactaagagtcgcgcgtttgcgcgaccataaaaagccatctttgttaaagattaaggttgccttttttttcctgttgcaactaaaatgatcttggccctaaacattaatacgaagttgcccatatgttacatacatgaccaccgtagtatttctttttttttcacagaaacaatttatactacctatgtttttaataaatgacgccattaacttatattcacacggttgaccatttgtcttattaaaaaatttacatatttctaatttattttattgtgagttgtgttacaaactgaaagtacttcaagcatgatatatatcttatttatttaaaaaagaatttggaagacaaatagttaaatatgtatctaaaagtcaatgatgccatatattaaaagacaaagggagtattgttttacttggtccatgtgtcaaatttcaaaaaaacccaacttatgaaattgaagcccattaagtttcataagtgtctatctgtgttgcttgctctctttcatgctggcaagtacgtgaggagaggcactagaaggctccggagggataatgcagtacgtatttgatcggacggtcaacatttatccaatcatgcatctgatggcctttgttttttagcttacgtggcctaatgtgcttttgagaaagattagttccttcattactttagactagctcctacttgtcaatgaaatcccatagccgtatgtagataatttctttgacatatgacaaattaaaatcatatggataaaagacttgatagtggttcaaggtatcacaaatgtcaaattattcggttcaaattaagtgaaaattagtt

SEQ ID NO: 22517 - DNA, 1509 bp, Oryza sativa
tttgataaaaatggacatatgagatttagccatatcattaagagtacattttttactaatgatttaatctgtgagtaaaatttttcattggctgcaccctcatacacaggaaccatatattgataaaaaaagtaaatttcagccacatcaatgcctcagaaaatttgacattttgatccaatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgcttga

SEQ ID NO: 22518 - DNA, 3409 bp, Oryza sativa
ctatcccagcgtagcatcccattataatatcggtattgaagatgacaaatgtgaggatcatactgacaacaacatagaggaggcatcaagtatcgcatctacaaattgtggttctgctgataagcatcagactatacaggtgttgcctgtttgtttagcaaatggagataacattgatgatgttgcttcattggggagttcaatttgtgaagacgttgaagataaagacaacaaaagtaatgctaattgtatttcagaggtgagtacaaaaggaagtttcgcttaatttctgaaaattgtggctgttagcttgttatatatttctgaattttactgctattgtatgtttcaaatgaatttgaaagggagctccacatggaaacggaatgccacttgttaggtccccagcatcatggtggaatttatgtggagttattgatgtgtttgctggatgtaaagattgaattgaggtgagaagatagttcattccaattttcacaccgtgacatcgtttgaattttgaactgagggtactccttttaaaacaaaacaaaaggaatccagctgcatggccaattattttgttgatcatcatctgctgcaccgtgggttcgcacaattgttacttatttattttcttgtcaatattgtctaacacaagagagatttttcttcggtggtttttactaagtatgatactacagtaaaaaaactaaattgttgatttattggggtataatggtattttttttcctctctatatgatttgggttttttatttccctttttttccccaagagactggcgttactcgtgtggaccaccagcctatctcacttaaaacgaaatataccaattttactggaattttgccatcctgcaagtatcatttccttttctcacccaaccccgacatagttcttagatgattgcttgattacaaagaatgatctgtaattttattatcgtcaactctcttcgcagtatttggacatgacacattttctgttgtatgcagatgttggcaggtcatgggtggaactttgggacaacagaaaactttagatgctcatcctaatcctgtgttgacaatgaagaagtatttgacagtttggattgaagtattgaattgtttatagtgaggctgtttgtcttggtggatgtatatatttttttggtagattgcctgattaatttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaagccaaatatatccgatctagaaaaaatatctgtaaaacaaattaacaccaccaattatatccctactacttaaaaaataagaggtgcttccatcgtccgtcaaaaaaactggcccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctagaaggattggagatctgtttgcaaaaacataacttacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaagaaaagccgcaaaaaaaataaaggaaaaaagaaaaccaacaacaacaacaaaagtctgtttccctaagtggcaaaaaaaccatagatccgaaccaaaaaaatcctattcctataaaggcaaacaaaaagtggtgaaaaaaagctagatccaattcctttcaaaacgaaaaaaaaagtctgattcctataaaggcgaaaaaaatctgaaaaaaacatctaaaaaagttcgtccgactctctaagaaagtggcaaaaaaaatggtttgtaaaaaataaaaagctggttcgtataaattaaaaaatgaacgcgagaaaaaaatagaatgggtgaaacaaagtctcagtatatatctcttctctatttctaatctaatctaactatttaaaaagagaaaatgcatgagaaaataaaaacggttcaaaaaaacgcgtgagaaaaaagtgagaaaaaagcgaaaaaaacactctaaaaaggttttccatcttccataaaaaataaaaaaacatgtgagaa

SEQ ID NO: 22519 - DNA, 780 bp, Oryza sativa
tgatctgctccgttcggaagttatttgcttggccaaaagtcataggcaacgtaattttgcccaatggtttggacgatgactgaggagtgattccatggaaaggttgatcggtgggtgtcaactcgcttcgtgggatccccatcgcgtccaaagtgctagcgaagagaaggttgattgagctgccgccgtcgatcagaactcgcgcgaccttgatattccgaatagtgggttcgaccacgatcggatatcgccctgggatgacagcagtcttggggtggtcctcttctgagaattctatcttctgctcagaccactttatcttgggcgcagctccctgccatgttgaacagacttcacgttccactttcttgtattctcgctttgaggagtatgctgtggaacctccgaagatgtgcgagacatggagatcagagtctgggtatgctgagtccgattcctgagtagccgccttagcgtccttctcggccacacgtactcgcttgcctttttccaatgccatgtgttttgcgagcgactttttgaagatgaggcaatcttctagagagtgtctgtccgacttgtgtatagggcaccatgttttcttcgtgtcgctgctttgtgggtctgggcgcttgggagggtccgcgtattctgttgcgagaacttccgcttgagctttccttttcccactcttgcgatttttcttcttgcttgactcaggagcgtccttggctggtttcttctctcctccggtctttggtttgtcgttcttgcgtctca

SEQ ID NO: 22520 - DNA, 773 bp, Oryza sativa
tcacgctgaattcgatacagcatacaatgctatcattgggagaattgcacttgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacacgcccagcccacccaccacagttgagccacccaagaaagtgagcaaaacaaacaagacggcgaaaccggacggtgcaatcaaaatcgttccactctccagtgccaaccctgacaagaccgtcaagatcggggcatcactaggcgagaaataggaactcgcgatcatcaccttcctccgcgacaatgctgatgtgttcgcttggcagccgtccgacatgctgggggtatccagggaggtgattgagcacaaactcatggtgcgaccggacgccaagccagtaaagcaaaaactgcgtgagatttgcaccagatcgaaaacaagccatacgagaagaactcgacaagcttctcaaagctggttttatcagagaggtactccatccagagtggctagccaacccagtcatggtgcggaaggtcaacgggaaatggagaatgtgtgtctattttaccgacctcaacaaggcgtgtcccaagaatcacttccctcttcctcgaatagaccaactggtggactgaacagccggttgtgagttgctgagctttctcgacgcttactccggctaccaccaaatcagcatggcg

SEQ ID NO: 22521 - DNA, 599 bp, Oryza sativa
ataacacagccgagtacgaaggactactcgccgggataagagctgcagctgcacttggagtcaagcgactggttgtgaaaggggattccgaactagtcgcgaacaaggtgcataaagattacaaatgctctagccccgagttatccaagtatctcgcagaagtcaggaagctggaaaaaaggttcgatgggatcgaggtccgacatctataccgcaaggataacatcgagccggatgatctagcacggcgtgcgtccagacgagagccactcgaacctggtacctttctggacgtcctgacaagcccatcagtgaaagaggcaagcggcgaagatagcccggtcgccctcaacatcagctcgggggctacagaggtagagcgcgccattgccgatatcgagaccacagacgaccggcgcaccccactcattaaattcataggcagcgaagagttgcccgaggacgacgcagaagccaaaaaaataacccataaagcaaaaatcaactgtatgatcggcaacgatctatacaagaaggcaccaaacggggtactcctaaaatgcgtctcgtccgacgacagtagacatctcctcctcgac

SEQ ID NO: 22522 - DNA, 741 bp, Oryza sativa
tactgtgctaccatattagtatagatattaaaaagttacaatatttagttctctctctgagctcaatgaaattaacatgcctatcactttgcgattttggccattatcattatgaccttaccctctaggttagtcccagatttatattgttatattcatgcaatatattctgttggtcacaggtttaccgcatccacctcgatgtgttgctgccaagtcgcgtaaaaaacgcaaggtagctatgatttgcaggagagaagaaagtaagaaaagacattctacactaataaccttatagacaaatttgttttgttagatttgtgatcatttggctgttgttccagggttatatgctgatactctctccctttcatctcggtctgttcggcggcgcaaaatcccaaatgataatattgtacaccaaccacaccatacacaactacgtcaacataacccaacctcagctgctcagccaggtggcgatggtacctaatttatttcttttcaattttcaataatgtattgtgatgacaagaaatccttaattcttctggtctatctttttcttgcaccagatcataggcagccattccccggtcgacaccgccgtaagttctattactttttttcaatcttactgttggcatattcattaactatttcttagcatatgagaaacatgcacgctatgtgtgtttcgaatatgcctaggagatatatctcctcatattgcctcagact

SEQ ID NO: 22523 - DNA, 756 bp, Oryza sativa
actagacaaattactgagagatgcaggatatagcttggatcatttccagttaccgcagctaagccatcatgcttttccaccattggagtataggcttataatggatgaacttgcttatggaacaaacagtgtgactgaactgcttaatcaattaaatccttatcagaggcatgtttacactgccatagaatcctcagttttaaataattctaggcaaacattttttgtttatggatatggtggcacagggaagacatttctatggaataccctattgaacagcattagaaatagagggaaaatagccttgacagttgcatcttctggtatagcatcattgttacttccaggtgggcgtacacctcattcacgctttaggattcctctagacatccaggaggactctatgtgtgctattaagatgaacacccagctagctgaattgattcagcagacatctctcattatatgagatgaagcacctgtcaaccataggcattgttttgaagcattcgattgaacccttcgggatatcatgtcatcagtcaaccatgattctgtgaacatgcagtttggtggtataacagttgtcttgggtggtgattttagacaaactctaccagttattcctaatgcaaggaaacaacagatcttgaatgcctcaatcacccgttctcgcctttggcaaaactgtgtggtgcttgaattaactgaaaatatgaggctcagctgtccaggcctttctcttcaagataa

SEQ ID NO: 22524 - DNA, 585 bp, Oryza sativa
gaggatggtcgcttgagccattacagaattgactcatttcagaagaaatatagagccagcccatacaactctttggttcaggctgttagcaccggcatgacacaaggatcaacagcaggtcaaaagatcgttttgccagcttcatttaccgggagcccacgttattactatcagaactaccaagattgtgtggcactttgtcgtcggtttgggtgcccacatctattcatcacttttacatgcaatgctttatggctagaaatagtagaagctttagcacccatttcaggacagtattcctctgatcgacctgatattgttgatcgtgtttttcatatgaagctaagaatctttatggatgacatagtaaaaaaccagttttttggtccaatatctggaggtaatttccatagctccttaattttgcgcactatgttctattacataatgtatttcccgttgatatttcccatctacatccaaatttttcggctattttttttggcctgattttccccttcgatacttctcaattagttttccattcccttttttgtagttgtctacacaattgagttccaaaaa

SEQ ID NO: 22525 - DNA, 412 bp, Oryza sativa
gtagtcgacgcacatcctcttcgtcttgtctttcttctctacaaaaatcacaggagcaccccatggggaagtactcggacgtatgtaccccttttctttcaactcttccaactgtttctttacttcggccagttcatttgctgccatacggtagggtcgcttgtacagaggagtggttcctggagcaagatctatccggaactcaatctctcgcttgggcggcataccaggtagttcttccggaaacacgtctccgaactctctgacgatgggaatttctgccagttctatctgatgaagttctgaacttctgacagaggttgggggcgcaaagaaaacaaccggttgttctggtcctcggtacagagtgacagtgcgcctcgcgcaatccactactccttggaattgggcc

SEQ ID NO: 22526 - DNA, 576 bp, Oryza sativa
cctgatccaagaccttctggagatcgagttcaagatgcgccaacctcacacacgcaaggacatggcatgccccggtatatatcccgttagatgtctcctctccgatcctggccgcgtgcttggaggggatcgcctccatcgccgtcgctagctccgcaagcgaagtcgtcagcgagaactcattgggattcgccgggatggtggacttgataccgcactccccggcgagctggtgcagaccagtgtaggtgacccgcaacgagccacggatttccgacaagttgttctcgagctctgacatgcgatgctcgagcccctgccattgtcgctcgttgccggccaccagttccctcatcttctggaggtcctcgcgtacctccgccagacacgcgtcagccggtcggcgcgctcattcgccgacgacgccgccaccgccctcgcctccgcgatctcgcagctaacaccgcgagcacaagcctcgaggaggcgccctatctcgacctggagctcctcccatgtgaggacggcagtcggcggaccccgacctgccgcgagatcgctggctgggccgctcgg

SEQ ID NO: 22527 - DNA, 1354 bp, Oryza sativa
agaatagtcaaaggctgggtgggctcgagcctggagcggctggatccgcctaccaatgaagtcggcagcgacttcatacctcgacaaacctcatactcggaggtcatcgatggcatcgatgaaggattgaagagaaggggtcaagggaggttttgcggtccaagacgaaaatcttgtctggttgttcctcaggaacaatgaagactggatcagaattttctatctgaagatagaaccacctcacccgccatttgctacgagaagaagggcgctggaaggggatatagcgtgacttcaggccatcccggagtcggaaaccgaccaagaaacggctgtaccccaatgtagtcatcacaacgatgcgaaaaaatactgaggaaggcgatggaattggggttcaaatggagcaaggaaaggccgtagaaattcaagaccaagagaagaaattcagaaggcggagaagaaaaccacagagaatatagtcctcgatcgcaaccatgtgacccaggacaggctggggttcagtacctcctacttctctctccatggtcccgcgaccgggaagggcgccatccttctgtagcttcttcagcgacgcgctggtggaggtagacttgtcgagatccattgccgctggagatcgccggagaagggaccgaaatgagctagctagggtttttgcgggagcggagaagacgaggaatgcttggaggttggagagttttttcacaacaggcggacttcaaaagggatccccaaaactcccttttatagtcacacttccgatggtgcgaattccaaggaaaagaagagatggccgccggaaatttctgggtccgttacgtgcggcagtttgtcggactttaatttaaattcactcatgaccgttgagcttcacttggcgttgtcgattactcttcgtttctcagtcctcacaccgagaacgacaacaacctcgacatcagaagtcatgatcggttacacaagttcatttaagcagaagtcggggggctactgtcagggttatgggtaaggtataccctctacccttcgatatacgtcacatatcgatattgtatgcctgcgcgaatacggacggtttcggcatacgttaaggaaattcatcacgaggttcacagatggaaagactcctactcggacagaactaggtcgtcattgtatcgtgccgagtccgatgtcttcgagtcctacttggagaccggttgacctgcgatataaaaaggaccccttggaaggacctaaagcatcgaatctcgtagccagcacattcaccacagcctacggagttgaagcctacagaagccaagtcgccgggagatctaattgaacctgt

SEQ ID NO: 22528 - DNA, 1924 bp, Oryza sativa
tcatcactggcctggcaaaacaacgcctggatttctaacatccgcggcaccctcactgtcccggtcatctcccaatttctccttgtttgggattgggtgctccacattcagcttacaccgggtgtcggggatcgtcttgtctggcattggacgagtgaccagcgctactcggcgcgttcggcgtaccaagcgttcttctttgaccagcactcctttgcttgtgccgatcttctctggcacgcgaagggccctgctaagtgcaaattcttcctctggtttgcatttcagcagcgctgttggacagctgatctcctccagaagcgcggcattgatagccactcggcctgccccttttgcgctcaagagcttgagacggcgaaccacatcctccttgactgcatgtttgctcgtcaggtctagttacgggtgttgtcttctcctggctgggctgccctctctcccctccgtggcagctggctgcaggattggtggccatcttctagggcatgtttacctgatcatctgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcaggataaatgcaagggagtacaagggggttataatataaaagggtagggtttacagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattctacattttagttgtcgagcaggttttaagaattaaaacactaacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagctcccaacccatcctagccataaacaagagtaccgacccaatccccctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaccattttgggggttttgaaaagagggggaggtgtgtgtccaattccaacataagccaaccattccatggtgtccaaatgatatgagaattcccaaagtctaaagttataaaaccacctaatgttgcctaattaatcagcgaagcatctacctaaatttatactagtggaaccatgaatataatgtccactagttagggttttgtttattctagggtgaacaaggtattaatatcaatagcaataat

SEQ ID NO: 22529 - DNA, 114 bp, Oryza sativa
aaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22530 - DNA, 591 bp, Oryza sativa
ctcatggaaacaagatagaatttattaaataaaaaggaattattgagacgacatgtccttctttggtttggcaaagccacatgcactcaattgttccagcttatctgttctgttactacttaccagacaggtggaaacggccagtacacatgtcagatgatatccaatgaaacaataacttttgatgttgacacgttgatacatcttagattggccttgacacctttgcggaaatgaatgctataagctcaacaagtaggaaaaagtaaatgtttggtttccttcctggtcaaatgaagaaaaagaaacatgatttaactgcaaacccacttattgatgctaacttggagtatgttttaaaatttactactactgtttcacaaattttgccggtttacatacccaagagatttaatattttattaacatttttaatagaattaaaccataatatatgctaagtgtagcattttctctatctgtaatcatagttcaattccgttgcacattacgtgaattttgcatttcatgtatacttttgccagcatccactaggaccactagtcatcctagaatagtaactagtcagag

SEQ ID NO: 22531 - DNA, 634 bp, Oryza sativa
ttgatcctcttattcggtttattagtgagacatggaagaacaaactgaatgttgtgttccctataaggcctgaactctgaagtcaggtgaattggctttgggtggtggtggggctggattcaaattcctgatattgttagttggagtgataacatacatatttgggtttggttgggttgatttctggtaaacttgggtattcaaggtcccacaaaaaaaggttgaacatactccaatgcctgtttttggtttaattaacgattggtatggactcaggcaagaaataagtgccataatatggttattcttgtgctaaaatatattggtggagattttaacttttagattgattgaatgttgacattttttctgttcttttgcaggatactctctgtttcttgggttaattattgaccggctacatcactatatcagggagttacggaccatgaagaaaaacatggaggctgtaacaaagcagagcaggaccttagaagaagcaaaacatgggagtgtagaggagattcaacaatatcagaaagagatttccaggttgaatgagcaagtgcaagaattcaagcgtctgtcagaaacgaaaactgaggaactaaaaacagctgaagcgaataccttg

SEQ ID NO: 22532 - DNA, 726 bp, Oryza sativa
gtagtcccaacatgataacgacaagttccaaacatgtgtgttcttgttgtgtttcacaatttttaaatgttccaattaatatttttttttcatcgtgcataattttaatgtttcatccgttggtccatctgatttttatggaggaatcgaacgttcgatttggagtttcctcccagaaagacagacatgtgccaagcacacaccaaaagagggaagggaacacgatattattccaataatgaatctataagtgtttcttaattaactcgttgatcaccaactttacaaacatcgactgacgggtcctccttgggacgacccaatgcattcctccggcacaacaatgtcgaatccactcagcgtccactctgcctccgcatacttgctgacgtatatctccgttccgacgtccagcgacgaccacctcctcttcgccggtggcgtgcccggatcctacatccatgttgcaaaacaacatcaatcacactcacccaaaatcctttccattttgctaaaaagaagaacgatcacttcctatctctgcattctgcattgaaatttctcaaccaaagtaaaacatcaactgcacaaatgcaatggactccctacatcctacaatataagaatctaaattcagatggatatttctgattcgtaacaatagaaaatatcccatctcatctacgattctaggtcttatattttgggacggaatgagtacctggt

SEQ ID NO: 22533 - DNA, 286 bp, Oryza sativa
cgacaccccttgctgctagtacgcctctacctggacccgcacagtagtctgttgtcgtcctcgatcggatcagctaccggctttccgaagatatctccgcgcttgatggccgccgccgccgcggtcgcctacctcctcggcttcgacctcgatctccctttctggttgggggcgccgtccatcacaacgcatggcaacgacggcggcggcggaagctacgtgtcggcggtcggggaccccggcatgcggcgcgacggcctccacgtagcctgggaggcatggaact

SEQ ID NO: 22534 - DNA, 689 bp, Oryza sativa
tatttctaataatataattacttagataccgtatgaacccgcagaagggatccacggtacccagcccattgatctgctaggcttcatcagtcatggtactgccaccagacctggccaccatcagaggcatggggcagcaagtttttttttcttcgaacgatcaggccgttgccgacgttttacataaagaagaagttgttttattttaaagagaaaacgagaccaaagcttacagtgcatagttaattagggaaaactatgcgaaaaccacaactattccctgttataattatgagcgcaaccagtgggattataagttatgtgattaatagtactaactataaaagtaaattacaactatcgacggggaatacccgtagaccggatatagagggtactggggtacgctggtacgaggatctacgtagtacgacatcaagcagacaaaaaaacaaagattatactggttcaggccccttgataggtaatagccctaatgtcacgtcctgataaattcatcccgaattaaaaatcattctctaaaaggaataatagaattaattaaaattcgaaaagaaattggcaaacactaaaatacgtacaagaaaattcaatgtgacccggagaaattttgtaaaatctccttggtctaaaaggagccctcaaatttaaatggaatttcagagcac

SEQ ID NO: 22535 - DNA, 15381 bp, Oryza sativa
  unsure (1)..(15381): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagccctagcaatggcggggtggtacgaggaggcggtggggctgctgcggcggccggcggtggcggagatggcggtggacgtgctgctgtgcgcggtgccgatctgggcggccgtcatgatcgggctcgtcatcggctgggcgtggcggccgcgatggacggggctgctctacctggggttccgaagccgcctccgcctcctctacgttcccccgggcctcggcgcgcgccgcctctggctcgcctgcaccgcgctctccgccttctccgtcgcgccgcggctcctctccaccgccttcggcagccgcggcaagcaccagcgcaaggacgccgccttggccgacgacgacgacgccgccgacgcctccggggacgccggcgattgcgtcgatggcaggtgggatcctcttgagttggattatctattatcgctgtgggttagcgtggtaggatgaggtgggaatgcgcagcgtttgccttgttagctgcgtccgttgggaactaggtgtgcgccatctcgaaattgaatttattactgataatcgaaatcaatgtgctcacaactcaattctgtggtgactaatgctgatggcaggttaggagcgccgtagcttttggtgaaattgcataattttaactgaactgatgatgatgccatatgtactgacagagctatagaggctggattaatgaaaatccattatctaaaaaaacatgtactgacagagcgaatttatgcttatggcatgcttgaatttcaaattatcgatgttatgttaaaattaaggtgcttgatgtccgtagtatttatgctccgacagataacattaagtgaaagttgtgcgtatcaagggtttcaatgtgtcatattaaaatcatatagtggaaggattagtacaagaaaattcgtttgctatttgttaagtacaactgttaataagatgatccattgtactttacccttgaatttgaccaatactgttattgccaaattgtggagttgagtaacagacttattcttctttctttagcaactgaatttgatgtgattgagttcattgggtcaagtgggtgatcaatggtcgatgtactgacataaaatgcatcaagccatcatcaacataaatgactgggagcttctgactgaaatttcaaatgctgattaggacttgagaattttagacttgttggacataattgaacttttacatgattgcctgttatatattgacctagttgatatgttttttcatcgggtgacccatttgttatgttacagtagttaataactaatgcaaacaaaaagttatttcaaagcatgattgcatctatttaaactgacttcaatataggtttatgcaacaaactgtttgctaaaatccttttcttctgtccatattagaacattttttgagggcggccatcatgttgtcactgagaaggacctagaacacctcgtacaacttcttgataacaaggagagtggggatacaacatggcagcatttgatggaacgtaccacttccaacatgacttacaaggcctggcgccgtgagcctgaggtatgttttccaatgggattgtaggaaagaaacagatgtcaaagtatatgtatagcgtgattgcgtaaatgattagagggccctgtattagaaataagttaaatactagcatctgaattgaaagaaaaactctgaaagttgaatcaactgtaccaagatcagaatttatgtttttaaaatcctgtgatgaccttggcttgccgtggtataatattaattcatttccttgctttgcacctttggttcatttcctgtcttttcaatgaatctacgtttgatgtgaccaaatcaatagcatataggttatagtgcaacatctaatggactgatcttcctttgcttgtaggtgggacctatcatgtactgtagtcgcactatttttgaggatgctactcctgagcttgttagagatttcttctgggatgatgaatttcgtctgaagtgggatcccatgcttgcatatttcaaaattttggaggagttcccccaaaatggaactatgattattcactggataaaaaaggtatgacaacttgacctgcatatctcttgacaagcatatcccccaaattacatattgaatcatgtaatttcaacatgttgcttgttttgtagttccctttcttttgcagtgaccgtgaatacatttttgggcggcggatatgggaatctgggaaaacttactattgtgttacaaaggtatttctaccacaaggttccagtattactattttcacaagacatttttatgatatgctaacctggctttggctgatgttctcatatggatatctaacttaagtgcttaactactgtaattgtatgagcacctattgcaagatactacctctgttcacgaatgcttaaccaatgttctgttgcgaaggctatttatatgtgaccaaattaaccctagtaagtaaactacttactattttctgccaaaagtggaaaggggaataaggacaaaactggaaattctacttgggaacatgaagtgacaaatatttattcagaagaaaatgtggtgaaaagtgataaatattcatgaatagagatagtatctgatttttgaggattctaggtagcggtctgggtgcttctcttgacgcagaggctggatattttccaattatctaaaaggatgaggattctaggtctagaaggtaattagatttattagtgactacaaggcagatcttttagtgaacaaaagatctggtatactaaaacattgtttgttgcgtagcaatcttgcctggctttctgcaaattgcaattctgacatcgatacgattgtacttactttttttgagagtgctagatcaaacatacatccattgtattttaaggtgttgaaggtgtagttgatgtgaatggagatcgaagtcaatagtgtctggcttctagaggatacttttgcatagctcatgcatgtagctcttcttacatttggttcaaatttcaaacctggatctcagcccagagaatcagacgccatggcctagcattcttgcataatcaacattagaaatacatgtatttgaagattgttggcaatgcactatgtagaaaatttgactactatctattatagcgcatatgcttgttgagagacttgtgagcactgaaacacttccatttgcagggagttccttatccagctttgcctaagaaggaaaaaccaaggcgtgtggaactgtatttctcaagttggcgtattagagcaggtaacttttgttcctaccactattcttacttcacctgaattagttcctttcatcacaagttttggtcaagaaggaacacaaatgtttataccttgacattctgttcccttttctgtttgggtaaccacagttcaatcaccgaaacaagatggacagcaatccgcatgtgaagtaacgctggtccactacgaggacatgggcatccctaaagatgtcgccaaggtgggtgtccggcatggcatgtggggtgctgtaaagaagttccagtccggatttagagcataccagcaaatgagagacacagagaacaccctctctcgcagtgccatcatggctcgagtaaccaccaagacatctattgctagttccagttgccccctggatcaagagccctccaatgcagcgaaaaccatcgatgagagtgagaattccagagcggttcaaccagggttcgactggaaatgggtggtgttcggtggcgcagtggctgccgtctgcgtgctcaacactgggcttgttgggaaggctctcctcatcggagctgcatcaagaaggcaggcgaagaagtgatgactgagtactgatgatgagtgatcagcaccctacctgtcagcttctgcaagatggcgttgagctctcttgcgcttcagactgtgcatgttgcaagtagagaagaggtaaagcgaaaaaaaaaaggacatagatgcggtgctactacaggaggcagataattagcacgcttaattttggatctcgtatttatgcagtatcgctgtcgcacatgtgtatcgtcaccataacgtaacaacagatcgtcgtctctggctaatgtacctgaattgaagatatgtctaatgggggattaattattaaaaggttttgctaatgtgcctgaactgttgcagttgataataaaattctccgccgtaattctcgactattgttcattttgttataataacgtgaatgctgccaccttgtggccctttcctttgttgagccagaacgatgttgttggaccgggttctgggtcttgccgttttgacctcctgttatttggtgggctgggctgcaatttctactaccggcaggtatctggttatctacttgtcagagccgtctgtcaatgtgtatgtgaaaaacgttttgatttttttttctaagttgaactttttaaattttgattaaatttgtagaacaaatatagtaatattcttatacaaaacgattatgtagtagatgttactaatatttttataaactaaagaaaaagtaaaacatcttataatataaaatggagatagaattatagattatcagaggttttttgcaattttgcaccatcttcggcatttgggtaacacccatagaaagagagagaaagaaaaactgaatatgagcattcagttttcttttcttgataagagattaggctcatacaggccggacaaacccctccatattctccccaaaaccatgcatatgcattcatgtgtctacaggtggtgtacatgtgtctgatgatgtaactaatggcgaaagaaaaaaaatcacattatccggctgcccacatatccaatgtctcaaccattactatctttgaatgggaacgaagtttcaattatcactgtattcttttttaatggaaacaaagaccaagaatttcctgattgcagctcctggattctacgcccagtgcagaccaacaccttatcaatttgtcatatcgccttcaaacttttttttcaaagcttccaagctgctccacttttcgtaagcgccgccaccacagcatccactaagcttaagcaccgtcattagagcagtacaatagcttaaacatattttaaagagataaatgaagagagaagagcagcggactatagatctgtagccagctgcaacacggacttaaagacgtaatgtctgtatgatatgtggaaccagatattaatagtatagtagaaagcaactattatataaattggctattatattagctatagatgatttgtagctagtagttggctatactattaaacttgctcgtagcatagcctaatcaccgtctccttcatctctaatcacgcacatgcaactcactagctctgaacaagtacaatagcagactataaacgagctgtaatcatattttaaaaagataaaagataagagaggagcagtactacagcacggacttaaagacgcaatatgtgtatgacaggtgggactagaaattaatagtgcaatataagtttatagataactattatataaactagctattaaattaactatagatgatttggagctagtagttggctataccattaaatttgttcttacccaggaataatagtacttaaaaaaacgcagcaacagagagaggtgtctcctctctctctctacctccatctcctcgagatcgacatgccacgctcacgagttcttcttgagtggatcaatggagatgtgttgctgctgagctgagcagagtgtgtgtagaatgatgggagccctgcagcagcagagcaatggccatggccatggcgtcctcctcctcgctgaggctggctatgccgaggttgatcccactggaagatatggcagagtaatcatctactaatcccatctcatcgtcttcttcctccagcttcttcttaccttgtttcttaatgcttcctctctctctctctgcagttcaatgagattcttggcaagggatcgtcaaagattgtgtaagttcatcagatgatccaatttattctcctaaattagtttaatcctctgtttgattgtgtttcttgattagaatttgagtgtttgattgattttggaatgatttttcgggtgcaggtatagggggttcgatgagtggaggggagtggaggtggcgtggaaccaggtgcggctgcgcgacgtcgtgcggggcggcggcgagctggagcggttctacggcgaggtccacctcctcgccgcgctccgccaccgcggcatcgtgcgcctccacgcctactgggtggacgcgccgcgccgcgccctcaacttcgtcaccgagctcttcgtctccggcacgctccgccagtacagggagaggcaccggcgggtgagcgcggcggcggtgcggcgctggtgcgcgcagatcctcgacggcctcgcctacctccacgcccactcgccgcccatcatccatcgcgacctcaagtgcgacaacatcttcgtcaacggcaaccagggcgaggtcaagatcggcgacctcggcctcgccgcgttccgccgcggcggcggccacgcccgctgcgtcggcacgccggagttcatggctcccgaggtgtacgacgagtcctacgacgagctcgccgacgtctactccttcggcatgtgcgtcctcgagatggtcaccctcgattacccctacagcgagtgctccaatcccatccaaatctacaagcgagtcatctccgtatgatctgatcaccacagaatttctcgtgaattcttggacacgatttgatcaagagaatgcgtgtttctgatcaggggatcaagcccgcggcgttgtacagggtgagcgacccggtggtgaggcaattcatcgaacggtgcctcgccccggcggcgcggcggccggcggcgagggagctgctcgacgacccgttcctgctgccgcttgaggatgatggcttcttctccggcgacggcggcgatggacatggcggttttggcgttggctactacaatctgatgtacaactacctgcaccagcctgcttgcatcgacgaccaccatgcctgcagcaatggcggcttgtcgccgtcgaatagcgtcggcgacaacgacgtggacgcggccgtgcagcggggggacgacgacggtgacaactggctccgcgacatccacatgctgttcgacgaggacgacgacgacgccgccgccgccgacgccaacgagcgtgtcggtggcgtggacatcaccatcaaggggaggaggacggacgacggcggcgtctacctcggcctgcgcatcgccgacaagaacggcacaggtacgtgatcgttgcatttttgaactggcgggtgttcaaatttgatttgatttataatacaaaatgatgtcaaatgtgggggcgaatttcgtctgaattcgagctgaattgtggcagggcgtggccggataatctgcttccggttcgacaccgaggccgacacggcgatgaccgtggcggcggagatggtcgccgagctggacatcaccgaccacgaggtgactcgcatcgcccagctgatcgacggcaaggtcgccgcgctggtgccgggctggaggccgggtccagcgacggacgacgacgacgacgacgatctcgtcggcggcggcgatgatccggacgcgccgggcggcgccgccgccgcctgctgcaagaactgccggccggcggcgtcgtcgtcgtcgtcctgcggctcgctcgtcgacttcatgtcatcggcggcggcggcggagcgccatggctgcaggcggtgcgccgagctgcacggccggtttgaggagatcacgttccaagccgacgacgacgaagaggagcagcatttgcaggggagctcctctgacaccggaggcagcaaccatgagcagcacgccatgggcaaggacaaggaggtcatgaacatcaatggcattgcacaagatggcacagtacaaggttcagaacagccatgatcagtaattcagtatgatgatgatgaacatccgaagatcgagcaattcgacgctgataggcgatacggatcggcgatgtttacaaccattgatgggttcttggatttgagcaatggcgcgagtcggtgccgccaccatgatcatgaccatggtagctcaaaggattcatgatcattgtgagggggaattgctcattgtgagggggaattgctgacagcaatctcgatcagccgctgctcactttcagaggttaccttgccgacacattgcaagagcaacaaagtctgtactgttgaacaatgctactgacgttcgacatgcccttctgacaaagtaaatctacagtttcaagattggatttgctcgtctttttttcagagatttagcatatattgtagggaagaaactgaaagatgtagtataacgttttgtgactgtgctatgaatctgaagaagatagggtacagtttaggtaggccaagtgcaattacttccaatcttcattggcttcagttagttacatgcatggctgtatctagcattctctgaccataaatcagtagtgcaagaaagtgcaatcaggaaagatgcatatgtttttcattcatatttggtacgtctcttattcaaagaagaaatattagggtggcattcttatccaaggggtacagcaaagcaaagtgtgtcattcagtagtaacataaggcaaagtttcctgagctgacatctgaaagataacaagttggtgatcagtgtttaattctttgtgtttgattaggcaggaaaaaaaggcattgagactatagtggtgtccaaagctacaaaacacaagtccaagtttggagttgtgagtctgtctctgataaggacatccatgtcaagctctggtacacaatagatctaacacatgaacatgcaaacttgcacattgccagctattgcagggaggcatccattgctgctttcataacattttcaattgggagctccatgatgcacaaagggatatactaatttatttatccttttgttttaatgtgggcaactttgatcaagtattgatcaacctaggaattattctttgaggaagcgaagattattattgcatcgtttgttttttaatcgtccctgcaaattagttcaaaatgtttaatttacttgttttatgtgctagattctgataaatgattgaaatggcccataccatgagatttgccagcttaccatcattcatggggcatctagaagtagaggagaaaggggtctccatccaaggatactttatggtgacaagtcggtgatcttgtatggtccaatgcaatgcatgaacacacacggatacagcaatttgcatgcattatttgcaccaaaataagttataaaatttatatatataatatatgtacacgtattgctcacctgtcctctcaagtccccatctggtcaatatcctctctctcattccttagatgttgacatatgtcttatcatgtgttatacaaataattctactttaatcatgtaaactatgtataccatgtaagtaatgcaatatttgcaatttgcacaagtctgaatgcacctctaacacagctacatcagagaccaataattatggtttcattaaaggttttaatttgagaaaagaaaagaattgaaaatgacttagtgagagttacagaggtccactgatctgaatgattaggcaattaagagcaactttgtgcaatggttggcttgtatagttttcagataagcatcaaagctgaacctactaccatgggtggtaggattggaaaggcatatgcatgctttccattctgactgaaataattgaatttttctcacaataatcatggccctgtagcaaagagaacactggtttgggggaataggacgcagtgaggttctctgtatggcaggttggcatcttggaggcattacattgcagaaatgcaagtttcggtgcctaatttcacactttttgttggtctggactcttctgcatatgttcaatgattgtgtagctaaacaactacagcaactgcatgttctggatgatctcttttttttagtacaaaagtagggattttggtgttggatttctcataagaattcgtcaatcccttcgaaaagcagattgctagggttggtgttatgaccaattcatgtacagaagaatgctgtgttagcatttgtactgtaaatacaagttaaatttgaccatgattattgtttacagtataggtttgtacatataaaaacgatgcaaccaagtagtatgtcataacaaaagcagacgtaatattattcttgtgtaacttcttttgggatttataaaaaacagttacgttcaaagttgtcaagttaatttcttttttaacgtaagatagtattacatggtctagtgcaaagatcattatgcccttgcttagaaactatctcagttttaggtttgttctcagtcaagacaaactttaatacatttgatcaaatttatatttaaaaaatactgcagcatctacaacacaaaattagttccattaaataatttggtattgtggatgatgtcacattttttataaacttaatcagactttaaaaagaagttttaagttaggataaatctaaaacagaccagcacttgtaaggagcccagttcaagtaaaaaataaaatgaagtggaaagggaataaggtgagaataatctgacttcgtgcacgtgcattggacgacggaaaggcatctactattctaacctaaaagtaaaaccacgaacattgaacaaggaaaatctcaccatgcctattgcctagtagtaacatcttccttgagatcttattgattaaattaattatttcctcgacaagaactctttcttcttgttgggtgcgctatgcaggctgcaataaatattactgcaccggctttgacaattttttatgttataatatcattgtttatttgtttagccatttggtgactgacaaactgaagcttcggtgctcaagttgtctgtggttataaaatttgttgatttgatttgacaagactttcttaggtgaacttggtaggagtagtagaatgcgtaaagtgggcaatttgtttttccagattatttgtctgtacatacatagaaatatttgctatgtgaaggttaagagttatttatattttatttatgtttatatgagatcttgctggtaatgcatatgctttgctggcaaaaacaacaaatagacgtcagattgatgtgaattcatgtaccaatcttcttgctttctctcacttttggtcctttgatccttcctagtttcatacctatttctctcaaaatgaatattatggttgcaactgcttcacttaaaaaatgtcttaataatcttgtttggtgttgctttctctaatggatcactttcctctaccaacaatgatctgatctctgcagactggagtgacatttaagagaaatcccagtggtacatgtcacaaaagcacatgataccaaatgaactggggtcagctgttgtcatattgctacaaaatttggcacagcctaagcagggagagggtttttgataggcacttcaagatgttcagagaaatttagatagcttacagagttagctaaaactgagtaggccgtcgaagtggaccatttcacttgcctagatgagtcaagattctgctgacgagtgcctctttctttccagaaactgggaggccatgtgcactcaggtaagatttcaagtccaccaccgtcatgtccttcagctgcaaattacgaattcagaaattacgaaacgattagggttacggttgatttggatttccagagcagaacagctgaacaggacagatcactaggcagaaattctaaagcaggcaaagatcgatgtttcaagtatgagttgctaattgttactagcatagagctcctggctgtattgttcccttgagattacagccttcaacattttatttatgtgcctcaaaactttttgggctgtggtgcatacataagcaaggtccgtaatacattggcatatcaaactgcaagctagcattttgaattactggtggatagaaccatagaggggtaaactactggaagacaatttcttatcagattaattggagcattaagaagatatttcatagtaaaattcagtgcctagagaacactttgttgtcccatcggtaagagcacctgcatgcttacctttccagtatccgcaagttctgcccaattatgtgctgcacttttctctgcagctgcatcagtaagtgctttcctcttctttgaagccccagccttcgctgctgctgcctcggcttcctcttgatcataattttcaccatagactgaagccttaaattcctcgacagctttaactactactggcctgagataagagtggtaggaaacaacccacataagcaagaggtgactgttgtacgttgttgttatgcaaaaaagtaaaactgaattgaatatgtagtagactgcactttcatcttcagtgtctgaaataacatgaacatgcttgactctatagttattcaataatttccattcgagaggaacagataagggtttggagatttcagcagactccaatagacaaataaaaacaagtacctagccaagccctcttcatcaggaagggtttcatccttgacatctggcatctcatcttcacctaaagctaaggcctccaagatcccatagtgtctttgcaatgctgtttcatggtggaaaatagaaaacatgaacaatgatcagaatagttcagtcgtactgcatattggagtgttcataatacttctttaatgcctattgacaggacccaatgagctctacggattatagcagcaattgctcacagatggtatcagaatttatgtatgaaggataggttcacaaatacatgaactcaggggctgtttggtttggtgccacacattgccacaccacatgttaggcatgccacagattgttagcttagcgtttggttgcttgtttcagttgtggcaagccacactttcttatttcatgggcctacatgtcatatactcattttctagccaaacattgccacacttgtggccaacaaattgttggccacactttgtttgccatgccacacctatggcaaactgagttatggcaatgttaggcaacaaccaaacagaccctcaatgtagtactgtcggtaatgatgtgaataagaggttcaaataaatgcagtgattacctgggttagaaaattggcatactgagaagttcttcaaatcaatacgtctcaatagatttgaagctttcttaatttgttcatctgtggcacgaggtgcatcatcagaagtcagatgaacctgcacgccaaggtgaaattattagcttactgaaaagatgaaatatggatgcggtgccaatcattacctcctcaggatatctaacatcatccgagtatggaagatagatcatgtgtattccaggtggttcaatttgaccaccagcagaagtaacctcttcctgttatttttctccagagtcaatttcaaaaagtatataagatatagctatgtaataagaatccctgacaaacaaaattcagacagaatacaaaacgaaaatatgtggccgcatgtgcgtctatatgttatgcatttcacaaaacactttaccagttttcccaattcccacccatgttaatatataggtggctgctgggaatatgtgaaaagaagcaaggctcagtctagttctttttttgtagccaacaggtgtttgtaccacaatcaatctcgaaaagttccaaatagcataagaactttcttttgcaacgtcacagtaggattaacccattagttaacaattgatatatatgttttaactaggtcactgatattgtacttgtaaactagaattctgaatgcagcaaatgtcgtaaagcaaaatatagacatggagagaatccctcacttgtgcaataagggctacaagttgtgggcgagttggattcccgtaaaatgcaagtgcaaacctgaaatggtacaattcataattgtaagttttcaaatgcaccatgtaaccatataaaatgaccacatgaaatatcatatgcatggttagtataagcatgtactaggctacagaggacctttgcctatgcatgacttgcattaggacggaatacatattcccagtcacttagtgtcacaaatacatgacttgcattaggacggaaagcctaagtgacatcactggaaacttacagttcagaaaaaggtgccaaataaacaaaccatttgagcctatgacttaaagaaatatattccctgatgtcaacaacagtatagctttacaaatcataaaataacacctgttttcttcctttttctcattttcttaaaaactcagtgaattgcaatgacaagattggcaaaaaatcccaaaacattttctattgtcatttaacaattcaaacaactctgtgccgctttgtacattatctaccctatagttcaacaaatacttttactcattctttcattctttcattcatcatggaacggtccagattatctcgctgagatctgacgcatcagaatcaacaacttagcaggcggggtcaccagcggaaaatcgcacgcacgggatcaccgctcggtttcctttcccttttctttcgcacaccgcccttcgccctccgccaaatcgccagccgccgccctcacggcctcgccctcgcacgtcgcacccccatcccgcgcctccctccgcaaaatcgccgtcgcacagccctccccgccgacgattcgctccgccgccagaacccagcacaacccctctccggctctccgccaccctctctccatctcccagatccgctctctacatccccaccgcgctccctccctccctccctgcgcaaaaatcacgccgaacttcgcaaatcacgtcgccgtcaccaccgctcgcatcgctgatctaggccgtggctgactggagctgccgctaatatatctgcctcctggggattcggtgtgccacctcgccctcgagcccttccacacaccggcgccccctcaacactagcgccgtcgttgcccttgcgccagcagaggcggtggccggttataggaccaaggacgcgacaacggcagatgtaggagggattttcttcggtcaggcgggcggtagtaagcggcgaggcaaggatgcggaggccgaatgggaggcgtacagcggtgacacgatctaggcaacaaggt

SEQ ID NO: 22536 - DNA, 12180 bp, Oryza sativa
tagtcttctctgcaacaagatctgaagaagtgcgggcaaggagcgtggtccccggcgaatccaagtccgttgaggccttaagcagtaacgaaatccatctatttctagaacttcatctattatttctatattgcagtgtgcaaggcaatgttgtttgtgtatgcacgtaacaagagtgaaactaaggttggatacaaagtgtggaacctctttcgttctaagctggcatccgctgaaggaaattgtggcctccttttttctgattctttttttattttgtgttctttttttcatgtaggggagcagctctggtgcgaccgtgaagttggcagcacagacgcatttcattgagcacatctttagcgttctagatttcttgagtgttctatattgtggccagaccaacaaggtatccatctggcatacagttttctcatttgggttaagtgattggactggtttattgtatcttgcgattttttgtgttaaaaaatattattcagttttcttgctaaaagcaatctatctcttctgtcatccagatgggaggcctcctgtaattacttatggcatcttatgttagtaggcataattatggaagaactggattagcatggataattaatggactacattaattggcgatggttttggtttagttgacattttccattttaagtataagtggaatgcatcattagggcttctatggacacttgagtacctttgcataaactagctaaaaaagcctgtgctttgcaagttgctgctatggtccatccttagtgtttattcactcaaatcttacagatgcacaagagtccaacttttcagttatttatgtttctgttctgtctcgatggataaaacttacaattttaacaaatatgttcttggttatctgtacttgacagaaataataactactactcttttcactttgatagctcttttctgcttctaaaaggtgggttttccatgaggagatcactattagaagctaattcagaggatttcagagcagattttggatgccggaggatggcgagagtgacacatttcagtaatcccctaaggttgctgaattttgttggtagctttatcttttcctgtgtaatctcccaccaacgctgagagctctactctatgtagttcctccttccaatgtataacgtgagttgaatgggttggatttaagtataagtggaataaattgttagggcttatatggacacttgaatgctaatctgaatattagaacatgacagtgccttggcttaactatttgtatggttaaatatgaaaccactaagtaattttgctttgttgagttcatttagaaggttcggagggcggcctgtatcactattcactcgagcacatccttttcaaatgatatcttaggatttgcgggagtattactatttgatgtttctggctcaaactatatgcaaactttatttaattgattctaaagttagatttctgtttttgtggcatttcataagctagccaacatatattttttcagctattttgtcctttggcatatcaaggaattctatctatattatatggttcttcgattgcctattctttttaaaggaaactaatgtgttatgtgtttattttgagttatctacatctaaaggagactgatgtgttatgtgtgaaaattgtttgatgtacgtaaagctcagatcatataatttatttttattttttggctaacatgacgttttgaaaattattaaagacaaataaaattggaccgtagcatttagcacgggcatattactagtgagctgtaatttgagataactatcgcatagagtgatatttcaacaaaactaacatcccctttcaattgcatcccctcactaattatcccaaaaaatgagcagtaatgttaattaatttaatccacagtacattttatgacttgacatacattatgtccatttataactatgtcagtttctaaaccctttcaaaattaaagaaattatggcagaaatataataagtcgacttaaccttccaagacgccgcattgagctatgtaaagcaacgaaaacacgagtgcttccaaatatttgctgcatcaaacaaaaggaggtaaacctaacatgcaccctagatttaagtaaagactgagaaagaaataagcatacaccacaatacaatcctaaatatgttcagacagatttagtttagtttggaagtagcatgcagcagggatgtgtatcgaacacaaatagatcttttattatgaaaaataatatcatcaaataaaatgattaaggttttcaactattatattattgcttcaagctagagaagtacaataatctagggaacaaacgaacaagataacaaaatattgtcaagactacgcagctctcctgcgtgtttgacaaaaaaaattaagatgaaggagataattgtactagtataacttcaaactgtaactcaaacggtagatttgaagtttgtgtattaaattatagtgatttaaaattttaaatgggaacaagatgatttatccaaatgtttatcaacgtaatcacagatccagattcatggatttgtggagctcggaatacccagctccaagaaatcttggatccggagctgtgccaagagggcctcaagattgaagttaagaagtacatgaagtaatgttattacctcatcactggggtaaataaatgttgacggtcttaagttgtgataatctttaaggtagtccagtggcttgaatcctaaaaggcgtagatgatgacttgaaaccctcttcacatcagacaattcacgagtagagaatttaacaattttgctgtgcaaaaaagtgcatgaatatatgataaagtagttttggattacaaatataagcatcaaactgaaacggaaaaggaacaacatgacggaatgacgagacaatgatcgtgccatgactcataactgtagacttctgcgcttgatgaagcaatcaagaagcagatcacagaacccaacccagaaaattatacaaaaataacaccgctttggttcaccagtctcatgtgtgtacttactcattgtacacctggaagcgcttttgtggatcctgaataagggccccagtgtcattgcatatgaaagacctttcagcctacacatacattcttgttaaagtaccgcataaaacttgatattttataactccgaatctccccccccccccaaaaaaaaaaagtaacacaaaattgatctctttgtcatgaagcatgaatcaccttcaatggcaggttgctgatagaatcaagccatgtaattgcccctacaaaaaggatgtcacagtaacaagcctatacatacattctcacagcaacattatgcaaagagataaagaagtaaatatcgccagttgttagagcatacctggagtagttgaacggattagcgcatatgtattcacctctatgcaaacatcattggtaattgcaaatgcaagagttttgactttgcgtttcttcatcattcgttttttcagctgattagtcatatcctccagccttcaaagaagacaatactggataagacaatgagaataactaggtctaagctaatctgtgccgttcaaacaatagaattctaaaattactagggaccaacagagtagcttgtgcatattaatagatgactaagactaagacattgatggccaagagtagacattactgaggtttcttaatatagtgtaagtcggtcattactattaattagcaaccatacagaggttcaagtttagtgcaacattagttcatatgagaaacacccagaggctacttcacctaaatcccatacacgatgcccaaaaggctggaacacagacaggaagctattcaactttgaagattttaacaatatactacagggaactccaagcagaactgccacctactacagaaaaatagaggacagcattgctacgtctaattctgtagcacaggttatctccactcaatgatggatcttttgttccgtactttggtaatgcaagcaaaagatggtatatagtaaatctgcaactatcaactaatcactaatcagaaaacaatcaacaagtgaaatcgatgcttagggagcaatacttttcaccagaagatggcagataatccactatttcatctccctccagaccaattaaatcctgggaaataggtgttgtttagccgttggaacttaaaagggttgcgcaatatgtgataaaagagatttactgcataaaacagggacatgttgaactcctcatcgggcctactcaaaggaagaagttcaatggacaggccaagatcttgtgcatcctgtaggaagacaatagacaattaatgatacaaaggccactaagaacatggtatgttgttgtgattcagcacgaaattgaacatatatctgtcataggcatactcttgcacgttggattgttgtccttatcatatcagtctttactgctcctgtaagaccaccaaaaggatcatcttcgttggtgaatataacaatccgcttactcacagtcttcacagatctgaagaatttataaaaccaccagcagaatgttcattcacttaaagtatttaaatatcctcatcaacattcagtataatgcaaatggtgcaaaatgcatcatttttgcgcaatatgcgaaaattttaaatttgttgagtgcacctgaaaaacaggttgaggtatatagagaatatgttaaagctctaatagaatttgttattaaagctatgctgctttttagagctgaaggagggaaagtggtgtgttaccctttacgcagcaatgcctgtgcaacccaaaaagcattgtacaaggtattctctcgagatccaaaagttattccgtaccgacttccaatattactcataaaagaatctaccattaatcaaaataagctttataatcatgtcatgcaaaaaaagatgctcaattttgctacacaataagtatagcaggccaattcaatctacctggactttcagacaaaataaatataatataaaacatcaatacgaaatagtgatgtactgcttctaatgagatcttggagtcaattttacagaagaaatatgatattatcaaaccttaagttcctaatgggaacagagaagcaactcaagacacagataacagatcatgtgttcgactttctaaaacactaggcattatagtctgttaaataagttttgagaagaagatagaacatataaggcagcacaaattgtaagctagaaaatgcaggtggaataggaatggtgatgatgtggcaaaagaaaatgaaaacccaaacaaattctacagatagatgataggaaagattgcataatcacaaatttcacaatttctcagaatattttgctaaaagaaaacaaacatgtcaatcctataatattccatacaagtaatgaaaggcaagcgttcagttggacaattcaatgatgatctatgaaccatacctagtacatgaaagaagtaaagcatgcatatcccacaaaccttgaccacatcaccacattcatgtattgagaaaagaacaatttatgtaattacattaccttctatacaagaaaattccttaatcaatcttgcatcaggcctatcaagtggttctctctctgtaacattataaacataaacaccagccaattcctggaaattcttcttttctttctgcaatagttatgtaaaaaccagatcaaacaagcatatcttgtaatgacataaggataacgatatacagatcctacattgttaatgatctaaggatagtgagtgggataagaatatcatagattattttaccaattatctgagaatcatatatttatatttataatctccatggtgcaaagtaacaaaattcagatcagcttttcaaccaattaagagttactgttaccaaaatatagcaacttgtctttttttttcttccttttaccacttggcaattctgattcttttttcacattttaagtatgttcatctgtcaagcttagaaaatataattaattaaaactaacaagcaacagtgtggtgtagacttacaacactgtggatgttaaatacttgtagaaatcatagatttaaacagcaaagaaattaactagctgactaatagaagcagagtcatagcaatatataagatgacacatagttctttaattagtcttaccgtgttaaagaaacatatagcgacttcatcataggatctaccgataatctgcgtcttcagcgcatgtgtgatgcagttcactatcgtatgaaaatgtgtctcctccttttcatctgcctgcaataaatggcagaaaaaacatgcttaactactacctagcaaaagaacttgattgaacatagacaatccaatccagaccaaacatcacagataaaataatcggtaaatgtatcatcccattcccaatatccatcgctaattgcaacacttgagctcgcacagggcagagagatttatcaaattaggcgctgaagctgctggaatttcaccttggtcgcaggggtgaacatcttgggcgaggcgtcgatgaggtagacgaccatctccttgttggcctccctctcctgttccctccaagaaaccaaaccgctcatcaattcacaggattcgagccacagaaaaaatgggggatagggaagctcgaacagggtggaacgcgacctggacgttgtcgtcatcctcgtcgctgtcgtcgcggaagaggccctcggggtccagatccatggcgctcgaccgagacgacgcctcgggcaccttctagaagcttctggaagccaactagggttgaggtcgcggaagccctagggttttagttaggcctccaccctccggctccgcttcccttgccgtcgatcaactcatcatcgcggtgcgtgggccttcccactcccacgtgggcctcggcccaacacggcccacgggccgaccaaaaatggaaagttttcccgcctccgaagcgagcgttcttcccgagtccaaattcaaaatcaaaaaatccaaccgaaggacaactgtataaagtactccgccaccagtatccccaatcaaatttcagttactacagcattcaaacgccctggagcgaaagaatttcgcgaaagaatttcacaactcgaatcgctgattatttttgcacatgaaacattcgcgacccatcagtactactagtacggtagaattcccaaatccaaatcaaccaatcaaggcacatgaaagttacaggcaaatctgaggtcagcatcaaaattcaagaacgattcacaaagagatgcacgagagattaagacgaaatagatatttgtattatggtttttgaggatgatgggatcctatcattacaggcgagaagatgatgataccgcctagagggaggtgaaacgaactaagacgaacaagcatttacagaacacaatttctgctactacttgctgatgatgatgctaatggcgctgtcgcctgtggagatcaaaaggtgggcaatccaatccaggtggcatcatcgccggcgacctctacttcatgctcttcctcgccgcacccttgcgagcagccggcgccgcagccaccgacgccttcttcttggtcgccgccgccttcttcttggcagccaccggcgccgccttcttggcaggcgagtccttggcagaggtcttggcggacttggcagggcggccgcggggcttcaccggcgaggtggcggtcttggccttcgccttgggagacgccttgggcttcgccgccggcgcggcggcgaccttgatcttggtcttggtcgccggcttcgcggccttggtggtagcaggagccttcgccttggcagccggcttcgcggccttggtggtcttgaccttgggcttcgtggcgggggcggccttgggcttggcgtcggcggcggccggagcggcagggcgggtggaggagagcttgaaggagttcttgaccttggccagcttgccggcggcggtgagcttcttgaggttgccggagaggagcttgcggaagttgggcggcaggttggcgccatggttggcatggatgtgcttgccgatggcctgggagctcgatccagtcctctccttcagcgccacgatcgcctccatgatcatctgaaaaaaaccccaaaacaaaatcagatccaaacacgcaaaagcaaacgatagatcgagacgaatccaaaacccatccgatgatttcaatccaagaatccccgcgacggcggagggttgagacggttagtacctcggcgtacggcgggtgggcggcggcgacgcggggcttcttggccttggcctccttcaccttcttctccttcgccggcttggcctccttcttctccttcggcggcctgccggccttcttcttctccttcgccggcttggcggccttctcctccgccgccgtcgtctcctcgacggcctcctccgccgcggcagcctccacctcggtcaccggaacctcagggacaacctcctcagtcgccattgcagcacgcccctcactcactctcccctctactactactcgcaagaaatggtcgcgactcgcggcggattgcttccgattctgcggcggcggcggcggatgtgggtgaggaggccggaggcgaagacggcggcttaaatagcggagacgagtggaggactcgggtgacgcagctgacgcgctgtgattggtcgagacgcgatcccacggattagccacgcggatgcgcgccacgatccaccgcagccgtcggatcggaacccatccgacggcggggatcgctcgacgcgcccgcgccacggattccgcccacgggatggggctacagccgccggccgctgttccctcgtgtgtttctgccccgactttgcgagcaaatatctctctccacgatggatatttcacgacgcggtctttctacgaattttagttgctcaaattagctttcgaacgagaccaaatttgtggggtttggttgagagtcgagggagaaatggctcgatgagtgatggttggttcgtttttggaaactattgttactggtgtgcttctctcccgacttcgagaggcgattcccgtcgacacgatcgaccatttcggctgagaccactcccgttctgtagagccagaaactagctttcgaacgcgaccgatcccgctcgatttggtgcagggcagcgccggcaatcggcgattcggtgacggctggtccggtggcccgtgtgactgtttggtcgccgccggccgtgctccgtcccggcggcgcggcgagctccggcgaccgtgcgatggatggatcacacggtttctgtgcagtgtgtgcgtgtgcgagcctgatttttttttccgggtagtggcatcgtgacaggtgattagtgaccgtgtatgactcacaccgtaaggattcgtgcaaatccttgtgtgttgcttggtgggggttgggctaccgaagaattgcgaaagttgtacatgttcaaacttcctcacgattctgagagatgattacaagttaattttgtgagatggggagagatgggaagaaccaggactcatgagatatgttggttctatagaaaaatgataaatgataatagtatataccaatcgactactccctccatctcaaaaaaccccaacatagttagggatgggacattacctagtccaatgcatctggacatatttccctccgtccaaaaaactccaacatagttggggatgggacattacctagtctaatgcatctggacagacattacctagtccaatgcatctggacatattggactagataatgtcccatccccaattatgttggggtttttttgggacggagggagtacatatttagcaaaaagattgagattcttaccttctttctacttcatgactggggaggaggataccaaaaacggggctggtgaataccaactccatttccgatgaaaaaagaaagcatgctcggttagaatttccttgagatttttgcaagatgattagctatctataaggtaattttgtgagatgaagaaagatgaatagaagagtggggaattgatgacgttatatgtagatatatggaaaaatgatgtgtaacgatcacgtagtcgtttaggagaaaaagattgagtttcttaccttctatttgtttctccacgatccatatagggagatgaggtacaccttataccaaatatgaagccagcgcatcccaaatccacttccgacgatgtattatccatccaaaatatgggctctaccttgagttgagtttttcatatccacttccgacgatgtattctccatccaaaatatgggctctacctcgagttgagtttttcgagctaccaaggagttgcctccatatcaccctgtcttggagtagatgggggcatggcaaaggggcactagttgagcgacagggtaccgactagacaacctattgggaatagaggggtgtggggagaaagaggggagatccaggggagaaaggacacgatgacgagagaagagaaggagagtgaaaaggagatgaagaggcagcgcggatttgggagtggtagcgattaggtctagagggggatatgggtatatatagacaaaacgactatatcctagtcgtacgatctctgatctaacggcctcaaatttagccctttttcacgagaaaaatgtaatggaattttttcatgatttgacactcctccaagtggcattctaagatttgacaccgcgcagctcatattttaaccttagtcccacatgtcatagacatatattagcaaatcttgaattgtcattgtttgaagtggcaaatcctaaagccccaatgaagtcaaaaacaattgttgtatagaaggatttggattattctcatccatatcataaataaatttcctccatgtagccttgtgttggttataacctaatttggatactaatattgagacagaatgtatggcgttatcatggcacgtcaaaacaaagcaacaacacaacaacgcttaacgaagttatgcaaaggtgtttcaattgaatgtaaaaacaaaatcgatttcatgactgtatgccaacacaaggtaataacttgtctctcatgcacccttcatctttccattcatttcctcgtccctttctctctagctatcacatccaagagcccccacatgtcatcaacaatgtccaagcttcccaccttgcagcacacatcggacttgatgtcacatacttgcattcatctttgtataccaaactggaaatggtatagaaaagcaaaagattgtgatggcatatagctcaaagactacatgcaagcacttgcaaggcaccagcaccatatttttgtgaaaagaaaggcacaaattacggtggatttacaacaatactatttgctaataaaatagtcaattctaagcaatgagcttgtccaaaaatgaatatttgtcatcaacatagcatccattgatcaatacaaacaaatttaccactttttctaccacatgccattgtagacgtagttactacaatattctttacccgcgtgaaaagatgaaaatgtcactctgtgggttgacatttcttctaaatctctctctccattgccctacgacacaacctaaaatgccaagagaatggcacacaaagcgcaaatgcatgatggatgtcctggtgtagcatgttattataaattatgttagacgaggggcacacaaacttgtcaacatgtctaaactttgaccaagtgagtggagctcaatcaaactttagggtgtaggctcgagctcgaagtatacttgagctatcatcctaatacaagtaggtgttggtatttattatgcacacaaataaatttgcaaagtacggataccgctgtagcactttacctcagagtattccaggggtatctaatcacagggaacgtgtgtgcactatctaagatcgtgattcatccaaagacaaaaaccaaatggtagggttaggatagaggggattcctatgggtaattatcttaattaagttaagatataactctatcagttgtttcggacactgtcccttacctggtctgctagaatgagtccggccttaagctttatgatatacccgaacatggagggatataaagcccgaacaaag

SEQ ID NO: 22537 - DNA, 779 bp, Oryza sativa
tgatcagggcgcccgcacgatctctactgcgcgtatccgagccggataagtcgcgcgtacttatccggactccacgccgtttgcacgcaccggatttttcggaacgtttccaaaacaaaaacgaatccgaatttgcagcaaaacaaaactgcaaaaggaggctgcatctgcgcaagggtgaagagccaatttttcggaccattcgacgcgtacgtcgtgcacgcgcgccgcctgccctgccaggccaggccaggccaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaagacccattcattaattccaacagcagcaacagtgcgtcgtcgtccccgccgcggggggagaagtttgcggacaggccgtacagggaatactgatccttgtggagatcgcggtggtggctcgccgccgacgactggtgttcgtcgggacggagagctgcctgagcccctgggacgacgacagatacctctgcgcgttccggtgggaccacgagctgcggttctggcgccggccgccgggacaggagcttcggcggccgcgcgctattcctcagcgccggcacggcgttcttcgcgcgacgcgaggatcctgccgtggtgcgccggcgactg

SEQ ID NO: 22538 - DNA, 445 bp, Oryza sativa
  unsure (1)..(445): unsure at all n locations
ttcccggcgaagccgnccaaagcgccacgctgcccgcgcgcgcgcgccgaggtggcttttctgacagncgccgccgccggcagcgcgggcctttcctgtccgcgcctgaggcccgcgtcgtcgctccgctccaaaccgtccaggcgacatcggccggggcatcgagccagaccccgccactcggcgcgctagcctccaagggacggaggcagagctccttctccctctgccgcgtcgaccccgttgcctcctactttgcccaaagtggcaaggggcaagcccccttacttgcttccttgggactttttctattcctacgacggcgtgattcccctccttactgtaggcgaattgaccgctagccggagcgccagctcgctggcttgaccatacaatgtaggtacacgtatactaaaccgacattgccgaccatataaacccaaga

SEQ ID NO: 22539 - DNA, 4784 bp, Oryza sativa
ctcaagcttatgtttctgacattagagaggttacattctttgtcctccttttctatgtttaaattctggtgtcatcattaattcattgctgtcattgtttgcaagatatttctccttacattggctttgatactttttctggatcaggtatactatagtgaaaatatagttaaagtgcctgtggatatgatagagggaaaatgtgaggtcaaaaagaagatcgacatctcaaactcagatgttccagtgatggttgaacatgaatttttctgtgaacatttctatgatcctgccactggagcattaaagcaggttagtcaatagctaatgtaccatttttattcagcaatgttagtttccatagttaactgaatgtgtgctgtatatatggaccagttgcctccaaatgttaagctcatgtctgtgcaacaaaaggcaactggcgctttgaaaaagaacaaaggaaagcagatctgtgaaagtgatcaggtggattcagataaatgtacaaaggtgtccaaagagaaccgtcttgcaactcttgacatttttgctggctgtggaggtttatcagaaggactgcagcaagctggtatgcactttccttcaataatggtgtttagctttatcatcaacatgtcggccatcagactgatattttattaccatttaaattctgtaggtgtatcgtttacaaagtgggcgattgaatatgaggaaccagctggtgaagcatttaccaaaaatcatccagaagctgcggtgtttgtggataactgcaatgtgattttgaagtaggtgcaccgtgcacttccttgattttttctgtggttttctttttacctatatagctcaatagggactgttatatgattttgcagggcaattatggacaaatgtggagatgctgatgattgcatttcaacttctgaggctgctgaacaagcagctaaattttctcaggacaatattatgaaccttcctgtccctggtgaagtagaattcataaatggtggtcctccatgtcaggtatattattttgctatacttgatggaattttctttgcacctaggcaagcaaattgtttgcacttcaatacttgtgataaatgacttcaattttgtaatttttttctcaactaaggcttttctgggatgaacagatttaacccaagcccatggagttaagttcaatgtgagatgattttagcattcctgtcttttgctgaatatttccgccccagattctttcttttagaaaatgttaggaactttgtttcattcaacaaaggacagacatttcgactgacagttgcatcccttctggagatgggataccaggtaattattcttctggttatacatacttaaaatgcctatgtacagcatttgttttgaatcttataataaccagaagctgtttacttgttgcttaggtccggtttggaattttagaggcagggacttttggtgttgctcagtccaggaaaagagcattcatttgggctgctgcacctggagagactctgcctgattggccagaaccaatgcatgtgtttgctagccctgagctgaaaataaatttgcctgatggtaaatactatgcagctgcaaaaagcactgctggtggtgctcctttccgtgcaataacagttagagatacaataggcgatttaccaaaggtggagaatggcgccagtaaactcctacttgaggtaaaattgcttctcctatatggctatccgctccattttatcctgtttcttctcttgatttatatgctgaatgaatcccctcttttgtaatgcagtacggtggcgaacccatctcctggttccagaagaagattagagggaacacgatcgcgctgaatgatcacatatctaaggagatgaatgaactgaacctcatcagatgccaacgcattccaaagcggcctggttgtgattggcatgacctaccagatgagaaggtaaatgccatctaccttgcggttgcattcacttccttttgtgctcttccatacattccttgcatcagcggaatgttaaccattatgagcgtgtgcaggtgaaactatcatctggccaactggtggacctgatcccttggtgcctgcctaacacagctaaaaggcacaaccagtggaaagggctttatggtaggctggattgggagggcaatttccctacttctgtgacagacccccagccaatgggcaaggttggcatgtgcttccaccctgaccaggataggatcatcacagtccgtgaatgtgcgcgatctcaggtaagctgctattgctatccatccattcaacattctcttcctgtcttctaagatattgtgaatttggaggggagtcagtactgaccgtttaactaacctattcttgtctgcagggctttcctgacaactaccagttcgcgggcaacatccagagcaagcacaggcagattggcaatgcggtgcctccacctcttgccttcgccctcgggaggaaactgaaggaagctgttgatgcaaagcgtcagtaggtgctcagagtccttctccgatgatcgagggagatgattctcccctgaaaagaaacaaacaaccaaacatatgagtgtacttattttaattgtgcgctgcatttaactttgtgtgttgattaagattttagtcatatagatccttggtaaccttgtacattttagaggttgtgttgtgattgatacccttgattcaggggtatgatttagtggctgtattcagatatttaaacaaaataatactagttagtgatggttgaattgttaccgtgggttatctggaaattcttgttttggtttgttcaggtctctaaaattttatttcagtttagtttggattttaagaattgaggtatattctcatttggctggatgcagtggaatctagggatttccatgggtcatggggtgaaggttttacttttgcatgaaactagaaagctagcccgcgcgaatacgcgggcatgcattttatttagttttgaaaatagttctaacaaaataagttgaaactaaagtaaggtatttttttaattgaattttcattgtttacatttttcttaagaagtctcgagaaatttttattgcttgtaaatttattcttttaccatccctgttagccctctttttaattgatgaaatatacatatcttatatagcgcttctcagtaatatgttagaccttatggtattttaaagaaaatgtctagtcaacatgaatcttaaaataataatttattatggaaaaatataacttttaatcatattataataagaaaggatactaatttgtattaccaccttagaggcttatacatgtaggttgtggagaaacccttggagctacttaaaggataggaatttactgaatttgaatttgttgatttatcattgactttcatctcttggtgtgtttaatatgactcatatgaagagaaatataaaattttggaaagaataaaatatcattatgttgtaaaataagctatgtttttctgtaacgaaagtagtagatttattcaatactatcttacgggttaagtgctcaactaaaatagttgtatacgttacataacaggttaagcacttcactaaaatagttctttgtaaatggattgcaaaagttattttcaaagatgacccatgagtctgaggcaaaaggctcgccacatagcaagctacacatttgagccacatgtgaaaagaatgctcacaaacaatcatttgtgcagtagtgtgattaaaataattatttatacaattaaaatgtttaaattcactatgtaaattaatggtacttgtgcccatattattgtttgccaacaatcgatagaacttgatagttcttttcggtatatagcaaaattagctagatattttacaactaattattgtatttcgttgctgagatgcacatgctattttttttctttatgttgcagtttcttattgttgatgaactgatgcctgggtgcatttgacactatacatattccaaataaaaaagtctagcggaatctaaattgatttcggattgtttcttgcatagtgcatgagacttcacataccccacgaatataatttcataactaaaaataactcggcaagcgtgattattattgtagtttggacttttcatgattgccgtcatgatttaaatatttttactctaaaatttataattaaacattaggaatttatatgctccaaacaatcactctttgtaactttcttttagctaacgtgcattaggaatttagtattacaattatgggtaaagtgttacccttaaattcattatattttagccacaacaaaaaggttaaaaatcctgacggccttaagagtataaatgtattagaattttgttttttcttcctcccaatatgtaatgaatttgaatataagaccttacatatagatataatactactaaaagtacaaacaaaaaaaattccataatttttgggatatataactaaaacattatatgttctcaaataactgatagtaaaaaaattgttgttagacttgatactgagatttgtgacaaatgaagtgattattaagaatatggttacatgtggcagttttttttgtaattaatatataggtaatatcgatgctatatatattatttatagaatagatacatcatatgttttataaagttttaaatagtgaataactgaagaaaataagggggtaaggatagatcgctttgtaggtgattttttttctttggca

SEQ ID NO: 22540 - DNA, 5358 bp, Oryza sativa
ttaattgtcaggaatataaagaatcaaactaatcagaaaatcaacatatatttttcaaaagttaatacatgcagatccactcatgcatgtagccctccatgaggaggacactgacgtataaccatggaagtctatattcaactgaagatataaatttaatgttgtttagattttattatgctttagatctcaacaacttacagagaaaagagagagcagatagcacatatacgtgcttgagccgtgagttggaattaatcttggctggtcgttcaggttcgtggttttttacaattaatcttggctgtgagttcttttccaatcatacgtaattttttgtgtttttttcttctttatttagatctttggctttttttttgttcggatggattaattgtacgtaaatattttctctcgtacgtgaacaggatattaggagtgagagactattttctttatagatctaataatttattggtctaaaataatgggtccaccactttaaatgaaaatcaaggttacatgttttacttttttttaagaatttctatgattattttctaatttattatagcgccacgtggtggcatagaagcgattgtagattgccacatggtgacttgagagcgtttataggaagttttatggacttttagtatataatagatagatgaatggctgataaataacagtttttaattggtttgccctcgtatgagggttgcttttactctggtgagaaagatcaaccaaatttcaaactcacgacatctaacttagatgccgtattgagttggagtactcagtatagtgtgtttgggatttcttcaaaatctgaatatctgattttttttttaaaaaaatgttgttctccgcatgtagtataactttgtttgttccatggtgaaaagttttggcgtgtcacatcggatacgcggacacacatttgaagtattaaacgtagattaataacaaaacaaattacaaaatttgcacgtaaagtgcgagatgaatctattaagtctaattaatctgccattagcaaatatttaccgtagcaccaccttgtcaaatcatggagcaattatgcttaaaagattcatctcgtaaattagtcgtaatctgtgcgattagttattttttaacatatatttaatatttcatacatttgttcaaacgttcaatgtgacagggtgtaaaatttttgggtgaaaaactaaacagagcctcgatatgcctcaacaaaatgtaatgcattcccgtatcccacacataacaactgggtttttattttacctattcatataagcttcatgacaatgattttcttttcagcggttacaaaacaatcttgccaggtaatgctaatgccatctcttcaccaaatgtgaaacgatatgttgcctagtaattgcagtgacttgagtagcacaccaaggtcttgagttcaaatctccatagaagtgaatttcagattgagttatttgagggctagttccttgttcgataggctaagttcctattaaaaaaatgctgcatatatccgattggatatagagaccgggtaaaaaataccattctctaaaaaaaaatctcttcactaaatgagtgcagtgccttgctttgtgtttgccaattgaagttagcaacgctaccccattgcacaaaacgaggcgacggtttaacgtataattaattaagtatttaagtagtagtgaaaaacttaaaaaaatggaataataataatatggtttttaaaacaattttattaaaaaaatatagcgtttaacaatttaagaagcggcgaaaaatataagaggtgaagtgaggaaaacagagtaaagaacacagtcaaaccaagaaaattctatcaagcctagcatatatccagacacatgcgcagcgtgttcgtgtctaccaagtcgatatctgcggagccacacgaaccactctctgtacacagttacacagcctacccgcctagaactacaagtaaagtatctctatataaggcaatgaacgcgccgccgtcaacaacattccatttccagaacctccctgctcccgtgcgccgcgcgttccaccaaccccgctcacctccatctccaatggcggccgagccggccgatctgtacgtggaggtggaggagtccgcccgcgacgacgacgtcgacgtcgacggccgctcccgcgtccccgtccccgtcccctccccctccggctgggagctcccgccgtgccccgtcctgcgcaacgtcttccgccgcctcccccgcaacccggacttcgacggcgccaccttcctctccaagccatggctcgagctcccctgcgacgggcccatggtgatcgccgagccgcagcggctcatgccggcgctgctgctcccggaggggatggcgctcgacccggcctcccgcgccttcctcagcctcgccgacgggcgccgccatgacatcgcgttcccccacgcccgcggcgcgcgctgcgtcgggagcacccgtggctggctcgtcatggtcaggaagggccccgagggagtcgccggcgccgccggcaccgccaccatccacgtcgtccacccgctgctcccgcacctcgagttccgcctccccgacgagttctccctcttcgagatccaggtcaccgcgcccgaggagcgcttcctcctgcgtctgacgccgtccgagaaggcgcgcattcgtgcgggcctccccgtggaggagacgggcgcggagttactgcagcgcgtgttcaagacggcagaggggttgcgcccccccgagccctacatcaccgatgtcacgctctcgtgcagccccgccagctccgacgacgactgcgtcgcgctctgtgtctaccgccacggccgttgcctcgccatcgcgcgtcccggggacgcgtcgtggacgcgcgtcgaggtgggctgggaatacatggagccgcacgagtacaggcgcgagttcctgagcgtggtgcaccacaagggcagcttctacgcggcgtgctacgacggcatggtgctgcgcgtgtccatcccgccgcccggcagcgcgtcgccccctcgggtcgacaagttcgcggacgcgccacgcagggagagcatccggtgggcgcggtggtggctcgccgtggacaccgcatcctcctccgccggcggcggcgcgctggtgctcgtcgcgaccgaacggcgctggtggaagcagaagatgtacatgtgcgcgttccggtgggacgacgagctgcggttctggcgccgccccaaggacttgggcgggcgggcggtgttcgtcgggcgcggcacggcgttcgtcgccgacgcgcggcacctgccgtggtgcgccggcaactgcatctacttcacccgcgacgagcgggtgcgcaccggcgacgacgtgccggtgcggtgctgcgacgtgcgccgccagaagctctactccgtccacaatgcggggcccaaggtggcgatggccccacctgtctgggtcatgccgttccatgaatagcgcagagattttgcatcagagagatcataggtactatgtggattgtggtgatgcttgatgtaaattctctctttgagacttttggctgaatttcgtacgaactacgtgtatgtttgtcataggaattgcagattttagatcgcatttctggagtaaatttcctgcaaactgtaggcaagttgttatagcaattgaggaattctggatattgagaacttcgtgtgcctgtgcaacttgatagtactatgcattgagctgacacatttaagccggttctgaatcttctgtgaattttgctctgttttctcaccttttatacatgctagtttttcatatttgaagatgtgtaacattgtgttgtgtggcaaaaatatgtggcagttttcattgatacggtggtgatattcactagcctaggtcatattatgcatcttttggtgatgtaaatagtataccacccagttaggtctatgtcaacaaaatgcaatcaaaattattgtggaatactccataatttagtgtgtcgttcatgcgtttctaaaagttgagacaacaaataaccgatttgtctagtttagacaaaaaaaaaaagactccaaaaatgtttgatagccaacagtataaattttaccctcaatagagttacctcgactgctaggatgatttcaatacgtatttcatggccctccagttatggtggaccgtcctctcgagtctcggcctcccacattgctttccctctgatgctgtttccttccatgagtggcactactcctgccgactcaaagtttggagggagcgtcgtcgtgggttcaacatggtcgtgacccttggcgcgtggtctatttggaaggaacggaacaaccgcgcgttcaacaactgttctcggccctggttcgaggtggtcgtaggcatgtcacaagaggccgccctttggcatcttgcccatcccctgttgccaacgctttcttcgtagcgtgctaggttgtttggtcatctcattgtaatcgcaagaataggtttaagtcctccttttcttccaacccccctccccctcatttttttgttttgcctaccgtgtaaattttattcctcttaaaaggtgcgcaatctttttgcatattccaaaaaaaatacgtatttcatggggaaaaaaacatggacactaaggaggaacttagagtcgacaatttcgactagagttgagcgtggcatggagattttatttaagaagaaataaatgtggctttgtctatagagttttgtttaaaaaatatgtggcaatatatatgactttaggggaacattccaaagtcatgtgccgatgtatttagcttcttccaacatagtttcatggcaactgctaaatcaaatactacctactcttctccatagccgtatctccttgctctaattgtgcatggttaccaaccaaccgaacatataatatttcttcggattttggagtgggattgcagaactttcaccggaaatggtacaatttgtagacaagacagaaaacattcctgggcttcaacgagaaattgaccacgcctaaatgacttagcgcaaaaatgacgcagcgtaaatcaggtgtacccgtgggacccacacgcagtgacacggttttttctcgaaactgtgcgcctgtgccacaacgccgcgcgacgcactctacacagcgtccggctatataatgcctggcgcgcaggcgcagctagcccaccaacccatcgtcacccacacaatcgcgcacatccgcaacaacgttaatccgcacccttcattctccgccgcgggcgctgcctcgccaccgcgtgccgaacatacaccaccgcacccacatgttcat

SEQ ID NO: 22541 - DNA, 50335 bp, Oryza sativa
  unsure (1)..(50335): unsure at all n locations
acgtttaataccacaataattcaaacataaatatttctaatgcatataatttaaccacacttaaattcacaatttcacacaccacaattcaaatccaaaatcaaaattttcaaacatgtaaatgcggtgtgagcataatgccatatacaacaacatgcaactaagattcataattcaccaatgaaaatgaaaattgctcaccaacatgtaatttttttttgtctccatatcaccacaataagctatgtgaatccggtgatgtattatataatttaaaaataacacattctacaaccatgaatggttcgatcgtaaaaataacacatcttacaagaatgaatggtttaggggctgtgtttaggtcctgctagagatgctcttaaccataactccataaacaagtatgaattgcagtaatgcaaattggacccaatagagtgacagtgtgtcagtgtgactggcaaccaatcttgtggcatcgataagtggatcaattagcctattcaagtttgtttctcaatcttcattgcaagcaaagacatgaatgtcaatgagacagtagccgtggaaaagttcagtgaatataccttgggaagtttatcaaaatttcacataaatgtatgtgtgatttcactacttcagggtcctcgcctacaaccattttggttgtggccaccgaccagcaattcgaagtgtgatttgaagcatcggccgcaccatgaaaccaccactacgactactgatggcttgctgagttgttagccctgtgatccatctcgaggatttacaatgcgaaacgcggagccacgactcgggataattggtgcggatgaagaagaagaggatgccattgtctgaagttgcagcgccaacgatggagcagacgtggtggcatctccggcgtgcgcagtcgatgtggttgctgctgccgcctcctcatcagaaccctgtggtggaagagcgagctgaacgggttggacttgccaagaattaactcgtctgttcatcgtgggagcgagcggggagtcacgatcccagtcaacctgcagatcgatcgagatatacatgcaatcagattgatcgatcgatcgatcaaacagcaacccagcagcatgtcgaatcctggaaaatggtgatcaaagaactgaagaacaattgattttgtcaggcaattatacctcgagcatgcgccactcgctccggcaatggacgtccctgacggtgccgtacaccggtggctggctgcggcggcgcgcgtcgtcggggttcatcagtaagcgcaccctcgtccccggagcgagcggcggcgagccttccacctcctcgcggcgcaccacgaactccgccgtgccctgccatgggcagtaggtcaccctgaacggttgggcggacgacgcgtcgagccaggcgtccgccacgtgcttgtcggggatcccgaccggcatgccgccgtgcggcttgcggcgcaccccgacgagcggctcgccgccggggcggcggcgcatgaagatcacggtgtccccgacgcagaggcgcttggccttgacgaacgcgctccagccggcggcgagcgtgtgggaggaggagcggcggtccgtgtcggcgtcgctccaggtgtggccgaactcccagcggccgccttgcaggttcgtcacgcggaggtccgggatccgcggaaggacgtgctcggcggcgctgggcttggggatcacgaagagggcgccgctgccgccgccgttcgccgcggcgtcgctcggcgacagcttcttgtcgaagaagcagaactcccgctggcctccgacggggtcgcgcgcggcgggaagcgggcggtgcgtgacgtatcagtcgcccggaaagagggaaatcatggcgtaggaatcatcggactgggcgtcgacagcgaatcgatgccggtgacggtgcagcgtaagcgatggcggttgtccgggatcaggcacgtcgtgcaggtgtggcattgctcggcgtggccttgggggaagtagtagaccgccgagccgacgacggggaggcggccggagtacggcgtggcgcaggcgagccagatgtcgtggtcgatgaccggcaccattcccgtcgtcgtcgtcggcggcggcggcctcggcagcgccattatctgaacttgcggggtggcaacaatggcatcccgaattcgcacagccgaagtagttgctgctggctaaggctgacgcaggacttgccaagaattaacttgtctgtgtatcctgtaggagatcgggaaggccgcttgatcccaatcaacctgcacacatgcaccgatcgagcaatttcagatcaacgatcgatcaatcatctcaacatgcaacgatcgaattgatcgatgaacaaatcagattgggtaggaaggggatgatgagattatgaaattaatacctcgagcatgcgccatgggcgtagatggtcgaaggtcctgacggtgcccgaaatcgattgggcgatctgcagcgggttcatccgcaagtgcaccgtcgtcccgggaacgaaagggtagaacggcgagaaggagaagccgatgtactcgtcgcgcgacaccacgaactcgaatgtgccctcccgtgggtagtaggtcacctcgaacggcgtcacgccctgcatcgtcagccacacctcggacaccaccttgttgttttcgaccccgggcctcgggtggtggccgncgcgcgcgcggggcgcgcgccgcaccccgacaagcagatcgccgtcgncgtcgccgtcgtcgccgccgcggcgcatgaagaccacagtgtcccttgtggcgaggcgctttgctttgacgaacccctcttcagcccgtcgttgtcgttgacgccgaggtccccgagcatgtaccgcagcgcttcttgtcccagatgtgcacgaactcgaagcgcttgctcgcaagtccctcacgtcgaaaaagccggcggttctggtagncgacgatgtcgagcggcgtaagtacgtgctcggcgccggcggggaggacgagggcgttgctggtgacgtcggccggcgacagctgcttctcgaagaagcggaaccccggctcgccgtgggcggggacctggcgccgcgcggtcgtgtcgtcgtggctgcctggaaggagggagatggtggcgtacgcctcgccgctctcggcgtcgacgtcgaggacgaggtcggcaacggtgcagggcacggggtggatggggtccgggaggcgggagagcagcagcgcgggatcctcggcgcactgttcgatgtggccatgggggatgtagtagaccagtgtgccgacgccggggaggacgccggagtacgggacggcgcaggcgtgccagacatcccggtcgatgactaccggcggcgggacggcggcggcggcggcggcgtcaggcggctgcgccattgttcgatctcctccacgggaggtagtggaagtggtggaaatgtgttgaattcgaaattcgaattgacgccagcagatggggtttatatatacacgccacgccgccacctccacttcgttaacccttctcctttcgtcttgctaattacagtgattaatccgttattacatgtttctttcttgtcggctacgttttaaatgaccagttagttacaggcttacagctagccagcgtccacttgcacggttttttactgttatttcttttcgttttttctttttttttgcttgggttacctctctgcaaggaaaaatatcagtaaaaaaaatcgtctacattgttctggacggaggaggccagggttcaaaattttagaaatatcgaaccccgatatgatatttatttcggcagaaaattttaatgtttttaattttttcatgaattttaacaatatttgttcaaatgtgactaaatttcgttcaaaatatcggaccgaaattttgaacatatcgtcatatcagcgtcccgatacaaatacccacttgatataggaaacagtaaccgtcacctcgcctcgcctcaaacctcaattcgacaaatccatctcccgctccacccaaaacccctcgtcctctctcccggcgacaatggcggcggcggcggcgccgctcgccgacgacggcgacgggatcgtagaccgtgacatgtggctcgcatgcgccgccccgaactccggccgcctccccgccgtcggctcggtggtcttctacttcgtcgacggccacgccgctcagttttgccagttccccgcccctctcctggagcagctcgccgtccccggcccccgcgtcttcctctgtacggtggccgccgtccgcctccgcgccgacgccctcaccaatgaggcctacgccgagatcaccctcgacccggtcgccgaccacgacgtcccgcgcctggcccccgctcccgctcccgcacccgccgccgccgccggtggccagcagttgcgttacttcgtcaagacgctgatgatttccgacttcgacttccgcatccgcttctccgcccccatggctgacgccaaaggcgtcttcccgccgctggtcgacgccaaagcggtccagcccctcctcgtcaaggacctccatggatctccgatgacgttcgactacggcaggaagggcaagagagtcacgctcgccaaggtctggaagaaatttcgggacgacatggacttcgtcgacggagacagcgtcatcttcatgcgtcgccgcgacgacgacgacgacgacggcgagctgtacgtcggggtgcggcgccagcgcacgctcgaaaggccactcaggaatacgatgcgccggtacaggcctccgaccccgccccaggcggccgtgcaggaggcggtactagccgcggcgggtcacgcggcggccggcgagcggttcacggtggcgtaccggtcgcggaaggacggcgacgagttcgtcgtgccacgcgaggcggtggaggaggggctccgcgccagactcacctcgctggcggaggtggagtttgtgtgggccgtcgaggacggcgcgccgcccatcgtcgggccacggggcaaggtcaccgccattgccaccggacagctgtggcgaaatctcgaggtaatccattcttgacagcttcctgacatccatgccaatgaattttcattttgtttgtttgattgttttttgtccctcatcagcacagcatcatcatcgatttcgttcttgcatgcccagtgttactgttttgttcatgcaagattgatcactaccgcgtgattgattattactcaataattgcattgatatggattctactctgctcgttgtgcacatcttcagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaattggaaaatggtgtacctgaaatctgatatctgaagaacacgaacagttcagatcgagatgacataacgacaattttatctgttagttacgactaatatctcaaggctgcttcctgcactgaacttaaaattcatagaatgcagtcaaatcctgtcaggtttttggacgccgacaattctgatgatcatagatcagctaatggttcaattcacgttgctagtgaaaacaaccaaattgcgtaaagccttggctaatgctgtagtttagcagatggtttgggacttgggacagtcactgctcaaggactaggttcagagttgagacttgagaccaataatctatgttccgttgttacaaaaaaccgttgcaaggacggcaatctgaaacttgttgccggttgagattgagtggagctgtttgacaatacgtttaactgggcatcagcttcagacacagacgcagttacaagcctctgtctgaatggatgctactggtggttccgactgacattttacattggtgaaattattgtttgatccattgtgcattactgctggaaaatgacttatctttgctaaaaatccagtgaaatagaacaaatcaactcaaacctgaactttctgaaaattcagactcgatatctgaattctgaactgtttttagataaaaaaacaaatttaactatggttatacgttaactagttgttgtttaatttgttttttcttgcgagatgtacaaattgaatttaaacttgtatatttataaagtgatatatcacatgttaatatatcttctcaatttcttttaaacttttttttttgactatttcaatggcatgcaagcaacgaagatacatccgtgcagggatcgaaatagttccccaacgccgccgcctccacttcgttaatccttttctcctttcgtcttagtaattacagtgattaatccgttcttacatgtttctttcttgtcggcttacgttttactagttgggctagttagttacagctagctagggtccacttgcacagtttattactgatagtatttctttccttttttttttttttgctttggttaactctgcaacgaaacgtctacaaattctggacggacgaggcggcggccggcggcgacagtataaaaccccaccgcccccacccacttgcaagcgagaacaaacagtaaccaacgcctcgcctcgcctcaaacctcaattcgacaaatccatctcccgctgcccccccccccccccagttcctcggcctctcccggcgacaatggcggcggcggcggcggcgctcgccgacgacggcgacgggatcgtagaccgtgccatgtggctcgcatgcgccgccccgaactccggccgcctccccgccgtcggctcgatggtcttctacttcgtcgacggccacgcagagcagttttgccagttccccgcacctctcctggagcagctcgccgtccccggcccccgcgtcttcctctgtacggtggccgccgtccgcctccgcgccgacgccctcaccaatgaggcctacgccgacatcaccctcgacccggtcgccgaccacgacgtcccgcgcctgctccccgctcccgctcccgccgccgccgccggtggccagcagcagcagttgcgttacttcgtcaagacgctgatgtcttccgatgccgagtaccgagaccgcttcgccgtccccatggatgttgccaaggacgtcttcccgccgctggtcgacgccaaagcggtccagcccctcatcgtcaaggaccttcaaggatctccgatgacgttcgactacggcaggaacggcaacagggtcacgctcgccaaggtctggaagaaatttcgggacgacatggacttcgtcgacggagacagcgtcatcttcatgcgtcgccgcgacgacgacgagctgtacgtcggggtgcggcgccagcgcacgctcgacaagccactcaggacgcgccgatccaggcctccgacaccgcttccggtggccgtgcaggaggtgatagctgcagcgggtcgcgcggcggccggcgagcagttcactgcgacgtaccgctcgcggcaggacggcgacgagttcgtcgtgccacgcgaggtggtggaggaggggctccgcctccgctccagattcactcccgagatggaggtggagtttgtttgggcccttgaggatggcgcgccgcccagcgtcgggccacatggcaagatcaccgccatccacgacactacatggatgtggcgatcagtcgaggtatcctgacatcgattaattcccctgattctcatccgccatgccaatgtttttgaagttttcttgtctgatttcgttcatactgcagattggatggacgggaggttcagagatgaacaagtacgccaacttctggcaagttcgattggttggttcggacgattttgcttctgctgctcctccccctcctctttctccaaagaggctgaagagttcagaggtagctacggcatctacttcttcatctccctgcaatggatgtctcacacattgatcgacttgtaaacgcacgcacacgttgatcgatgcaacaatgttcactatttggtgaattgatcgatgcaatgttcaatcgcttttcaggatcatctgcctccaccaaaggcgtcagcgtcagcggcagcggcaaaggcttctccctcttcctccgcgcaggcgcagcagttcagtatcacacgcgagatgtggcgggcatgcgccgcccccaagtctggccgcctccccgctgttggctcatttgtctactacttccctgacggccacgcctagcagtgcccgtcgcgtccaccagagccccttccaggcagggtgtttctatgtaaagtcacagctgtccgcttggatgcaacaagaaatgagctctttgcgaccatgtccctcatcccagtcgccagagaccaagccatccagcctcaggcgcccgctgatccaggtccaagctcccctcaagtgcagactactcttgtttcatttgtgaagcctctcacgtgcaccgatgctgtcaagaatcggtatcggttcatagtgcccaagagagagaccgccatgggtgttctaccccagctccaattgaacgaacacgtgccgctctatatcaaggacatgcacggaaaggagtgggtgattaattatacatggaaagagtacacccacatgctttccagtggctggataaaattcgcgaatgccaaccgccttgtcacaggtgacaacgtagtgtttatgcgcagcatggacagtggcgagagatacatggggctgcgtcgcaccctcaagccggagccagtgtcagttgacgaagtgattgaggccgtatggagggcggcgcgtctcgagccgttcgaggtgacctacctctcgcgccaggacggcgacgagtttgttgtaccgtgtgggattgtacataatgctctacgagcgaagtttaccccaggaatggtggtaaacttcgtatgggctgttgaggaggacaggctgccgaatgttgggccacagggaaaggtcattgccatagagaactatgcaacctcaatctggaggatgattcaggtattactgtattactctgaattttgctgcttgtttaattgcaaatgctttcctaaattgtgccttggatattaggcatcatgagtagttgtaactttgtaccagatctagtgctagcattttgtgtctccactgaaattgttgcattgtccatttttatctgacactgtgctgctcgccaggttgagtggccatcctgtgcaggaatgaacagatatgttaatttttggcaaattcgtgaagttcttggagagagttcctttgaggcatccacttgcattgtgagaagtcaagattactcgccggcaccacagaggaatttagttaatgcgcttcagcttcctgacggaacaaaacagcttcagcaaaacaagaagtctgtttcctcgtcatccaccttccgactctttggcaaaaaaatgacacctggcgtgccaccaagaagagacaccagtggtctttctggacaggtgagctcaacattgcagtaacaaaagtttgcattctcctattgatgatcatggaatttgtaggtatcattattcagccattatcttccccatgatgaggacgatggacaagttccaacgatgaggcaacggctagagacgctgtttcctgataacatctgaggccaaggacacctacctaactaaagatttgctctgtcacttgtgactttgcgagactgggtccgtcatgaatcatctatgccagctttggtctgaatttagtttgaaggttattctgaatagtttcaaaattcggggaacaagtttgcagtgttaaatgtccattctaaatctgacggaattggaaaatggtgtatctgcaatctgatatctgaagaacgcgaacagttcagatcgagatgacataaccgacaatttcatctattagttacaacttacaactaatatctgaaggctgctgcctgcactgaacttaaaatttttacagaatgcagccaaagacctgtcaggttttcggacgacgacaattctgataatcacaaatcaactaatggttgaattcctgttgctagtccaaacgaccaaattgcataaaagccttggctaattctgtagtttagcaaatggtttgggagcagtccctgctcaaggaacttggtgttttgccaggttcagagttgagaccaatatcctctgttccttggaccagtttttcagacatttttacaaaaaccgttgcaaggacgcaatctggaacttgtcgttgccggttgagattgagtggagatgttaaataactgatgacggcatcagcttcaggcacaaacgcagttacaagcctctttgtctgaatgaatgatactggtgtttccgactgacatttttacattggtgaaatggttgatccattgcgctggaaaatgacttatctttgctaaaaaaaacccagtgaaatagaacaaatcaactcaaacatgaacattctgaaaattcagacttgatatctgaattctgaactcaatccaactcatctcggtgtcgacctatataatgccccacgcaacccccagtccgatcgcacatacttttcagcccaccagcccgcacgctggtttctcattatgggcccatcagcccacatgtttgtttctttcttcattatttttggcccaccagtcctttctttttctttttcgcgggtttcggcccactatgtgtacgtgcttcctttccttttttttattttccgaaattttcaactcaaatttgattcaaattgtaaaactttcaaaacagactttgagaacttccaactccaatttcaaaacttttaactcagatcttaaatactttcaactcaaattttaaaaactttcatctcaaatataaaaaaatttcatctcaaaattgaaaactttcatacctaaatccaaaattttcatctcaaattttaaaaacttccaattcaaaattgaaaactttcaactcaaaattcaaaaacttttaactcagatttaaaaactttcatgtcaatattttgaaaactttcaaattgtattttgaaaattttcaagtcaatatttaaaaaattttaactcaaaatttcaaaagcaattatttttatttttattgagagattactgtagcattcgctaatagctatgattagcactaatcgttgggattagcgacgtcgcgtcatttcgctaagcggaggccgcgtgcgcgcgacttaagatactcgcgcgtgcgcgcgagctatctatcccccgcgcagtcacgcaggcgcagcgccgcaacaacattccacgctcttccttcaactcatttcgctgcgccgctcgtggtggaatgtgggcgaaggcgtcggatctgtattgtgaggaggccgaccgcgacgacgacgacggactcgccgccatcctccacgacgcctgggagctccccacgcgccccgtcctgcgcaacgtcttccgccgcctcccgcgcaacacggacttcgacggcgccaccttcctctccaagccatggcttgcgctcgccgtggacgggcacaacgtcgtcgccgacgggcgcttccacgacatcgccttcccccacgaccgcggcgcgcgctgcgtcgggagctcccgtggatggctcgtgagggggcaagggagtcgccggcgccgcgggcaccgccaccatccatgattccatgtcgtccacccgctgcttccgcacctcaagtttccgctccccgacgagttctccctcttcgagatccatgccgccgcggacgagaggagcactgcgattgccactctcgaaggaggcgcgcctccgtgccggcctccccctggaggagacggacgccgagatgctgcagtgcgtgtacaagcccgacaaggagaactgcccctacatcaccatggtcacgctctcgtgcagccccgccggctccaacgacgacgactgcgtcgcgctctgcgtctaccgccgcggccgctgcctcgccatcgcgcgccccggggacgcgttgtggacgcgcgtcgaggtgggctgggagtacatggtctcaacggcaagtacgtcagcatggtccacctcaacggcggcttctacgcggcgtgctacgacggcacggtgctgtgcgtctccatcccaccggcgggcagcagctgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtatcgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaactttattgccgccttctcccggtgcaggacgtcaaatgcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccagatttttcggaacgtttccaaaacaaaaacgaatccgaatttgcagcaaaacaaaactgcaaaaggaggctgcatctgcgcaagggtgaaaagccaattttttggaccattcgacgcgtacgtcgtgcacgcgcgccgcttgccctgccctgccaggcgaggcgaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccatcgggtggagcgtataagtcatactcctaggtctttagtaagcttcctagaagattcacccaaaatcttcataaactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataattcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggaccgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgtctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaataataccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatcctttattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggtacacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacataagcatgtgacccattctccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgctttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcgacatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagctattttgtagtcatgaaactgctccatgatatacagatcattgctagcatcagtagcactgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggttgttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaagagccaattttttggaccattcgacgcgtacgtcgtgcacgcgcgccgcctgccctgccctgccaggccaggcgaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaagacccattcattaattccaacagcagcaacagtgcgtcgtcgtccccgccgcggggggagaagtttgcggacaggccgtacagggaatactgatccttgtggagatcgcggtggtggctcgccgccgacgactggtgttcgtcgggacggagagctgcctgagcccctgggacgacgacagatacctctgcgcgttccggtgggaccacgagctgcggttctggcgccggccgccgggacaggagcttcggcggccgcgcgctattcctcagcgccggcacggcgttcttcgcgcgacgcgaggatcctgccgtggtgcgccggcgactgcatctaccctattgacgacgagagcgtgctcgccgggaagaacatgaccgtgcgctgctacaacatgcgcagccggaagtatagatggccatctgggcggcacggcccaggcacggccgtgctccggccagaatctatcgggcccacacggcccgaccaacgccagaagcatcggcccaggcacggcctaatatgactcgggccgggccaggccggcccgatggcacgacagcccatcgtgcttctttaaaaaaaaaataatttcagtccctcatttctttggaccatgtctgaaggaaaaagtacaccaaaggtccctcaacttgtcatcgggttacaaaatggtccctaaacaggtatatcacatcccttagcttacaaaaccgttcactcaaggtccttaggtggttttgaacccggttttatctgacgcggtggctgagtcagcgtgggacccacatggaccccacgtgtcagggtgtccacgtcaccacacacacactctctctctcccctcttctctccattcctctctctcatttttcccctgggcatggatggcggcggcgtctttgacgcggcggggaggagacccggcgtggccggcggctggaggggaaggagcgtggcggagaggagggccgatgcgacgggcggctccgccgatggatgtcgtcgcgcggatggccgcggcggccgtccccctcaaccgtcggcctcgacgcggcaaagcaatccaaaccaaatcaaataccgagccgatcgagtctagctagctagctcgctccggcgattgaccaccaccaccgcttgcagcggtagtgatatactgatatggcggagaagaggctactgctgccggtggcgctgacgatggcgcagaagcatggaggaggggagagggtgtgggagcggccgtggaggtcgtcatcacgcgcaggggacgcggcgttcgtggaggacgtcgtcgcgcaggcgcaggtgtccaacttccggtcgtcctcatcgtatccgccacgcgcgcttctgatactctatgagcaatcgacgcccgcccctctgttcgctctctctctctctctctctctctctctctctctctctctctctcacgtggctgagctgacctcgacgggcgatgtggcggcggcggcgacgatgtgggagcaagagggccgccccccacgccgccggcttcggtcgcctctccaccagcttccatggatgacgacggcggcctcctcgctctccccgtcggctcctcatcctccgtgctctgcgaggacggcgcctcgggcgccgccgaccgctccacgctgctcgccgctgctgctcgatctgaacctgtcggcctcgtccccgtcggctgttgccgccgccgaagccgacgagatggattggtggtgcgacacgctgctccacctctagcctgcacaacaccaaacaatggcagcaatcgccagtgaactctagcctacgacgacgacgacgacgaccaaccagcaagcagcaagaatcggcaaactggtactgcgttgctacgctccaatccaaccatcaccattgctgctgctgctactgcgaagaagctctaccatctccttcatagacacggatatttttttttattttcgttttcctccatcactttttcaccactcaggatttcgtttccgccgcctctcttttgcatctctgtatccaaaggggatgctgctgctttcagctgtaccaatagctagaaaatggtagagaagatgagaaaatttggttcaaaatttgtaatgttcagatcgagcagcagtggcgagcagcgtggggcggtcggcggcgcccgaggcgccgtcctcgcagagcacggaggatgaggagccgacggggagcgcaacagggagagcgaggaggccgccgtcgtaatccatgggagctggtggagaggcgacggaggccggcggcatgggggcggccctcctgctcccacgtcgtcgtcaccgccggtcgccggccgcctgacctcctctcccacctcgccccgccggccggcttgcccagacgaaggacaaatttgagagagagaaggaagggatagaagaggggaaagagaaatagtgatgacgtggtacctgacacataggtcccacgctgactcagccgccacgtcaaataaaaccgggttcaaaaccacctaagcaacaaaagtaaacagttttataagttgaggatgtgatatatctgttttgcggttgaggtacgactttgtaactcgatgacaagttgagggaccttcggtgtactttttcccatgtctgaatgattgtagtaagtctatttacatcccttatttcttgggccgtgaattatatggctgcaataagtctaacttagtccctaaagtattttcttccctcctcattgaatcaggccgtgccgggccggcccaccgtgccaaggcatcggcccaggcacggcctagctgtcgggtcggcccggcccggacacgaccccaatcgggtcgcgccgtgcctgggcctatggccatctatagctggaagcttctgcgatgctggggccaaggtggcgctggccccacctgtctgggtcatgccgttccatgaatagtactgtacagagacatccatccaatgatccaagcaggtaaatcattgatgtgtaggagtttgatcaccatttgttcatttgttgctaggtgttttttcatgtgaattctatctttgagtaaatttcatacgaactgcatgtaagtttccatagctaccgaggaattccggatttatgattttgctttgtataattatgcacttcaaggcattttcttatagctgagagagctacacaatttgcatgtgctaccaaccttccatttctgattgttttgtgaaattgctagctgtctagttttactcccagagttccagtgctagtgtttgttgaagatttttgtactggagtagtattttgttgtgttgcaaaaatgtatagtggcttatttgattttaggatgtttaattttttaacttgattctaagtgtctttactttgaaatcagtattagtagctgcaatactgttccaattttgcaaagctctctgtctttcatgttctcgaataaagatttgcctgttcaagagtttgatcgtccatatgtattaagcagattagtgaaaatatttttggattagattttagtgaggactacatgtatgctatatggatatagaataatactagaaaaacgtcccgcgcgttgccacaggatgtgtgaaattgaacgataataaataaatataaaatatcaaaatattataaaatcattttcttacttatatataaaatgagaatgacgatttgaggattttagaaaaaaaataaattgaacaaatgacttttttctaacttcgatgatttattttttagaaactaattatgaacatcacttcatatatgactaagtattcaattctctatgattttgtaggagtttaacattgacacaattaatacttcctcctatttgtgtacaatggacataatatataatacaattaatattgtgtttttcattgtacgtttaattttcacttgagatgtggtgttccaacctctgttcaaaccgatcatgttaaatttaggatcctactctataaaatcaagttttccaagttctcccataatatcacatcttttctcagattttttttatacctatacgatttatctgcttaatttccttccataaggttattgtacatgattaatatggttcatctagaagtttttttccatagcaatgaatgggcgtagttagtctcataattgtgatagattttattgtgcttgtttttgttactcttgtcgtacaaatcgatatagcaaaaccggttgatcataaattgttatgtttcagttatgagatacaattatttgaagctcttaagatacaattaaaatcttaattgcaatttgtcagaaataactgcacattgcggtagtttggtgtggcatcatcaatgctatcaaagctatagtaagacatttcttcagtggctatgtggttaataatttgtgtatttatagcagcagcgatctcatctgttggtgctaaaattgcacgctcacataagtaggttggtagctgtgatacatgtggtattgaaccatacacaaaagaaatcaaacctgctaggttcctttcttcaaccggtagtaagagatatgatggaattttcacccaggtggtgtccggtcgatcagcgggtgcactatcatggacaacaccatcacccaaaaatagaagccatgttgcaaacagctcaagctcaaacctgtcttaatgagaaaaggttggataattgagcctcatgttttcagttaattcaagcaccacacaattttgccataagtgggagcgagtgatcaaggcattcaggatttgttgctgtcttgcattaggaataaccggtagagtttgcctaaagtctccacccaagacaattgttataccaccaaattgcatgttcactgaattaatcatggttgatcgatggcatgatatctctaacggtgcgatcaaatgcttcaaagcaatgtttatggttaacaggtgctttatcccatataatgggagatgtttgtcgaataaattcatcaagatgggtgttctacaatagagagtggattttaaactctcaagtggatgatccctcattatttacatgccactcaaatagttatgaaaaaaattataaaaaatgagaagatgtattattatgtgatatatcgctctacaaacatgcaagttaaaatttaacttttacaagttaaaaaaataaattaaactatagctagttaatgtatgttcccagttaaatttgttttttcattgcgacatatagaagttgtttgtgaagtgatctatcacatgttatatatcttgttgatttttcttttaaaaaaaattcttaactatttgagtgacattcaaaccttaacttagaatagtttctttatataatggagtttcaagccaatttatagataaaaaaaaatgtgaagatgtcagcttatggtagtgtgtaccggcggatgagtattgggccagttgtcgctgtcggcggcggcgaggtgcatatgctgctatgggcttcaatgggctggtttcatcagaagttaagtatatgtgcatgcgtcaggaataatttcactttgattcccttaactagtggaagaatctggttagtatccctaaaccgtaatattggttatcttgactccccaactattaaaacatattcgatttgcctcccaccacggttttggagggctgtttgcagatgtagcgtctacacggggtgttgatctggtcttcgttccacgtgatgttgacgtgacgcttatgtggtatttgaatttaaaaaaaaactaggtgattcccttcactttgttgcgggaattacttagaaattcttaatatttttttgacaatcaagctaagagtaaaaaagaaaaaagaaatgaaacatccgggttgatacccgtgctttagtgtgaacatattgataagtatatgttaaatattgtaaaagtgatagatagatttgttaaaatattatgcaaatgatacgaggggtgatgattgatatgcttgtattttgatttgtataattaaataaattgtagatcatgtttatgtttgcatgagattaaatatgtaattattgctagtggatgatgatgtggcatggttgcatgttgagctatagacttagtgtgctttaacttatatagaaagcatagatatgagggacccatgtcatcctccttcacattctttcacaccttctttcgtcgaggaattcttccacatgtcatcctcattcaccttcttccgtcgagggagtcaaattgagccagtcaagatatctggtatagtgattcagggatatgaatgagattctgccgctacttaaggccttgttcggtttggaaggattgaagaggattgaagggagaataattccacaccacaataggtgtggaataaatcccctccaatcctttcatcatggggattaaccgaacaaggcctaagggagtttttacttttatagatattgttggtcaaagtagcatttcgaagacgatgttagggtccaaaaatacttatattttgtgacggaggaagtagatcaaaatcgtattacaactcaatgactagtgcactgtacccttgttttaatatccagtagtcctcggttgcgttctctttgagcttaaggctgaaatccgctctacatttaataagattcacaaaaggttggatattatttacattgacaatgaaaaaaaattaactatcatgcaaactattaagatgaggaccaggagattgcatctttggcgatgcgttgtaataggatggatcacgcttcccacataccatagaattttcgtcagtcattctgcctgatgcataacaccacatagaacaatgtttccagtgcatggtttaaaagagtgaagcaattctgcagtcggggtgaactaagcgagactgaaagctaaggttgcccagaccacacgagccaacacaacaagaagacccgttgcaacgtatgaatatttttctagtaatataaccaaacaaccacgtgaatacaaattatatgatgatatgaaaccaaacttttcattgtcacacaccctctagacataacggacttccagtgtacacacctactccagcatagatgcttgtttccgttatatccaaggaaatcttagttaccgggttataaatctgcacgatcgcttttgtccctgcttgcaaccaaaacactacctctccctcgtccgtcacaaccaaagggtgcactttcacataaactccagttccaaagaaaacaaaatcaacattaatcctatattctttcgaccacgtccccttgtcaaaatcagtcagaaaccacagatccacgatagaaacgtgatctttccaatgcgctgcagacagagtgcccttaagttgagctaacatgagatggccggcgaggccagtgtagtttactgtgccattagcatcatgaagaatcgtctttgttggcccttggagagtcatgctccattgctccgtttcaaggtcgaaggaaggcatgcagcctgtccgtatgagggaggaggcggcaacgcggttgaagtaggacaggaggaagtaagccgcgcctctgtacacgactccattggtgaagctccaatcgaggtagtccggtgggttgtccgccttcctccactgaggtttcgtgtcgctggtggtgatgatctccgacacgtgggagtagtccctggactccacgatgcggagtagcttgtgctcgcctgtgtgagatgtgcggccaaacgcgagccaaacacggtctccgcctctggtgcgacggcgaggtaagtgcagccgcaggggatgtgcttgacgacgttgccggaaaggtcgacgaggttgatacgtggggtaggagaggtctccacgccaacggcgaagaggagggcggtgtgagggtggcgggcggcgtgcgcggcggctaaaagcgggtcggaggtgaaagaccgccacgagtggcagacggcgcggaggcggcagatgggcttggcggggaggcgaaacaagacctcgtgcagcatctccggtggcaacacgccgtccactgttcctccgtacccactgcaaggcgccgccgacgaggacttgttaccgacgcgagcacgagtagtaggaccgccacgacggcgagaggcagcgcgcttgggcatcacggcggcgacggtcctcttccggcggggtctagaggacggcaaggaccggacgggcttccccatgtgttcctgcggttccgaattccgacggtggactgagggcggcagcgatcgaggctagggctcaagataatagccgatcgaagaggaggaggaattcgaacccggaacgacgctcacccggtgaccggcggcgtcgggttttacgagggaaactgttttaacagctcgagtggacgtccacccgtttattgcatgtcatctaaatggttatgaaaaaaattgaaaaaatatgaacaatatatatatatatatatatatatatatatatatatatatatatatatgtaatatatcactccacaaacatgcaagttaaaattcaacttgtacaaattgtagcaaaaataacaaacaagactcaaattaatatgtatatttacagttaaatttgttatttttgttacaacttatagaagttgaatttgaacttgcatgtttgtggaatgatatattacatattgatctatcttgttaatttttttgaaaatttttcataactatttagttgacatgcaataaacgggtggacatccactcgagttattagaatccatctccggttttacaagggctctctcggctgggctggggccctcttggctgggccgaatgggaattaaaagagtggcccgtgacgagggggaaggatggaagcccggacgggacaactgtgctggtgcagtgggaagaataagtctattttatctcctcacaaaaaaaagagtctattttggcctccctaacctcttatgctttgatccaatcacatcccccaaccataaaaccgactgtaatgcatctcccaacttcaaaaactgatgcaaatatactccttcggtgatttaagaagtggtttttgctgacgtgacaggttgaccgactgagtcaacatatggcccccagatgtcagtgaaatgtgaaaaaacatatagggggacccacatgtaagatatattcattttctccttcctccacctctccctatttcctctctttctctgtctccatacctatcggggtcaccgtcgggagtggcgcggtgaaagggagctggtggccgatggagggatgcagaagtcaacgatgatagggaaggagctaaaggtcggtggtgaggccgggaggttgatacagtcaattagccggagaaaccaagggcggtggcggccttagatccagaagaggagccaagagagaggcgataggtagtcgagatagagagcccggtgctagcaagcttgcgttaatgcaaacggagcttgagctctcgctacagagacagaggggatccaggaagagggcggagcttggggtcccactggtcgcaggctcctctctcaaacctcagtggcaggggagcttgggttcccgctgccccatcaaacctcagtggtgggtggcaggggagctttgggtcctgctggtcgcagtctcctctctctcgagcagtggccacaacagcctaatggtcgacgagatcacggtggcgtagatggaacttgggatcccgtgacagatatggaggggagccgcgcgagcaacatgtcatctcctctctcccgagtgacgcgggcggcagcgcactggcgtcaccaagcatgatgatgcggcaactgttgtggatcttcagctcgaggtcacgaaggtggcggtagtgccatggaggtggtcgtcagggaggaggagcagttgcgtggaggtatcaggggtggaggctagcgggtgcgtcatggggaaagagattggacacctcttcatcccctcctcctagcaaaaagcagctccattgtagtaatttctgttgaacttgccgacgaagactagagagacttggcaaagaaatccttgaattcttaggaaccaagaaaaggaggggaatatatgaccccatcaaaatcattcattagcatccatgaaatggaatgtagtaagcaaaggatcggtgcttttcgtattctcttgggaggagggtttgatgttgtacaaccactagattggtgaatttattattaaattgtggtgaacttgttcaacgtatatttacccgtgataactcttttttgagatacaataaataatattttcttacatatatttgtatataatctctcatatttctcaaactgggggtaaaaaggtcatttcaagttccttttggtgacataacactctaattaggaaaaatctctcactcatatagtgtttgtgtaaaaaaaatggaagaggggcatctcaatagagtcactccgtaggagtggtggcaaatacttaaaaaccctgttatagtaacaacaggaatagaaataggagtaaaagtggcatttatagtactactctttccgtcctaaaatataacaatttagagggtttaaaatttgctaaaaaaatataataatttctccactaacattctcttccaaaccaatcacaaacctccattattcaattttttcgtctaccttcacttctcaaccaatcacaatattcccttattcaattttaccaatttttttaataactgtattcaatctttaaaaaaattatatatgggaaggggtagtattataatagtggcaaatagttaaatttccacaagaattgaatggaggagaagagttgtctcccctgagttgatttaacacctctccacgaggtaggcaacgcgagttggcagctaatcctgtcaagtatatttttaagatggacataggtattaagaaaataggtagaaataattagagaaatattgtgattaattgagaagataaattatttaagaaattaaatagagaatgattgtgattgattgagaggagttggtaaatgaagaaatagttttatttcacaaaatgttaaagatagatttattttgagataaagaaagtaggatggagccactgggagagcagaagtgcgggttccaaaaatcagattttttttatttgccctcaaattggcttagatcatttaatgaagcagacgacaagcttttcatggagactctccattatatgcccattcattttttttccttttccaatcatttccgttgtttgattaaggtgcagaaattaattgaactttcaattttttttctgatcgaatcgccatgtaagtatcatatggaatgaagacctagtcaaatgggctttgtatgagccacgtcagttaaaatcaggttcaatactactcggcgggggactatatttgtaccggttttaaagttgagggtacaacgattctgattttgcggtttgaggatgtcttaatttgaaactcaaaaaaaaatgaggaatgtaaagtggacttttaccagtgaaaaaaaggtcagtttgtgagggttggcaaggaggaggggcgagggcgtattgaacaggtcaacaggaacaccctcaccctcgctgcccttcgggttcacccggccccggccctaaagtgaaaaacgggcgtaaaacaacctctgcacccgacacctccggggccctgtcacccgaccgaggccctgctgcacccgcatccgcatggcaacgaccgaggaagagacgatgaggcgtgatgcagtgggacgacgatgaagaggcggagcagcgacgagcaggcgtggggactgtggatggatgaggcggcctgacgacaatgatggtgtgtcgcaccggcagccggagatgaaccggcgcggagtagcagtaggcggcgtcgacagcccggctgcgtgggggcatagaggagaagcaggcggcccggttgcatagggacgcagtagcgtggaggaggagtagggtgacgctagcggtgccggcgacgtgggtgagtgagcttggcaatgacatcgcgttggggaacgcccgcgcgtgcacatgcagtaggcggtatagcgctagcttgggccggtggtagctagggactagaaaagggatagggagagaagaacttatataatacatacttaatttaacccggtttcataagtgggaagtgtttacacctaaatttggtacctatgaatgaaatagaggaaaattgtcaaagtttgaaaagtgttggatttcctccacagggccggtcataccataggtatatgggcggtctgactggctaatagagccggtctgaccgcaggtatgtggccagtcagactgtcagagtccgagtccaagtctgtcttcatcgggtctcaggtttccttactcgggaaggctatgtttcgtatttcctttgatttctatcccgagttagacgtggagaagggcctgtagagggcaagaccaacccctatttaagggacaaggccggttcatttgtaatcccccgaatacaatctcttttaccatgttttctattttacccaagttttagtccatttttttcaatttgcgctgtaaatcatctgccgctgctgcgagagtgcgacacctctttgtaggtttgtcctgaaaaccttccgttttgcccacgagacgggtagttatcttcatattgatctaagtcggtctagaggctgattttgatctctaaatcgccttcgctaaccggtttagctgtttttctataaaacccatcttgatttggtcgtttggctagatcgaggtggtcgattctatatcacctcaaggcgtttaggtgttgcgatcatgcttgtcgacttgtcacaaaaagttaccaacaggagggttaagattttcggtatgggatcacctatacatttgtcaacaaattttgttttcaaaacttgacaaatgtaattgtagtacaatcgtgatgtaattacgttgtaacttgtatgtaactttcaaaaatctctccgtaatcggtgaaacggatgtcctgggaacgaatcctctcacatgtgtgctgctatgcgcgctgtgatttttttctttcctcacttgcacaattacggagaaacaaatctactggttcaaaactatgtgaaagttacatacaaattatattgtagttacatctctcaaatttttaggagaaaatttgtccacaaatatgtagctaaattgttatgtagtacagtttcgaaaccgctaaaaagcggctagtcgcgcgtctcccctccctcgtggcgcggccacgtggcgcgaagagaggatggccacggtggaacggcgcgggagcgccacgtgcggcacgtttctccggtttttctggtttttccctgatttctttcggcggcagataaaaacgtggcggcggcggaatcagggaagacgaggaaacagctgccaccggcgggcgcaacgctgccggccgtgacgccgctggctgcgacactgctagccgtgacgccaccgggcaaggggctgcaggtacaggcaccggcgggcgaggcgccgctgccgggagaggcgctggcgggcgacgcgacgccgccgggagaggcgcaggcgagcgcggagaatcgccgggcgggagcatttcgtcttcgcacgggaacgagaggagagagaggcaggagtgtgagattgggagcgatattcgcgagaatactcgcccgtatataagccgagcaaggaatggggagaagggagttccaaaacttatgcaggagggtaggggatttgttggagctgttttctagactaaaatccctcaaaattagttttgggaatcagataggttgactgttggtgatgctcttagcgcgctcgtgcagtttaggatatgaattagactatccctttggcctgaaatatttatttgcgttccgcaagtgaaatactccattttgttaggcccatcaaactaacaagcaccagagcccacccacgatcgaggccaggcaccatccatgccgttgccaagttgccgtcgacgagagcagaggccaaggcaaagctgcttccagaatccagagtgccacctccgtctccgagcacggcagcaacggccacaggaatctgccgtgcagagcacgctatcctcatctatatatttctctgaccacttcgtcctcacccctcccccatttcaaatcacgcccacctcaattcagaactccacatggctgccgatcccaacctccccggccgtggcggcgccacctcttccccgatggtctccagcctcggtggcgtcgacggcgagggcgcgccgcccccctctcccatccttgctgccctcgctttgtcgactgtctccgcggcgtcgagcgcgcccgctaccggcgccaccgtttcccccctggtctccaacctcggtggcgtcgacggcgagagcgcgccatgagcgccgcctccctcccccactgtccctgcttcgtcgacggtgtccgcggcgtcgagcgcgcccgctaccggctccacctcttccctctccagcctcggtggcgtcgacggcgagggcgcgccatgcgcgccgcccccctcccccatccctgctggccccgcttcgtcgacggtctccgcggcgtcgagcgcgcccgctacccgcgactacctcggcgggatcactggccaccgcctcggccaggaggacgactccggcggccacgagtacacatccgtctccggcatccacgtccccagcagcagcggcgtcgccttcgtgtcgttcggccagtgtcctcaggaggtgatctccaccgacctctgcctcggcttggggcccatcgccgccaccgcaccgctgcaacctcctccacctccagcggcggcagcggcagcggggtctccgtctgctacgacgccggagccaggacatggggaagcgacaccgacgacaagttcctccgcgcagtttcagacgcaggcgcagcaggttacgcgcgacatgtggatggcctgcgctgcacccaagtccggccgtctccccaccgttggatcattggtctactacttcccggacgggcacgccgagcagtgcctgtcacgtccgcaggagccgcttccaggcagaattttcctatgcaaagtcacggacgtccgcctcggcgcagcagcaacaaacgaagccttggcaaccatctctctcgtcccgatcgccgccgacgaccatgccttccagcttcaggctcccgctgatccagaccctgctccagcccagtcccagagtctcgtttcattcgtcaagcctctcacctataccgatgtcaccaagaatcggttcatggtgcccaaggacgatgccgctgcgggagttcttcctcacatacagttgaacgatgatgtgcctctccgaatcaaggacttgagcggaaaggagtgggcgtttaactacacctggaaagctcacacccgcatgtttcgcaatggttggatggagttttctaatgccaacggcctcgtcactggcgacaatgccgtgttcatgcgtcgcggcaacggcgagatgttcatggcggtgcggcgcacgcgcaacaggccggcgcccttctcagtggaggaggtcatcgaggccgtgtggcgggcagcgcgccgcgagccgtttgaggtcagctattgcttgcgccaggatggggacgagttcgttgtaccacgtgacatcgtcgatgatggcttacgcgccaggtttgctccaggcatggctgtgaacttcgtatgggctgttgaggatggcaagctgccaaccatcgggccacagggggaggtgatttccatagagaactatgctacgtccattggcgcataattcaggttctgaatttttcttgttttgattgaagtgactgcatgtattgtgttgatagtatgattgatcttaatttcttctgctcattgttttttttttttgacgcaaaaggtagagagactctaccttgttaccattgtattaatggtggtcatgaaagtaacaaagccagtggctggcaagagattatacagggggaacaaagaggaaggataaagaaaaagaaagataaaaaagaaggaagggagaagaaaaagaagaagaaagaacaaaacacaaaaaaaaacaaaaataaaaaggaaacctagctaagcttgtctgcccaagtgttgatatgttcgcgaaggcttggctttaggcgatgaacccataattggagactttctctgatttgatgaaagatgtatgcaacgcttgtttcagtgagcttgaagaccagctggttgcgtgctttccagagaccgtgcgaacaagcagcaaagcatgcagggcatcccggtttctggtgttctggtaaggtgtccaggattgattccacaaaatcttgtatgttagagctgcgcacggctgtctcatataggttgagtttcttccagacttcccctgctaatttgcaacgaagaatgatgtgatttgctgtttcaatagctgggcaggacatacagtgcgggttggaatcccattttttattaaccctgtttgcattggtgttgagcctgtcccggaatgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgttggtccaacaatatatccatgagggactgtaactcggtttgagcccgggaagagagaaccgggtgtagatcaattgtccaggtgccgttagtgtgttgggaggagactgtacagttgatatttgttgcgtaggaagctagtgtcggatatatgaggttgaatcgtcctgctgctgtccagtggtctcgccaaaactgcactagctggccgttcccaatcgttaccttagtggaggcaataattggctcgataacggaacaaactgtcttccaaatcggtgtttctgttggttttgctttaatagggatctcatttgccatgtgttgcgtgcgcaaccattgaaaacatggttctgatgagtctgataacaacctgcatcctatcctcataagtagagccaggttgtgagctctcaagtcaccgattcccaatcctccttgttccttgttgagagtgacagttggccaggccactaaacattgacctccttttactttcttatcccctttccaaaggaatgccctccttaggcgatcaactgcttcgatggttttgtctggccacttgatgcaggacatgaaataatttggtattgccgacataactgagttgatcatgatgagtctttcaccccaactgagaaggcctgggatccatcctgctatagccttcgatctattttgtcaatgactggtgcaagcaacttgtgtgagatcttggctgttgtcacgctcagaaattcacgaaccagaatttctaagctgaatgtgcattaaatccctgtccaggaccagctagggtacacaaacgacaattgttgacatacaaatccacgtcttacaaaaatataaagattacaaatgcagcggaaaagataaaagcgagctaaaccgggaagcttgacttcagcagcggggcgactccactccacaggcaatccttgacggcagtgacgaaatcaacttcgacaagacagctcccactaggaagatcttcagctctggtgtgggggaaaagagagcaagactgagtactacccactgtactcagcaagtcataccggaagaggaggtatgatgcaggatataaccgaaggaggctaaaggttcttttgcacaaagcaggcatttaaaaacagtagttgaaagcagtaaaacagttgtagtaataaatcaatattaaccaaacactgtccaacgctacaccacgttgcaacaggcccaaccaaccgcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactacaaagggggaaatcgtgacctccacataactctcccctaaccatccacaccacgctaaggtttcacccccacccctcaaaaggcagtgggcggtcccctcttgcgccgcggtgaatccggcaactggacaaccggacaccccggccgacccaactccatcacgcccaccctcgccaccggtgcctaggaaagggttgagctatacttcagatcaagcagttacccactcccgcttgtggtaagcacggtaagtctcccagggtttcccgtgaaccggtccttaactgccatgggtgcgaccagctaaaccatgcacccacagcccaccattcagtgtattttaattaactaacaccactgcggtggcaccaatccaaaactatgctaatagacaaagtctatgtaataatgtgatccctttttgtgtactagttaagctaagcatggctaagcatttcctaaaccaacatctaatcattttgataccccagttatcaatggcatatggtaaacaatatatagcagagtattaggacccatcccacatgacattgtaaaagaatgcgacatttaatagaaatgcgggacatttgtaaattgggtacaatatgatcaattgtaatgcatgacttgccttgctctcgcactgatgagaccacagcaacgtcttcgagaaaccgcggatcgacaaaacagccgaaatctacgcgacaaacaaagcacacaagcaaaacatgctataagactactgaaacaggaaacaaaaccatttttaatggattctttgcatttttatgaatttactgagacttgaatggacttaaacgaagctcggatgaattacttatgaattttagaagataaactgtgtttttactaataaagaaaaaatccttaatcaatttattgtgcaataaatcccagggctgacgtcatccaagggggggctgcgctgacaggtgggccccgcttgtcagcgcacaaggggaggagagggggctcgggcaagtgggccccactggcagcggcacaaggtggccggtctaccgtggaccgggaccacgcgggtggtccaccgccggtccacgggaccgacagtccggatcggcccgaggctgatcggacggcgcgggcggcggttaggcacggctcggctcggcacaaagccgaccgaccggccatggcgagcggcagcggcgcgtgcagcgcaggccatccacatgtcgtgcggagcggcggcggacggcgcgaaaggctgcggcggacgtccggagcggcggcacggccaaaggcggcggcacggccaaaggtggcggcgcacgcgggaaggggagaaaagggagggggagggagtcctcaccggaggggcggcgaccggagcgggaggggatgagcggcggcagcgcttcggaaaacggcggacgggagcggcgcgtcctgggaaaaggcggtgaaggggttagggagaagagaggagccgcggcacggcgaggagaaatggccggagatggaaacaatggcgagctcaccggcgtgtagcgcccgttccgtcgtggcgcctagcgggaaaattatctcttaaaaaccctaattgcgaaatttgtttctttgcttgttgtctagtgtccgtgccatctcaagatctcaatccgcgatcgatcgtcgagatcaattccgaatccaattccttccaaatcgaatccctccgcaaaagtctagtttgcctcccccgggttcgatgggccgaattccgctcggcccatctcttccccggccccctccctctctctctctctctctctctctctctctctctctctctctctctcgctccccccccccggcgcgtttcccccccctggctgctcgcgcgagcgtgagccgcgccgagcgcctctctctccgctcccctccgctccgcccgcgcgccgcgcgcgcgtgcgcgggagtcgcccgcgccgagcgccccctcctctcgcgcgagctccccgctcgcaaagccggccccgcgcgccgttgctcgcgcgcgcgccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccatcgtcatcccccagcccccgccactccgcgcgcaagccgccaagaggcggaggccgagctctcccttccctctgccgcgtcgccccgctccctcctccttttcccgattcggcaaaggggcaagccccctttctctccctccttttcccctttccttcctttttcccctctcgccggcgtcacctcctgtcgccgctttggacgctagccggagcgccagctcgccggcttgaccgttcaatgtcggtttccctcgcccaaaccgacaataccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggacttcggccgcgccctcttcttcctcttccccggcccgaggccggagagattactcccgcgccgtcggcctctcgtcacagcgcccctcctcatctcggtgatgcctccctccgttcttccccctcgccccatctcctccccctagctttcggtagtagctcgagtagactccccgtagctagccggcgccgccccgaccgatgccgtcgctcgccgtgtgctcgccgccgtcgccgcccgagctccgtagcaaccgcacgtcgccagcctcgctcggcgtagctccgtccaatccgacgctagcatcagattcccgtggtcacatggatgctctcaccgctgggaatcgacccctcgtggcctcgtcgccgtttccctcttccctcgccgccggttgccgccgccgcaatccgccgccgtcgagcaacctccggcgaatccgagccgttggctcgtctcccctcgtcccgtgcaatcgcccggtgtgctcgcttttgcctgtatcgccgtggctcgctccgccgctcgccgctgtcgcccgccgtccattcgcggccgagtcgtcgtctacctcccgccggcccgcgtggctgccacgtaggcgccacgtcggggccaacttgggcggcgaccggataagccgacccggccagccgctccctccgtttctccccgtgcgtgtggtccgcggtgagccgtgaggctgcgcgtgggcccgccgcatccgttcctccgcgaaccgcgcgcgtgcaccgcgtcccagccccgcccgcgcgcgtacgccgcatactccctccgcacggtgagccgagccgctgacaagcgggtcccacccgggaccacgcgtggtgagcccggtccaccggctccctctctctcctccctcccgcgcgcgcgcgcttgggccgtcttgggccggccggtccgttaagcttggccgagccgccccaaatctcttgggccgcaccctagccacccgagaaaagtatatattccctccctcctttcttttcttttccttttccaaaaaggatttaattaaatcctttttcctttagaccaaaaatccaataatcttagaaattcaatatattcccaaccgtaattccgtttgaccccgttcaacttctaaaatttcccaaatctcgagatctatctagtggcacgcttagaggtctttaatagggctttattttcgccgtttgttgagttgtcccgtttcgcgtgtagtttcggagcccgaagacccgcagtgcgaggatttcgaggatcaagctccggatcgcgagcaaggcaagccccctttgaacatcttgagcctatatttgaaatttaattatattgcttgcgaaatattatgcattgatacgatcacacttaatctgttgtcccgtctgcaaggcagattggtagacctacctaatttgttgcatttgatccttcctttgttaattgttataccatgtccccttgtaaccacctagttacacctcgatattcgtgcactctgtgcgagtatcgacggtcgccttcaaacttaaaatctgagaaacaacttgggtaaaactggagttttacaaaagacttggaaaacccgacacctaggtcggtgcttgcgaactaaatgaatttccaaaaccgcggaccggggaacgtaccgggtgtacggtttcccgctctcgcacttaaggacagattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaatgctgttgtgaaaagggaattcggtgtttgaaaaatcagcagctgacgggatcagctaggcccgggtggccgtttgaaaagttgttggcccgggtggccgttgaaaagctgttggccggaagccaatcttggttcaaatctaaagattgatgcattgcacatactccggccggacgagacgcactgtctcatccgagtcgtttgagaagcactcacctagtcattctagaaaagagttcaaacaaaatcaattacgaaaacaacaacctttccttgaagcctgcattaaacacttatttcccctggcttgctgagtactcccgtactcacccttgctctatataaataattccctcccccagttgctgaagaagatgaagtggatcctgccgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttattttggagcgtcacgggctagttccggtcgggactagttcggggcgtgacacggcggcgcgagggaatcggagctccggcggtgattcgcggcaacgaagcggcggccgaggtgcggacgggctcggtgagcgcgacggcggcgactgcgcggcgcggcggtggctatagtggcggcggcgcgtggccggagacggcggtaggcggcggcgcaaggggcgagcagcgcggcgacgataggaagcacgggagggcacggcgagtgcgaaaaacgagagagggggacgcggggagcgatttatagatgcgggagggggcggacgtggccggggaggtggccgatttggccggcgacgtgggggagtggggaggaagagagagaggggggattcaaattgaaccccgaccactctcgggcgcgcgggcggaaaagccgccggagtggggcaccgacgtgggcgcgcggcacggccggagtggggcacggagaacggcggaaaacggcggcggcagcgtggccggtttcgacagcagcggcggttgccggaggtaggagacaaccgacaggtggggcccacctgtcggcgtcccagagagaggaggaaggggcgcatgggccggcccaacaaaggggaggccgagcgcgggagggagtgggccgacggcccaacaaagaaaaaggagggaaaagaaaagaaaaggagaaaaaggattttcctgggattaaaaatattgcacttgctcaattttaattggttaaaattatttccaaggctctgaaaattccactaaaaatcatgttaatgtattggagcatggggaactcaaagaaaaattccaccacgccgaattcgattattaaatgcatttattaattagggatttagctctaggttaattaagataatttcttcgggcaatttatttaactaatttttaaagcaagaaaaggggggaaacttcagggtgtgacagctgtcgagagcggaagacctagacctagatagttacaaggaagcgggctgatggggcattgcaaaagctcagcgatggccgttgcctcgggttcattcatgtgtatgggtacgaaggtactcttgctgaaattgatctgtagccctgagaatgcagcaaattcctcaagaatgctcttaattatttcagcctgctcaagcgatccttttaaaatgagtagggtgtcatcagcgtattgcagcgtgggaggaggagagtgagaatccagtgggtggagtaactgctcggagtggaaggcttgctgtatcatttgctgtaggacgtcagcgactagaatgaagagatatggggagagagagggtcaccctgacggactcctctcctatacttaaatgactcgcctgttgatccattgatcaagacgtgtgcttgtccagtttccaaaatctgtttgatccaattgatccatgtgtcgtcgaatcctctgcggtgtaggaccaagtataagcaatcccagttaactgtgtcaaaagctttttggaagtcaagctttagaataatcgttggttttttccttttgatcgcacattgaacaatgtcagaagctagtataaaattctccgtgattgatcttcctttgatgaatgcagactgcattggatcaattaactcaggaatttccccttgaacccggtttgctagcactttgctgataagctttggcagactgtgtagcaaggatattggcctgaaatctgttatgccgagaggggtttcttttttcggaattaaagtgatgtaagagatgttaacccctgaaagatcggctgcattggcatggaaggaattgaacagcgcgatcaggtcaggcttaagagtagagatgaagcatttgtagaactcatttgtgtagccatcaggacccgggcttttatttggaggcgagtgcaggatggcgcttgagatttcttcccaggaaaaagaggtggagagagctgacaagttgcgcattgaggggtagaggggcgacagaggaatggagtgggaagtgagttcagtgctgaagatgttccggaagtgtgcggtcgcaatttgcaatttttttggagtgtcgtagtgttctatcccatcctccaacaggagtttgattttattttttctgtggctaattgtggctgcaacatggaagaaatgactattctcatcgcctagcgtgcaccaagtgattttggatcggcgtttccattttagcgcccaaaaccagtttaactctttgaagtgctcgtggcagtgtttacgaagtgagaattccaggtctgtaagaggccgccactcttcacagcgatcaaagaaatcaatgacatatttgttagtgtggaggagagattttaaaccagctttgcgtcgtttccaggctctgattttggctctcagccttctgagtttaaagttcaaaatggagaccggagagataggtctagcggccttaagcaggtcgttttacactaaatttttgaactccggcatttgcagccaaaaattttccaccctaaaaattgcggagcgaggcgctgaatcggaaatgtgaactaggattggtgtatggtcagaagttgttgcagtcacagcttttgcttcagtaagagggaaggattggctccagagtggattaatgaaaaccctatcaagtttaacaagggtggggtggcgtcttttattagaccaggtgaaggtcctgtttgggatgtcaatgtcaaggaggctctcggagttaatccagtcgttgaatgtttccatctccgaccaattgatattatcgttatttttttcgtgggggtatctataaatgttgaagtcaccgaggatcatgacagaaccagttagattgagagtggtggtggagagctcatcaaagaagaggatcctgtgctggtcgtcacagggggcatagacattgatgatagagaaggaggtgttgtcggaagagctacagaaggaggtggtcagatgagacggtgagctggagaggacagtggcagagaaaaggttgctccaagcagtgagcaagcctccggctgaaccaagggagggttgaaaggagaaattacgaagattgcgtggtaagaaggaagcagcgaggagagggcagatagtatcaagcttggtttcttggaaacaaactatatctggtttattctcagctagggattggaagataagagctttctttttatcgcagccaaggccgcgcacattccaggtggcaatcttcatagaaaaaacagagaagcaacttggtggaggaatcccacccaaaaccaaggcaaaatcgcatgtttaaaagtctgccgcggaaaaaaggaagaacagataagcaagaaagctgaaacggtaaaaggagttttgcaagctgaagcaagagtctgctcattgtgcatactgcagattggatggacagaaagttcaaagatgaacaagtacgccaacttctggcaagttcgatcagtttgttacgatcttgcttctgctgctcctccccctcctctttctccaaagaggctgaagatttgtaaggttgctacggcatctacttcttcatctgtctgcaatgaagatgagcaagttcagacgatgcgggagcgagtagaggcgctacttcctgataacatcaaagctatcatcgatcaaaaaggaaatccaaagggaaaggacacctgacgttgtcggcaatgatcacactcaagattgggtctgtttgtcatgtggggattgcaatacaaacgtcgcagcaacaggcgggcgacggtaaggcgtgacgaggaatagtttttacttctattttgattcggttcggagtttgttagatagtttgttagtttcttattccgtaagctgttaggagtctatcctttagaattgctatgtaatctgtaagacagtttggttttggaatcaatcaattacgtgagattaatctgcagacctattcctgcctcgccggtgcggtgccgaacacggctcctccgcgccaacgaggtccaggaccacgtcctgttacagccttcaaatactccctccgtcgtaatcctccttccaatctcctcgcccgtgacaacttggtatcagattcttctggttccgtgtccatgggttccactcagacgcaactcgacgagatcgcgaagaacctcacttccatggctgcgcagatttctgatttagccaggaagatgagcaccctggaaccattggtgcccatcgcaccaaaacttagcgacctgccggaacgcgtcacccaggtgcaagcctctgcgttcgagtactccgagcaggtgcgctccctcaacctggcgatccagcgcgtggaggcgtcctagcgcgcgtcggccacggcggcatctggcgcctcctctcagccgccgccaggcgaccctcccccatccggcgacaacgacagaaccctgcgccgcgatcgccgtggcgacgactcgacggtcgacaacagctttctaccccgcgccaagctcgagttcccgacgtacgacggcaaaggcgacccgttgccatggctgaatcgctgcgagaccttctttcgtggccaacagacaccggaaaatcgcaaggtgtggtacgcatccttacatttagttggtgatgcacagttgtggtactacaggatcgagctcaatgctggtgaaccattgtggcggcgctcgtccagttggtccacaccaggttcgggccgccgatgaccgacagcccccttggcgagctcacggcgttgcgccgtacgggcacggtggaggattacatcaacaatttcctcgccttggcctgccgcgacgtcgaactctccgagcgccagcaagtccaactcttcaccgccggtctcgtcaatcccctcaagaccgatgtggctctttgccgcccacaatcgctggacgacgccatcatgcttgcgcgggcatatgaacagcgggtccaagttggcgcaacggacccagtcccggcccgctccggccgcgcaccacgccccgcactccccgcgctgccggcatccgcgtccaccgcgccgggcacgtccgcggcacccgacaccttgtcctcggcatcaaccggcaaacagcccctggtgtcggctcttcctcgcaagcgtttgtcgccggcggagatggcacagcgtcgatctgaaggactctactacaactgcgacgagaagtacgtcgccgggcatcgctgcaagaaatcattcgtcatcgaggtcattagctttccggatgatcccgaggaggaggcagaagacgcaccgactgctcatgcgctctcgctggacgagcccagcatctcgctgcacgctctcgccggtgttcgctcgccgaaatacaacacaatcaaggtgtaggctcgcattggcacaatagacctcatcgccctcctcgactccggctcgacgcacaacttcatcagcgatgtcgccgcccgtcgtgcccgtgttcccctagaaccgcgacacggcctcagcgtcgcggtggtgaacggcgatcgcatcaagtcgccaggccgtttcccaccgcagcttgttaccatcggcaatcacgacttcgtcatcaacttctacgctcttcctcttggcggctacgacattgtcctgggcgcccaatggctcggctcccttggaccgactctctgggacttcgccaaccagtcgctcgcgttcgggccgccgactgaccgtgtggtttggactagcattgacgcgccggcatcaccttcccaggcggctacaatcgacggcacgccaggcgagctcatgacggagttggttgatacctttcaggacctcttcgttgagccacacggcatgccaccggggcgccacctctgccatcggattcgcctagagcacggcatctcggcagtcgcggtgcgcccgtatcgctatgcccacgtccagaaggatgagctggagcgccagtgtgacgagatgctgcagcagggcgtcatccggccgagctcgtcggcgttctcctcgccggctctattgatcaagaaaaaggacggcgcatggcgattctgcatcgactaccgcgccctcaacgacaagaccatcaaggacaagttcccgatcccggtggccgaggagctgttcgatgagctgcgcggcgtcaagttcttcaccaagctcgacatgcgttccggctaccaccaagtacgaatgcaccccgacgacatccacaagactgcgttccgcacgcatcaaggcctgttcgagttcttggtcatgccattcggattgacgaatgcaccggcaacgttccaggcgctcatgaacgacgtgctcctcccgtttctgcaccggttcgtgttggttttctttgacgatattcttatttacagatcatcgtggtcggaacatctccgccacgtccgtaccgtgttgcaaacactgcaggaccataagcttcgactcaagcgatccaagtgcgagtttgggctctccgccatctcgtacttgggccacgtcatttcggccgccggcgtcgccatggacaggagcaaagttcaggccgttcttgactggcctcagcctaagaacgcgcgtgcagtccggggcttcctcggcttggcggggtactaccgccgcctcatccgtgacttcggcaccatcgccgtgcccctcacggcactattgcgaaaggagggctttcgctggtcggacgatgcgacagcggcatttcggcagctccaacaagcgctcacggcggcaccggtgctttaactgccggacttcaacaaggagttcgtcgtggaatgcgacgcgtcgggctctggcttcggcgccgttcttcatcaaggcttcggaccggtggcgttcttcagcaagccgatagcgccacgccacgccaagctcgccgcctatgagcgtgaactgattggacttgtccaagcagttcgccattggcggccgtacttatgggggcgtcggttcctcatccgcaccgaccattacagtctgcgcttccttctagaccaacgtctatccaccgttccacagcaccaatgggcaagcaagctactcggcttcgactttgcagttgagtacaagccgggaacagcaaacgtggtggcatacgccctctccagaagggacgaacacctggctgaaactctcgccttatcagcccctcagttctccctgtttgatgagctgcggcgcgaggtgctcacgtcacccgagctgactgccattcgggatgacattgccaaggggtcaaaaccgccggcctgggcgttcacggacggcctcatcacgttcaaaggccgtatctttgtgtctgcatcatcaccatccttgccggccatcctcgaactggcacacggcctggggcacgagggcacgcagaagacgctctctcgcctccgagctgacttccacctcgcacgggacagggcggtggtacaagagcatgtccgagcctgtttcacgtgtcagtgaaacaagacggagcacctacaaccggccggtctcttgcaatccttgccggtgccatcggcggtgtgggccgacatcgccatggatttcgtcgagggtctgccacgcgtccatggcaagacggtcatcttaacggtggtggaccgtttctccaagtttgcccactttataccactggctcattgtagcgcccattccgtcgtggcgccaagcgggaaaactatctcttaaaaaccctatttgcgaaatctgtttcattgtttattgtctagtgtccgtgccatctcagatctcaaatccccgatctatcgtcaaagttcaatcccgaatccaaatccttcccaaatcaaatccctccgcaaaagtctattttgcctccctcgggttcgatgggccgaattcctcgcggcccatctccccctccct

SEQ ID NO: 22542 - DNA, 14298 bp, Oryza sativa
ctctgtctctctctctctctctctctcccgctctgcccgtgagccgcgccaagccctccctctccgctctcgctgccgttcccgccgatgccgcccaaatcgccacgccgcccgcgcgcgcgcgccgtggtggccgaccggccagtcgccgccgccgtcagcgcctgccgcgcctgcccgcgcctgccgcccgtgtcgtcgctccgctccaaaccgccccgccgtcatcgccgtcgtcatcgacccagcccccgccactcggcgcgctagcctccaagggacggaggcagagctcctcctccctctgccgcgtcgcccccgttccctcctccttttcccaaagtggcaaggggcaagccccctttcttccttcctttttcctttttctcttcctccgccggcgtcattcccctccttcctgtcgccgatttggccgctagccggagcgccagctcgctggcttgaccatccaatgtcggttcccctctcctaaaccgacattgtcgcccatataaacccaagattcccccccctttcctttcctctcccattcgccctcgctccaccacgccattgccgtcccctctgtctcgccgatcgccgaccgccgccgtcacgtgtgccgaaggagccggcgcgcgttaggaagcggaaggggactccgggcgcgccctcttcttcctcttccccggcccgaggccggagagatcactcccgtgccgtcggcctctcgtcacagcgccccacctcgtctcagtagtgcctccctccgttctccctcctcgttccatctcctccccttagactcgggtagtagcacgagtagcctccccgtagctagctagcgccgccccgaccgttgccgccgctcgttgtgtgctcgccgccgtcgccgcccgtgctccgtagcacccgctcgtcgccggcctcgctcggcatagctccgcccaatccgacgctagcaacggatccccggagtcgcatagatgctctagctcgcccgaatcggtctcccgttgcgcccttgccgtttcccccttctctcgccgccggttgccgccgccgcaatccaccgccgtcgagcattccccggcaaatccgagccattgactcgtctcccctcgtcccgtgcaacctcccggtgtgcttgctttcgcctgtatcgtcgtggttcgctccgccgcttgccgccgccgtccgccgtccgttccggccgacgccttcgtcttcctccagccggcccgcgtggcaaccacgtaggcgccacgtcggcgccacctcggccgcgaccagatcggctgacccggccagccgctccctccgttccccccccccccccgtgcgcatggtccgcggtgagccgtgaggctgcgcgtgggccgccgcaccgcgtcctccgcgaactgcgcgcatgcgcccggccttccttcccaaaccctagcacgccccgcgtgcacctcgctcacggtgagctgagtcgccgacaagcgggtcttacccgggaccacgcgggatggacccgggggaccggctctctctctctctgctccccgcccgcgcggcgctttgggacgccttcttgggccggccggcccattaagctcggccgagccgccccttttctctcgggccgcgccgtagccgcccgaggaaagtctaatttacctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaaaggcacgcttagaggtcaataatagggctttattttcgccgtttgctgagttgtcccatttcgcgtgtagtttcggagcccgaagacccgcagtgcgaggatttcgaggaccaagatcaagatctcgagcaaggcaagccacctttgaacatcttgagcctatatttgaacttaattatgttgcttaaaaaatattatgcattgataggattgcacttaatctgtttgtcccatctgcaaggcagattggcggacctacctaacttgttgcatttgacccttgccttgtaattgttataccatgttcccttgtaaccacctagttgcgcctcggtaatcgtgcactctacacgagtatcgacgatcgccttcaaacttaaaatctgagaaacatcttgggtaaaacttgggttttacaaaagacttggaaaacccgacacctgggtcggtgcttgcgaacctaaatgaatttccaaaatcgcggaccgggtaacgtaccgggtgtacggtttcccgctcttgcacttaaggaccgtttccttggaatttcatccgaacataagacaagtacgaccacatgggtggaatgggacacccctggctgagtaactagctaatcgggggagccatgatgtcaagagacatgtggattcaacggggtggtgtcggggaggacccccgggtttcctggcacagtatggtctgggacctaatctggtgttggtctggaacccctctcattggcatatggtgaacctgtgtcggctttcgaaatgccttgtcatgaaagccttaaggtctctagtcgtggccgttctgcacgggctggatgatccgggttagtaatgacgtgtgggtaaagtgtaccccctctgcagaggttattaaactgttcgaacagccgtgcccacggtcatgggcggatgtaaggtgattcctagcatagttttgtttgactactgcttgtgaaatttgctgatgtggtttgggattgatgtttggaaaatctgcggctgatgggatcagccaggcccgggtggccgtttaaaaaccgttggccgggtgccaaccttgatcaattcaaaagactgataccttgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattccccatggcttgctgagtactcccgtactcacccttgctctatataaataatcccccccccccagttgctgaagaaaatgaagcggatcccgctgacgaggagttcttccaggagcaagccggctacgatgagttttagggtttcggcctagttcccaagtcgcgcctgtgatgtgtggtccaagtcttggcttccgcttcccttttgtaatgcagttgtgagctcaggatctgtccgcagcccaacataactgtactcctactctataataaagagatctctgttgctgtgatattctgtcttcctgtgataccagcactgtttcctgggactggtatcaattaataggttaatttggagcgtcacgggctagttccgctcgggactagttcgggacgtgacactcatccctacacgacaacctcgatggcagcggccttcttcgcggaaattgttctactacacggtgttctagcttctattgtcagtgatcgagatccggtcttcaccagcactttctggcgggagttgttcagattgacgggagtacaactgaacttgtcgtcggcatttcatcctcagtctgacggccaatccaaggtgacgaacaagatcattgcgatgtatctccgttgtcttaccggcgatcggccacggcactggctacggtggctcccatgggcggagtactgctacaacacgtcctaccagtcatctcttcgcacgtcgccgttccgcgtggtttatggccgtgagccacctacgctgcacgcctatgaaccgggatccactcgtctaccggcagtccaacaggcgatgcaagatcgagatgaatttttgcgtgcgattcgtgatcgcctggagcaagcgcagcagacacacaagtcggcgtatgatggcaagcatcgggcactggaattcagtgtgggcgactgggtgtggcttcgtttgctccatcgcccgatggcttcgctcggggtcgccggccgtggtaagttgggtcctaaattttacgggccgtatagggttgccgagcggattggttctatggcatatcgtcttcagcttcctccgggtgctcgcttgcatgatgtgtttcacgtggggttgttgaagccatttcgtggaaccccgcctgattctgttccgccattaccgcccattcaacacggccaagtgtgtttgcagcatgccgcagttacgcagagtcgattggctcgtggagttcgtgaagttcttgttcagtggaaggataagcctgctgccgaagcttcatggatgcctttggatgaatttcggactcttcatccggattttcagctcgaggacaagctgcttttccagggggggagagatgtcatgtggggattgcaatacaaacgtcgcagcaacaggcgggcgacggcaaggcatgacgaggaatagtttttacttctgttttgattcggttcggagtttgttagatagtttgttagtttcttattccgtaagctgttaggagtctatcctttagaattgctatataatctgtaagacagtttggttttggaagcaatcaattatgtgagattaatctgtagacctattcctgcctcgccggtgcggtgccgaacacggctcctccgcgccgacgaggtccaggaccacgtcctgttacagccttcaaatactccctccgtcgtaatcctcgttccaatctcctcgcccgtgacactgttacttgtgagattgggtcatgaaatcaagattggattgggtctgttacttgtgagattgggtccttaactcaagattggattgggtctgtcacctgtgagattgggtcatgaactaaagattggattgggtctgtcacttgtgagattgggtatggcctgaatcagcaaaaagctataacaaactagtatcatgcattgtttcgtttggctgttgtcttgcctacagtttatctgctgtgagaatgttttttttttcttccagcaacaacaactgtaacatgaactagcactttttgcctgcactgaacttaaaattcatagaatgcagtcaagtcctgccaggtttttggacgccgacaattctgatgatcacagatcagctaatggttgaattcctgttgctagtgcaaacaaccaaattgcgtacaaagctttgactaatgctgtaatttagcagatggtttgggacttgggagcagtccctgctcaaggacgaggttcagagttgagaccaataatctctgttccttggagagagtgaattttaaacatggaccatggatatagcagaccatggatgtatttcttttgtgtcagtgtctgtccacctccatgaagcgcatttgcttattcaatgctcagaaaaatatgacatctctcctctatccttgattgcaaactctgctgcacttatgtactgcaaaatttgaaactattgcaaataacattcaaagtagaagtaaagttgtaataagagtttcgttcaaaaaaataagttgtaagaggaggtatttcaaagaagaatgcagtcgattgccaccacctgttcgtcgattgccctttcacaaatgcagtctggcaaatccttaagagatggatgaatgtgaactttgctactcccggtgagaaggcattgcaccttgctgactggtggctgcaggagagactatgttgtcggacgcgctacagggaaaattttgacagtttcttctttttgacctgctggtttctttggaaggagaggaatgctagaatatttgatcagcgatacaagccagcggtgtagctgaagacatcaaagaagagttcctctgcttgaaggaagcggggatcatcgctggaatcagcgagtagtcggcttactccttcgatatagagctgccctttctctggcctgctctgctctgttctgtctcctccctcctgggggataagcccttggcttgttcctgctcagctgtcttggccgatgtaaaacaaatcatgtatttgctcttttcttctgatgtgtatgccctctgatggcctctgtaattattgaccaagtgtatggagagctgagatcattagttattgattggttgaattgaacgtgcttaggttgcactaactgtaatcgtttacttatggcaataaattgtttacttgatccatttacttgtgctaaaagtgtactctgcatgagtggattagtttactttggttctcttcttcttggactgtacacgtcaagttactgtcagtctgtgacaaacttcttgctgaatgtcaggtgtatgttaaacatgcgttttagttgagattactattgattggttgaattgcatgtaatctgtactaatggcaataaattagttatttgcttcatttatttgtgccaaacgtgtagtctgcataagttggattgagttcagactcttaagtctgaatttcagacatgttcagaattgagttggttgaaatttcagagaagttcagaattgagttggttcaatttcaaagaagttcaataacttagttacttgatctattgtttatgccaaagtaataataccatggaagaaaaccatgcactgaaaacattgatctgcgaggtgttctgtgtcaggtggaatgactgaccaaaattctatggtatgtgggaagcgtgatccatcctattacaacgtgtcgccaaagatgcaatctcctggtcctcatcttaatagtttgtatgattgtcaattttttcattgtcgacgtaaataatatccaaccttttgcgaatcttattaactatagagcggatttcagccttaagctcaaggagagcacaaccgaggactactggatgttgaaataagggtacagtgcactagtcattgagttctaataagtttttgatctattaaacattcccttaaaaacggcatatattgatgactcgagagagcaactaaattaaagagactttttacaatgcttgggaggtatgttaggtaccatttgttatctccatagccaagtgcgcttgtacacctcatattataacaagattggatattgggatggtgctctatatgtgttttggggtcaaccagttgccgctattgtctacaaggctagatcactctactgttgatttgctacttagcacagcaaacttgctccccgacgtttaactgggcatcagcttcagacagagacgcagttgcttctctttgtctgaatgaatagtactagtgtttccgactgacattttttacattggtgaaatgtttgatccattgcgctggaaaatgacttatattcgctaaaaagaaccagtgaaatagaacaaattatctcaaatctgaactttctgaaaattcagacttgagatctgaactcaatccaactcatctcggcgtcgacctatataacacccccacgcaacgcgcagccgcgcagcgccccaacaacattccacactcttccttccttccttccttgtcagcgtcgctgcgccgcggcccgcggccgcgccgcgccgctcgtggtggaatccgctccactccccaatggcgcccgcggcggcgaaggcgtcggatctgtaccgtgaggagaccgaccgcgacgacgacgacgacgacgtcggcctcgccgtcatcctccccgacgcctgggagctccccaggcgccgcgtcctgcgcaacgtcttccgccgcctcccgcgcaacccggacttcgacggcgccaccttcctctccaagccatggctcgcgctcgccgtggacgggcacaacgtcgtcgccgagccgcagcggctcatgccggggctgctgcttccggaggagatggcgctcgacccggcctcccgcgccttcctcagcctcgccgacgggcgcttccacgacatcgccttcccccacgcccgcggcgcgcgctgcgtcgggagctcccgcggatggctcgtgatgctccgggagggccccgagggagtcgtcggcgccgcggccaccgcaactgtacatgtcatccacccgctgcttccgcacctcgagttccgcctccccgacgagttctccctcttcgagatccatgccgccgcggacttggaggagcacgtcgtgcggttgccactatcgaaggaggcgcgcctccgtgccggcctccccctggctgagaggctgcagcgcgtgtacaagcccgacgagaagaactacccctacatcaccatggtcgcgctctcgtgcagccccgccggctccgacgacgacgactgcgtcgcgctctgcgtctacctctgcggccgctgcctcgccatcgcgcgccccgggaacgcgtcgtgggcgcgcgtcaaggtgggctgggagtacatggagccgacagagtacaaccgcaagttcgtgagcgtggtccacctcaacggcagcttctacgcggcgtgctacgacggcacggtgctgcgcgtcaccatcccgccggcgggcagcagcagcagcagcgcgtcgacccctcctcgggtggagaagttcgcggacaggccttacagatcgaagtggtccatgtggagatcgcggtggtggctcgccgacgacggcgcaggctctctggtgttcatcgggactgagcgctgcctgaatccctcggacgacgaaaggtacctctccgtgttccggtgggacgccgagctgcggttctggcgccggcccaagagcttcggcggccgcgcgctgttcctcagcgccggcacggcgttcttcgccgacgcgaggatcctgccgtggtgcgccggcgactgcatctacttcaccgacgacgagagcgtggtcaccggggagaacgtcaccgtgagatgctacgacatgcgcagccggaagctctacttcgtggaagacgctggggccaaggtggcgctggccccacctgtctgggtcatgccgttccatgaatagtactgtacagagacattcatccaatgatccaagcaggtaaatcattgatgtgtaggactttgattagcatttgttgctaggtgatttcttcatgtgaattctatctgtgagtaaatttcatgcgaattacttcatgcaagtttccatggctaccgaggaatcttggattgacaaacttgttttgtagtcctaagcactttaggcaatatatatattgaatgctaccttttcggattgttttgtgaaaattgctggctctagctttacttcccgtgctagtgtttctgaagattttttaatattttgttttgttgcaaaaatgtatagtggtttatttgatgggttctacatttgtgatgccatttcttggcttgattcgaagtatagtctacttcgaaatcaatatttgtaacagctgagagagctacgacatatgtagccaatctattgcattgcatgctaacttttctgtttatcctttgaaaattgttagctgtctagttttacttccggtgctagtggttgttgatttttgcagtagtttgttgtgtggcaaaacggtatagtgttttgtttgattttagctacaatgttgatgttcatttcttgacttgattctagtagttggttaactgtcaaaacttcagttgccattgatgccaaatgcggtgttcatctgtatcgctagcgcttgatgctccgggggccatgggtgctgggaaagggagggccattcatgtgagggtaatatttctaggttttcagattaatcacgttattatgctagctgcaatattggtccaattttacataggctagttctctttcatgttctcgaataaagatgtaatcatgtaattatcaagagtttgatcacccaaatgtattaagccgattcgtgaaaatattttttgttgattttaaaggggattacatgtatgctgtcatggatatagaatacttgcagaattaggaatatagtgtacttgctatctcgtaccatagcaggatgctgaagctttggcaaaatttacttcaactctctgtgctggattgctggtactagtgttgaatttacttgcaatattatatgctgtgttcgaaacatacgtagtctgttcaaaccgtataatgttgtgttgattcgcatttcagatatcactaaactgtaatactctcaatttgactgtttgatcattactccgtagttgtcatcgatgccaaacgcacaggaggctgaattatcgttccaaacggaccaactctatcgaaaatccgtatgcacgtccttgcatatgcagaggcaacattttgcaaatcagatttgccttaatcaataggttacacaagagctgagtttctaatgaaattcttccgaacttggtcgtaacacatgtggcgcggctatgtacgcagcggcagcacagggctcagacgcaacaaaaatgtaaaaaggacacggcgttggtgctaatccattctggtaggagtaccagattaatgaaaattccaaaccaggattttaagaattaagaatcaacaatacgatcacgacaacgttaacaagattctcacataaacttggcaaaacagatcattgtgcacagtgctgcttagctaaacagaacaaaatgccttaggtatataacttgctcaaaaaacaagtgatactggaaggacaagccatgggcgcttaacactgaattctgattctggatggctagaagctgcatgactcatttgagagggatgaaccgagaggagtgggtggcaccaataccgggcctaccgtgcttaaccggcttgtaggagatggagaactccgcaaggtagtgaccaatcatctcaggcttaatctcaacctggttgaaggtcttgccattgtagacaccgacgatgcttccgatcatctcagggacaatgatcatgttgcggaggtgggtcctcactggctctggcttctcgccagcaggggcatcctttttctgttcaagggcatttcaaaagaaaaatattgaggaaaatacaaattataacttttagttgtttgcaaggtaatgaaatcccactaactacaaatcaatactgaatcctacaatagagaagcttttagcaaacaagaaaaaaaaatagtacagacagttgatccattcctcagtaccagtgtatttcattccaaaacagcaataagtaacaaattaaaaggacaagctaatccacacatgtagcatcgcagattaaggaatgcaaaacatcaaatgcagcaaataaaatgcatttgacattagacattctactgtgattactgctggttcagattactttacacaacacacgttttggtagttagaaatattgaagtaatcagacaatctctacttagaacatattttgagaaaatgttgcaaggatagtaacatcttttgagaaaatgttgcgatggtagttttcaaagtgtgtacagatcggtcaaaaataagatctgcaaattaagtagttaaatacaccacatcacaacatgttaaacaagaaacatatcgatttcatttaacttcattacatgaaaggcattgacctattaaatgacatggaattgcatctgcccatcaacacaagtgacatgtcaacaacaaacacagcagtcaaaattcccatcattcaattccccaaaattagcaccttacactaaatttctatcatggcaaaaaaaaaaactaaatttccacaacatcctacaacactgaattccacagatccaacaccatgacagttttatcagggaccagaagtaactactaaaaggactacgcttagtattatctgttctaaattaacatagagaatcatttctaaaacaagaacacgccaatcatccaaaatactaagcatatagcacaaattaccgactctgcaaccgtggaatcatagcagatatacgcaaacttctttcacggctatctcattagtcagaactcagaacaacacatttcaagaaaagtgagatcaagattaataattccagactcaccgccttgcgcagcttcttgatgagcgccatgggcttcctcttcagacccctctggaacctgcaagatcacagaaccaacggatcacaccagatcacacccgcaaaaaaaaagagcattcccgtaagggcaaatcaaatcactggcacgatttcatcacagatgcgagatgtgtgggcagcaacacaacaccttctgcgggcgcgcgcggggaagagctggacgaggtcatcggtggacatgtcgaggagcgcgtcgaggtcgacgccgcggtagctgtacttgcggaacgtcctcttctttggctgtgcgccggcggcgacctccgtctcgacttcgacgtccgcctgcggaaaaacgacgcggtcaccgacggagacatgcacgggggatcaccaacggaggaaagttcgagagcgaggaactcaccatgatgggctcggagcgcgcgggaggagctcggcggcggcggcggaggcggaggcggaggcggaggctggcgggtagggtttagaggggagagggcgagtgaggtgggtaggttatatagtgcgcgtggttgcgaaggccattctcgttgtactgatgggttgggctgaatgatagttgggctgtgtggagtttcggctgggactaatttgccctaggaataagttcatctgaggtatgtcaacgaatccgattatctataatctatgttacctggatacagcacaaaagtggcgtatcagtatcggatacgtgtatggatatggatacatattggatacacttcgatacgtatcccagattttcgcgattttcagttaaataaaaaaaagatacctcgccgatacgtcccaagcgttcctgaaagggttaattggatacgtgccattaaaaatttgccagtttagaaatatgccattactatttaagtatttgtaaccatacactgctgcttgtttgtaattttagtgatgccactaagctacatattttgcatgtattggacggaaataccctcatcttctacctctctctttccccatcctctcctctctcgctcatgacctctcagacccaaatccgcggtcatggcggacctccgatttccccggcgacgcttacaacctcattctccgcaactgcaaccacttctgcgacgtcgtgcgccaccgccttgtcggcgcccacctcctgcgctgggtcaacctcgccgccaagatcggggtcgtcttcacctgcgtcatcctaggcaacggcgaggcagtgcgatgtaagcggaaacccccaccgccggaggcgggaaggccagcatccacagccgctccgtgcggtggtgcgccagcccgcggacgccgctgcgacgctgaagcatctaggcccccgttgttaattttggtaattaatgacaagcgctaattgtggactaaccgttgctattaagatatattttaagttaggtccacgtcatgtgtgcgcatggatgattatcgacggattaaaatttgatggcgcgaagcgaagaaaagaaaacggtaaaactagtgctttagttttaaaattgatcgaggtgaagggcgatcaaatttgctagtttatttttagttttgccgtactatcaagggggtaatgacctagcaaatgagatgattttaattgccacattatgtcattatgcatttagacttgtgctcacttttcaccacacacacttatcacacacagtttcactgtgttcggcctgaccaggggcggtcagaccggccacatagtggcggtctgaccggcgtgccttggccagtctgaccggccacaagacggtggtctgaccggtgcataaggccggtttgaccggcggcacatgcgcagtcagaccggccctctggtggccgggatggtgttgctcggggtggccgatacaaagccgacggagccgtattcggtcagaccgagctgatggctcggtcagaccgccattagctcggtctgaccggccggggcagtggggcccaatgacagccctacaacggctagaaaactagccgttgttgagtagcacggtctgaccggccacatacctccggtcagaccggcagagcacagagttgggggatttcgccctcaacggctagttttggttggtgggagtataaatactccccctccagcagcaaggggactctcttggcacccatttcaattgcatacaccccttgcacctctctcacacccacttgagctttgtgttcatccatctagtgtgttagagggtcaattagccaagagtcaagtgcattgctt

SEQ ID NO: 22543 - DNA, 10903 bp, Oryza sativa
cttaaccctcaccgagtctagcaacttaggttagttttgattaagtgtcatttagtttttatatcgcctattcacccccctctagtcgacatctcgatcctacagccgccacggcccaagacgttcttccgctccctctccgccggcggcagcaagaacatgacgccgtggctactcttgacctcgccgtcgtcgtcgctgcatcaggcatcgaggtagtcatcgacggcgaggtgaggcggacagatctgggacgtcgttgttggtgtggagctccacgtagaaggaggttggcggcggcgcgaggtagagggagacccggcgtcccgggtgaaggagtgctgaaaaggaagaaggtggcgactgctttggtcatgtccatctccggccacacttgtcaccgccgtcgccgaattatcgccggtctctcatgctgtggaagataggaggaaggagaaatgggaagaaggaagaaggggaaaaatgggtagtttggtccaattttttctggaaatgcatctaagagggtaagtagtggtatcttttgaatatgtataaaagtataatggcatatttccaaatacataaatactggtgacatattttgaaacgggcaaatttttaatggcatgtatccaattaacccctcctgaaatggttccatctgctattcctccggacgccccctcatgaggtcccagtgccgccaccgtcgccacacgccgaagcaacagcatcgcagctgggtgtagtggaagatcgcgcgcgccaatgccaggcggaggccgtatggccgccgtcgccgctgccaccccacacaacgcctccgccggtggcaccacgggagcacgagcattcttttcgttctcctgggagccaaatctccttgtctagctaagttcccgcgcttgatctgggtggtggccggtcggtaggtgctggggtccttacttgtctagtcggcacttcagttgatattgtaagcacgacgcatcaatttgcatccatgatttgccatcatcttgttaaaaagtctactagcagaaattttgaatagtgaaaagatgattgttttgttcatcttaatgcagattggagaataaaggatctgagaattgaagatattaatggcaattctattgagccttcctatggaacctatcaccaggactaggatcctctaattttagctgcattaatgtcaggggtgaacattgttgtcacttttgaagttttacacgtttaattagaggacagcaatagaaactaaaattagaggattaacttggtatgttacctgatgagtggtgaatcattcatgtatcttatatatcactatttatgtatgcaaaaggcaactcagtgtattgagagttccgaagcttttaagtgattactttcagcacttaacactaaatgattgtccataaatttactcattcatttatgtctttaactaatggactgtatttgatcatataaattcagtttctatccttgatttaaaaaagtaacattcagttgtaatctctcgagataattttcactcaatgattatttaacatcttttcatccggtgtaatatgaaattaatgcatagcatttcccatcgcaacgcgcgggcatgtaactagtatcatataaaatcgtactacctccatcctaaaatatagctatttttagctataaatctgaacacacaagtaagattcatagctatttttagctatgaatctgcagaagtatccagattcataactaagaatgcttatattttgggacggagggagtataaacttgccgatgggtattgtacacagtgtacagtacattgtacactgaattcgataagtttttatagtgtgaacgcgagtttaaaaattttggatccgagttttacccacatgtaataagagtagccgatccatttggatatctatggataacctattaatataatagacttatagtagatcgaccctattaaaccatggatcaacgaactcacttaaaacggtttaggttcaatccatatcctaaccattccaatcctgatgtacactgttcattcgtccacgcggccacgtcgccccaaaatcagtcgcgtccaatctctttcccagccacgtgtttgcattgtatcgggccaggccaattgagcccaccacccaatcgctcacgacaggcagaggaggaaaaaaatggggcgctgtgaacccgctgattccccattctctccgggaaatttaagtatttgtcactcttgtgacatagtaattaacgatttgccacatcgtatctataacatgtggattctcatgtgttataacatatggaactagtggcaaatcatacgagtggcttacgagtggcaaatagttaaaatcccccattctctccaccgcgtcatggcctgcgacggcgccgccgttcccctttcatctcgacctcgggcacgcagctcgcgtcactcgccgtcgtcgcttcccagcgaggccatccacggccaccgtcgcttcttcccggagaccgccgccatctccccacccccgcgtgacaccacttcttgccctctccatctagggttttctcgggcctcgaatcgctgtaagcccctcgacgacttctttggttgttttgcttggatctccagctcaggggagcgctgctttgatttggggattgtgcctctcttgcctctctggtgtggagcgatcagtgtggcgttgttttctcttaagctagggttagtgcttagtactgtaggtgggaaagcaatttcttttttttttggggggggtggggggatgaactctcggcttcttctttagatggtacctttgattgggtgtgccgtggaattgcctgccatgcttgataattttggtatcccctgtgtagaaagcatgttccgctgccacggaggacagggatgcccctgtgcttctattatctccaccaaggaggctgttgcattccagatctccctgtcgggcaagctcgggaggacgctacattgagccatgatgactgcaatacttttaggccttgagaagaggatttggaccactggtggttctgaccaagatttaacggtatgtgtttttctgtatgttttcttccttgtagtgtctattcccttccccacgtcctgatgattacttgctcaagctgtttgattattgttgcagcagttacaccttcagttgaccactcaaccaaggtatcgatcagttttggtccaaaacatatgtttattctcatgcatcgatttgcaatgaccaaatctatgcttcgatcttttaatttgctacagttttccctgcttctctaatcagtaccattacagatttgtctctgtgactgcttactgtactttcaaattgctttacagtgcatgcacaagtctgttgcctattttagtactagccaatatatagatgttcccaacgaacatggtaaaaatattctctgcaattctttgcttctatagattctcatgcatacgatatctgatcgatatccatgaatccatccttcttttgcatggttttcattttcagaacatttcagctttcggtatatgaagctcaagaatgaagtgaccgttgtctggcttgcaacctttccagggtacaaatcaatcagtttggatatggaacacgcattgtacgggttgctgcttataggttgtttggatatcacttaatggatcaaacaagcttgtcatgtttgtttatatgcaggtgctatttggaattaagtgcagtggttgtacgggttaattcaaacatatgtatgtctagattcgtagtactagaatgtatcacatccggtagtagattatttttttataggacagaaggagtagagttcagagaaagtggctagcaagtaggccccacattttttatattttttcctaggcacttaaatgtgggctttacctgtatttgtgactgggttgctccatcatcacaaagttgactaagtcaaaaggtcacgttaacaaaaccatccaaaacactatcgagagaatcaaaatttatcggttttagtaattaaagggttgagatatctggcatggtatcgtggttaaagggatacgatttagattcgacgacaagttaaggcagtcaaaacggacttaatctgatttttgttagcaaattttagccatctagttgtcatgtattaacattaggaaaccgaggacggagagagaggagtgaacgggggcacggttaacgaccaaaggcaggaaagaaaattattattaattcaaatcctgatattttaaattaacaacgttgctttcaatgcactgaatattctgctataaatcatgttaacgattttaaaacaaagagaattcgaaaaaaattatccctgacctttctgattattaaatatattgttaattagggttttctactggttaaccaaagtaatttctatagacaatttacagtaaattgcgctcatggtatctgaacttctatgaacttatatggtaggtgcaaataggtacaataacttgcaggtcgctcattcacacatgggctaaaacaagccacgcaagaaaattgatctgaatctacccgcaaccttgatgatatgtacgcatcaaaaccggattgaactaatccattccaggaaaattaaataattttgaacggaaactattgagatcacatcgtgaaaagccaaactgccaattgaaatgtatcagtaataattagaagtcaaaatggatcagtgcagtcaatcgtgacagtgtagtcaatcgtgatggaaggaaataacaatctcatcttaaccggagcctgtgcgcctaaaggtcttagaattggtgacattatgtttatcggctaccaggatcacggttaggtcgatgtcatagtgcagcctttgcacctatccctaattccctatacacacttccagccaaggatcactgtgtgtaccaaaccgatgatatcctagcacgctcaaagccaacccagttctagccgaggatcatgataaattggtttgcccagcctaggacaagccgatcaaatcggtgagagtgataggagaggcaaacatcaggtgttttctgtaaattatatccccaaacaaccatacggcgtgcaagatggtatgtcatccgtgcgccacgccgtatcattttgctagcatagatcgttttggattaaattagcacggattagccaagttattatattaaaacaagcaatttacaaaatgttgtacctacttgcacccaccacacaagtttatgtaccgtgattgtagtttactcagacaatttttaatgaattagaaattacggaaaagatgaaactccggatgtgacaaccatcctgaaaaataatcaaaagcttgattgtttagactttatgcttctctgcatactttgcgatgcatcatccctagcggtgcttataatcataaaaactaacaaacatgcttttggtcataataaagggtaaaatctcgttgcagtcatctaacataatcatgctttacactatattctcctcttatatgagtagattattatatataaatatatttagtccttaattgaatatatttatataaattggcctacaggtataagatcatatcggagtagtagccaatacgttatcatttcctttattttattctattttctactccctccgtcccacaatacaaatgattttaagtttttgatggcaacgtttaaccactcgtcttatttaatttttttttgcaaatataaaaaactaaaagttgtgcttaaagtactgtagataataaagtaagtcaaaaataaaataaataataatttcaaaaaattttgaataagacgagttgtcaaacgttgcaagtaaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaagaaagagagacgtcttcggctcttcgcccgccgccatggcagctattctccgatccctgggtcgctcggcaaccaccgccggcctcttcggccgccgctgccgcctccttagcgaggcagcttcagatcatcaggtcagttccgtcgctcgccatcttcttctctttctcgcgacacagacccgaaatattttcgacgaaaattttctccatctcccccttatcttcgatctcccgcgcgttggggctccttcaatttcatatgggaaggaacaaatgggaaggaatagatttgtaggatcttgtttggttaatcaatttcatcatatgggaactagattggaggggatttgggaggtgtgcaatgtcacagaccaacacaatcacaccaaatctctcacacacagtgccaccgatatattgcaaatcgtgttgggcgacacacaattgcaatggtgacctttggaggcggaatttgagccatggaggggttggtgctggtggtgcccgccaggtgttcggtgaaatgctggctgggagatgacgcgggcgctgttcttcatgtccaagtgagccaagtcctttatccggtgaccggcgaggtactgcatcaagtttacaacacctatggagccgtggctgtgcaggtcctcaccacgagcccttggggtgttgaggcttccgtgtggttccgatcaacctgcgatgcggagagggctcgttctatcactaatggacgcaatatctatgatgggtgttgcctgcttgatgtccagcacgtgcagcccactatctgacccatagtgtatacgaccattgggtatatgacatgcaattaatccccctaatcctctccaatccaatccccatagggataatttgattaagcgaacaagccctcactgatcgattataatcaaatctaacttgccgtcctctaatttgtgccgttcccgtggaggcagccgaagaggattatcggtttgtcaagcggtgtgcacgttaaaagaggctcaaggatgcagtcgtcgcggcaatgccgcagtaccccgtcgatctgctcctcccttgctgcttggtttccttaggaagtctggttcctattatcagttagcatatttgtggttaaggatggttcagtgccacagaacatctgttcggcgatgtactgtgattcattcccttgaactctgtctttattaataaaagtttgagttttcaaaaggaaaatctaacttgcttacttatttatgcctgattttgatttgcataagaagatcgcaaagaacagcggccacatgaagaagggatctgcttcggcgatgatgcagcaggaaagggatgctgcggaatcgggggtgcaaagcattgggggagatgatcttgctcctagtcctcgcttgcttttctggtgcaataccgattcccttccgtctgtttctacgactttcttgctgctaccttaaatttaactcttggtcttgatgatgatttattgagtttcaggagtagaacttaaatttgagtcttggtcatgctttattgaatttcaggggtagaataatccgtttatccatcatcacctacgcaagcttcaaacttggacaaaactctgctagaaacgcatacaagagaaccaaggcagagcttccatgcttagaagctgttgacagcacaactgcgtagctctccctccatcttttcatacccaccttgccttgagctgcccctttaattatgcatggatcagacctatgtatgtttgttttccaagtaatctatatctccattgggcatgtcacctttagttatgcatggatgtctcctttatagatccacctgttgatgttttctgctaatcgatgtctccagtgagcatgcatgtcaaagttggaagtttgtgtgtgctttgatgtaatggaaaagttggaagtttgaagaaaaaatttggaaccaaacttgtaggctgtgtttagttccttccaaagttgaaagtttgggttgaaattggtacgatgtgactgaaaaattgtgtgtatgacaggttgatgtgatggaaaaagttagaaatttggatctaaacacaaccttgatgtgatggaaagttgtaagtttgaaaaaaaactttggaactaaacaacagggctaggagttctgagggatgtccggatgtgataaaacagatgtgacgccaggtatgaaaacgaagatattacaaagtgtttgcgcccccccccccccccacgcccccgcccccaaaatcctctttgattcacttccattaatctgtggttttcttccattaatttgtggttctctcgggtgccacatctgagcttcacacatcctccaagcaaagagaactttgcttggctgcttaatgtgatcttctgttgattcacacaatcacccattcttcaaggtacagctgcaaaaaatcctaacttgtttgacacgaatattggcactatttgatgaatgattttgttgactaaaacacactataccccccccccccccaaaaaaaaaggtttttgctatgcatcactagcgtgttttttctttgttcggactcaaattttcatctgtcagatcatagcttcaagatctgtgttgttcttttttttgggtgcgcagccaaactagctcgagcctgtttgctctactgatcctatcgactatcgagtgaggtcgcacgcactagcactagctagcgacagcgatgtgatcaatggaaaaaaaaatgaaaatatacattttttttcatattttgcgtttatatacatagttggcgaagtttagcgaaaatatacctctcctgcgcgttgggagtgcgggagcagaacaaatgcacggcgtgatggcgcgggagcgatttgccaaacagtgctgcggactgggggtgcgggactggcttggcgcgcagaccgtgggggtgcggaactggcttggtcacgcagaccgagagtgcggaaccgagtcggtctcgcgcggtggctgtgctcatgcgtgtggagtgcgggaccgcaccgatggctgctcagtcgcgcagaatggtggcacgggaccaaagtggtaccgcagtctgaaggcgcggaaccgagccagtcccgtggggctacagttccacgtttccgacgtgcgggagcgtgtcaaagtaaaagcaaatcattgaacgcttttctaccctatatatcttcaccaactcactcttacacctacattactcattagtaatatgcccgtgctaaatgctacggtgcaattccattgtctttaataacttttaaaatttcatgttaggaaaaaaaaatctatgatatgtgcaccgtatcggctcacctttctacatttttcccctccctatttatattttcctctctatctgtccgacttccattttttccccggtataatcaggctgtgttctccaaaaagaaatatctccttccacatgtaaatagaacaatgaattagcacatgattaattgagtattagctaaaaaaatttaaaaataaattaatatgattttaaagcaacatatatatatatatgtatatatatatagaaaaactattctacacccggatatagaatagttattctataccccctccctccaacccacctcccctcccttcaagagggcaaaacacacccccccacattggtcaaaggtcccccacctcggtcaaaccagtctgtggctttccccaccaccttcactcttctcagttctcgtctcagaaccgcgtagtaatgtgatgttcatcatgcagtaacgctatgtcttacgtgcagtaacaacactcaaatttagttaaaatatagccatgacggatctacttttgataagcactttttttctaacatcatagtgcaaacggtttaaaaaaaatcatacatcacgtgagagatattgttgttcgaagcttgggttttttggatcttgactatccacaagtagtaatacttagtattagttactactatctattgtgcgttactacaatcccatcgtgacgttattgtaacgttattgtaagtgtgcagtaaagaccataagttttgtagtaacaatgcgtcttactgcaattctcgaatagtgttactgcataaacatgcggtaacatatacctgccatgcagtaacaattccactttgtgcggtaacaattatatttagcatgtgatacttttaacctatattttttctgattccaagtttaccgcaatctcaccacaatgttactgctaaacgtgcagtaacgctctatatgttctacagtaaaaaggtgttttactgcaattcttgtatagtgttattgcataaacatgctgtaatgtgtaactgtcaggtggtaacgtgtatctgtcgtgcaataacacttttacttttgtgcaggaacaagtatatggttatcatctaaaactttgaacccatatatttttgtttcaattcctgatttactgccattcaccataatactactgtcaaaagtgcagtaacgtcatatacatgcatgcagtaacacta

SEQ ID NO: 22544 - DNA, 2342 bp, Oryza sativa
ttgtagtaacacttatacttttatacagtaacaactatatggttagcatgtgaggctttaacccatatatttttgctttaattcctagtttaacaagtgagatatagtctagtggttgttcttatgttgatttagttgaaggtcttgtgttcaaatcctattgattgcaaatttttattttattttttcactctaaaagaatagtcttatatatatatatatatatatatatatatatatatatatatatatatatatatattaaaaaatgccctgtctaacaatttaggaagcgtgcacgcaggacctttcgacgacaaagagacagcgtgagtgcaattcggagagacggcggcagtggcgcttgcgtgagtgcaattcggagagacggcggcagtggcgcttcaggcagccgcacgttgctggaggggcaaggcggagggatggcagcgtgatctctttgaaacaaggggcgcttccggttgtgtgcgtgcttcaaacaactttgtcttctccatattaccacatctatagagtctaattttctatgaggaactactgagttcaaatgcgaagacggtataataatacgctatgatgacaatgcaacggatatcattagtaaaaaggaaatccaaatggaacttgcgtttttggcgcgatcgtcgagtaattgagagaattgaattttactaaaatagtttctagcttatgaagtattaactgtcaaaagggaaatttgagccttctttgttgtacttgctaattcaatgtatacacatataagctgtaacagatggtttcatatttgagccttttttttgctgtacaagctcattgcctgtaacaaatgctcattgttggaaaataagagagatcaatctagaaatcagctcctctagttgccaagctgcaaacgcatgtgaatggaaaaaacaacacagtgggtaagttaggagaaggtgactttttctctttttctgaagtaaaggttggagctttgctcattatattaagaagttggtttcagactataattcgaggatattacatagaacaaaaagcaactgaactttcaccataaactccattgcatagcgaatatagtaagatgcacggccagtttttttttttgttaaatttcctgcagatagaaccttgtgtacaaaaaccgatccaaagaacatctgcctgggttcatctggtgcccaacataatgcttttgaaattgttacaggtcattgaatgatgacatgagcactgattgcagctatcaatgcctccaaaaatcctaagctattattagaggggcatcaagcttacaaagttatcttgaaaggagaggctaagtggctatggagaagagaaattccaatgaccgcttcttcatcgtcaatctccagccgccgctggccttcgtgaggcattttgccgcttcacccacagttgtccagcaggaactcaatggctgggtgctagcagccaggaggatggaggtgggcacaacgtgagccccaatcagaaaatcgaagatgaatgtttttattgaaatggcattgcaactttaacactgcacttcatttgtcacctgttaggatctggcatgggcacagatcacttttcagtttgtcccatacattaagaacttggaaattaagacaactgtaacaccacgatgtgcatcagaaaccttttgggacagcaatagaatgcaaacccatcattgatctgctcaatctctgtagttgaaagtaagctacctatgcccatatacacagaaaaaaactcacaatgtaattgcttatataaccaggaatgagaaattagtaaagaaataaatgaattttaatcagatggtcgttattacaaatatcggaaatctccaatatgcacagttctgcaagatgcacataattatcactgtaaacaggttaacaaggattcatgattatggaagaatgactacaaagtttgattgcaacagcatggaaaataagtttattttttttatcaagctgatggagagaaacaatggctatatggacaggtaatcacataattaattatgagtacaacatatatgcgtgcaccacaacattgtttcaggaaaaatgaatttgcatcctaactaaagaagaatgcgatcagttataagccaatatggaagtaggagtgcccacaatcccacatgggggaaaaattccaatggtcaatatatgattcattcaggaaatcaactgattttttttccaatgatccatatatttatatatatatgatttatcataactttccaagatgatcatacctatattgtttctgaatataatccaaaatcatca

SEQ ID NO: 22545 - DNA, 1110 bp, Oryza sativa
cgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaagaaacgggcggtggccaccacattctgcggattgtaggtggtgtacatggacttcatttcctcacccttgaggaaataggaggtgcggcccgttagcaacgcaacgtaatctataaatagggatcaaatgaaaggtggagataatccaggtgttagataaatacaatagttctcttgttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatgggggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggtt

SEQ ID NO: 22546 - DNA, 730 bp, Oryza sativa
  unsure (1)..(730): unsure at all n locations
tttcgcttgactagacacacagctaatgttcagtttaccaaatctacttgataacacttaattaactatgacatagacattattgtctgatcaggtttaggtcatcacatgaacagttctacaatgaacacatatttacatctgttatttcaggcaacaacttactttttagatatggccttctcatcagatgtgtagatccagtctatgccctttatagcagctttttcaagggggtcaccaacctttgataagatgaaacataccatcaacaaaagaaggtatctaaacttccgttggctatgcttcacatagctagttatttctgacatatagtccattacataccagtttgttatctacgaatactaatgcatggcaactggacaatacttcttgtgtgcggagtggcaatttatttgcatctgttattaattcttcatcatcttccaaactaacaacaccttggaattcctgaaatgcatgtcacctcggttgacaaaattccacttgaattgaaaatacaacacatgggtaaatcatttaccatgtcatccgatgtcaatgtcccagttttatcaaaacagcatatgtcaacctgataaaaaaaataaagagcttttaaaagcttttgcaagaaggattaaacataagcacaacaaagttttttttattnnnnnnnnnnnnnnnnnnnnnnnnnnnnnnnnnnnnnnnnnnnnnnnnnnnnnnn

SEQ ID NO: 22547 - DNA, 542 bp, Oryza sativa
cgatgcagacgtgcaaggggaacacaaggacggtttgtggctatttgcataaaggcggttgtaaaacattttattgagcaaaacagtaaaactgttgagtaattaaagtaacattaaatctgcactgatcaacgctataccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcgg

SEQ ID NO: 22548 - DNA, 686 bp, Oryza sativa
cccaaagagaggagggaggattttatttgttttctttttattttaattggttaaatgatcttcgtgactttaaaactatttctcgagctccgaaaattcacggaaaattccggagagtacattagggcacaaagaatattaaaaaatattcccggccaatgacttttaagggaaaattttaattctcccattatttcacttgattaaattgctttaacttttatttaatttccagaaaatgcattatttaatgatttaaaacccgaacgaaaatcggggcgttacatcggattatctcatagatcaaactagtcttgttttggggttttcttcttcccatgtgctagctcatggaagtgatgaaggttgtaggaggtggtggcttcatttgtcagaggtggcaaaatggaaggtttcgagagaagaacccacaaccgacatcttggctggaggtggagatgtaggcccttccttccggcttggaagccgactgccaaagctgcttttgcggcagtcaggaagaatcaacttaggggagttgttgctcctagttgaagacctcgacgatggtggttgtttggtgcagtggttttgtgcttggctccagatctgcagggaagatgttgaccggagtattggggagggggggggggacaagctttgcgctatgacatcgcccgggacac

SEQ ID NO: 22549 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnnnnnnatgggtccatggctactacaggttgcccacagtattgctatctgctagccgaggcgaaagttgttgcaggtcgtctgccgcaacgggaggtatgagctgaaacccagccgcgacccctccaggtcaaactccagcaggttgtcctccatcatgtgcccgccgatcaccaccgatgacggatacagcgcggggccgccgtccaccacgccaaggcagagcgcgccgcccttggcgggcaccatcgagtttgccccgtacatgatccacgacacggcctccctctgcagcaccagctcaatcgtcggcaccgctggccccgcgcgggtgctccctactttgcgcccgtcgtagcacagctcgaacggtgccacggccggcacacgggggatcgtggccgtctcggccgcgaacgcgtcgatgaccgccttgtagatggaggtctccagcacggtgtaaggagacgccgtgctcagcgtggtgccggctacgccattcttgtcgattgccaagagcgtcgcgttcagtggcacgtcgcggccgttcaccttgatgcccgtcaagccgatgaggtactcgatcgacgtcttccccgtt

SEQ ID NO: 22550 - DNA, 659 bp, Oryza sativa
  unsure (1)..(659): unsure at all n locations
tnnnnnnnnnnnnnnnnnnnnnnnnnnnnnnnnnnnnnnnnnnnnnnnnnnnnnnnnnnnnnnacatttcttcacaaaatgctgcgcgatttttttaaatttctgccccttctgggactgaatgcaaaatctttttctatggtttcttttgtgcaaccaaacataagtgtgccttatactacatggcatctgcattataccaaaagtggccttaccatatggactctatgcaaaatataacttccaacttctaagaagcagcttttatggactgtaaagaaaaaaacaatgtagcgggctttattatttctatttgcgcgttgggaagttgttctgttatcctatccactataagaatacatcatgtcattaacatccattttccattagtttgtgcctgatagaattaaaatttacattccaaatgcatattttaggatcagaaaaattattttgcttgatatacaatagtaatgaatggtaacgttcttatttcaatagagaaaacgaggctcctccacagactccattggcatgtatgcagttcaatgttgtgagtgtcacaaatggcgcaaggttccgacgaaagatgaatttgagacaattcgtgagaatttcactgaggagccatggcactgcaataaaaaaccttactgctc

SEQ ID NO: 22551 - DNA, 920 bp, Oryza sativa
  unsure (1)..(920): unsure at all n locations
tgtgaaatagtatatcacatattaatttgggtattaatttatcttatagttttttaggatatatataatttttagacagacaagaaacaagaaactgataacatccgccgagagattaaaagaattcccctaaaagtatgtatgatttcgccaaatttactgatgttttttcattacaacagagattgcaaaaggctagcaccgagatacttcgcactatcacatacagaaatgcagaatttatacaaagtgagtataactcaactgatcaggtttcctgtggtggaacctgtccaccaggttcaaatcttaaatttaacatgggcttgtgtttgtatcatttatttaaaaagaaaacaaatgagctaccctggcaactgccggcattgctatatactagctagctagccaaggtgaaagctgttgcaggtcgtctgcagcaacgggaggtaggaggtgaaacccagccgtgacccctccaggtcgaactccagcaggttgtcctccatcatgtgtccgccgatcaccaccgacgtctccggggctacgcctccatccacaacgccgaagcagagcgcgccgtccttggtggccaccatagagttcgccccgaacaccacccacgacacggctttgctctgcagcaccagctcgacggtcggcacggccggccccgcgcgggtgctccccaccatggtcccgtcgtagcaaagcttgaacggcgccacggccggcacacggggaatcatagccgtctcggcggcgaacgcgtcggtgaccgccttgtagatggaggtctccagcccggtgtaaggggacaacatgctcagcttggtgccgcccactccgctcttggnnnnnnnnnnnnnnnnnnnnnnnnnnnnnnnnnnnnnnnnnnnnnnnnnnnnnnnnnnnnnnna

SEQ ID NO: 22552 - DNA, 678 bp, Oryza sativa
gatacctggaaaaaaaaaaagatcaaatcaaaaaattagttcaagactaccagattaaccatgtcatacaccagtaattcgttaactgtacgacaacacaaatgttgataatgagaataggatcagcactgcaacttcgtacagaattatctttttgcagttttgttacattactcaactgtcaggactcaggactacagttgcagatcaggaacaaaacaagcctcaaaggatggtaagttggttacaaccaacaagcatttgtagtgacttcgctttagtaactttggctgagctatttttcgcttacattctgcacttcatgatatgcagctgtgtccaatgagacaataacatattggtcgaatagtagacaaaagaaatattaccgagaaaagggttcatgcactagtactatgtctgtatagcaagatacaatcctggtcaagactcaagacaaagaggatatgtctagagacaaacctaaaattaacatttcatacaggatcatagtaacaagctgatttttttagacaatcatatgtatatacacagccagtagtaacgggctggtaaactgataaattttgtcttcagagtaaaatatcagatactgttacacatgaaattccacatgtaattctaccatttgatatccaaagtacagctggtacttaa

SEQ ID NO: 22553 - DNA, 1141 bp, Oryza sativa
  unsure (1)..(1141): unsure at all n locations
gagcgtcgtcgtggtcgaaccggccaaaggcacggcaaggcttttgccagcgtcttcacattactcagacaagcaccccacgtcgacgaccatggaatagaccgtgacgtctcacaagcaatcatacctcgacgtgaccaaacacgtcagcgcatccacatccacacatcgcgagcaggaggctcaccaccagcgagcaaccctgctggagcccgcctcgactccgcatagccaccgagctcgccggagccctcccgagccatgcaacaccgctacacgcaaccgccgcccacgccacgcccgctcccggtctcctcctttcctgccgcccaactccttccccgccttcatatgctgccgctggcgtcgacgcgtcgtctgctgcacggcgccaccatcgccagccatcaccaccacggccgtcagccgccgtggtccgccggtcatctccacgccaccatcaccagccgccgccgccagccgccactatcaccggtcgccgctagcagccgccgcccatccagatccggccggggtggcgcgggtccgggggacggagcgcgccactcagcaccaggctggagcgagacaaccatgacggcacggcagaggtccctgttgtggtggtgtaacaccctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataagacaaatattgagtaaaatgcatatatgcaaaattaggaattgtggaatcaaatttatatggaaaatacactaaaatcgggannnnnnnnnnnnnnnnnnnnnnnnnnnnnnnnnnnnnnnnnnnnnnnnnnnnnnnnnnn

SEQ ID NO: 22554 - DNA, 1314 bp, Oryza sativa
aaaaagaaaaggaaaagagggaaaaagagaaaaaggaaagaaaaagaaaggaaagaaaaaggaaaaggaaataaatagggaattaaagggagattagggaagtttagaaaatttaaaataattagaatttagttatagattagttatagtcgtagaattgcgaaatttaatataaattatggattattcttggtaatttctataagaaatcaattcgcggtagtaatttagatgtaattaataactaaacaaatagaggaattcttatagattattatagattatttttgggtaatccctataagtaatcgattcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgagaacaaaacatttatacctgcaaaatagtttgaatcgaaattgggtttgccctagtacgcgaatagtaaagttaatacaaaagaatcgactttcgcgttcgacttccatttggatttatttggatttttatttgaattctaatcgaatccaaatcaattttcgcacgtaactatagagcccgagggagttgcggatccaagtgaaggccaagacccccaagactttgagcaaggcaagtcatcactattccttgaatatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacataatttgtgaaaggagaaataaaattaaacaactgttttcgactggggcggacggaggatttgggtggtatctggaaaaggctagtatcgtccccggtcaattaaggactgagccatgaagttaagcatgaaacgacccccgtacaaccgcacttctcgtatgggtatagacctagcggattagatagccgagcggaggcagtatccctgcatagatggttcacccctgagtgaggcaggtgcgctacggtgggacagccgttgagg

SEQ ID NO: 22555 - DNA, 12845 bp, Oryza sativa
aaatggtactgtttacacgaatgattcctgttataaaaacgggggtctacaggtggcctggacgcgccgcggtccgccaccgacgttgccttcagtcgccgtggtccgccgccgtcgtcgccaccgtcaccgtcagtccccgccgccggccacccccccttcagatctggccggaaacggcgcggatctggccaccaccaccgccgccccggacagctccgccagccgccgagcgtgggaagggcgaggcgagaccccgccgccgccgtccttgcggctccgcggctttgccggcacccgctcgggcggcggcgaggtgaaggagggggcggggggaggaggaaagcgtcggcgcgcgcgtcgcctcccgagccgcccgggggagggcgacgcgagggctattcgccgatcgatgtggcctaaaagatctcaactggatttttacttgttgtttctaaatatggtcaccaaactttgatttctcggatatatatcgcgaaacatgcatcgcatgtgcacgattactagcaatacaaaagaggaaaactaactccacctttcccctacaagactacaacatctaagcactttccaataaagccatacaaatggacaacgaatgccaaccaatgccacatgaataggccaattcttacttacctagtgtaaaaaaggaagaccgactggacactggacctttgcacatcgcttaaggcatgacgttgccagataaaaaccagacaagcgtacaactagttgttgacacctttttagtcacgccacaacacgatcggaatccacctaaagttttgcagcgtatggagtctccaaccaccttgatcttgagaagcccctgatcaagatgggtttatagatcaaaagcaactaacggagccgatttagacaaatagggataaacacccgtcttgtgggcggaaccgaatgttttagggacaaacctacacagatgactcgcactctcgcgacgaagacggacaactttcaaagcaaaccaacgaagatggatgaactaggctgaaaactaggcaaaaagtatatgtgatattgaaagaacgattcaattggctaattgcgctgttgtagattgtgtgcctcaattgaactggccatggcgactacaacaaaaacctcatataaagacacttttgtagaggtgttctgcaaattgcctctaagatctggtgttttgtagtgtagagacactttacacagacactttgaaaattgcgtagaaaacttttactttagagacactttagagatattttcagcacattttattaaattatatcttgtagaagtattctttcgacactttaaaatgtacctgatatgtaaatgcatttcttgagatattttaaactttgtacaaacacttactttttagaatgataatgtaaactgaagaactaaatataaataactcaaagcacaaacatacaagtaacgacataaggttgagttcgctagtgcattgaagataaaaatgatttgtccaagagatcttgagctcaaggatttgcaatagcaagggaaaaatattttactccttttttacattggtttcatagggttgtggtacaatttaataatttaatgcctctaccattttatagacattttataaaatgtctctttgcgtttcatatggttgtggtataatttaataatttaatgtctctagaaaatgcccataccattttatagatattttataaaatacctctttgtttgtacagacaattcaccgtaagtgtcactagaaaatgcctctaccatcttatagatattttataaaatacctctttgtttgtagagacaattcaccataagtgtctatagaaaacgcctctaccaacttatagacaatttataaaatacctcttgtctgtggtgaaaaatgcctctaccatcttatatattttataaaatgtctctttgtttgtagagacaattcaccataagtgtctctatagaatgcctctaccaacttatggacattttataaaatacctcttatttgtggtgaaaaatgcctctactatcttatagacattttgtaaaatgcctctttgtttgtaaagacaattcaccataagtgcctctggaaaatacctctaccgacttatagacattttataaaattcccattgtttgttgtgaaaaatgtctccaccatcttgtagacattttataaaatgcctctttgtttacacagacaattcaccataagtatctctagtacatgcctctaccatcttatagacattttataaaatgtctcgttgcttgtagagacaattcactataagtgcctctaccaacttatagacattttataaaatgtcttgtttgtagacacaattcaccataaaacacttcttaggtattttattttaaaatgcctctacagtattgtaaaaacatttaaaaagtgtctccacaaagcatttttcttgtagttggctcttattttggggttggtcttgccttccataggtatctctccacgtcccactaggtgtacaaaccaaataggactaaagaaaaccttagcccaagcaagggaacttgagaaacgacaaaatcaggcacggagtcagactctgccagtctatctggccacatgccgtcagttagaccggccccacactgtctgtctgaccggctctatgacgatagtcagacttgtcgcgcgtagcaagctaggtccttttcaaatttggctatattttcctattttcgctttaggtgccaaatttagggttttatgtcacatactccatccaagataaaaaaaaatctaaatctaggacgaagggagtaggtgaatttgtcatattcgatggagaaggaaaaaaaaaagaaaacttggaaaactgtctagagccttcgcacatagttttcgaatacgattatgctttaaaaaaacaaatgaattcacaggtaatagcagctaaacctctcaaatgtaataccagcaaaaccgtttaagaaataccagcgaatccttagaagcacctcaaataccaccatactttttatttttcgtgacgtgaaatggttacgttgttgcaaacaaagcatattattttgtctatagtatgaaaatcttgccccagcgatctctataaatactgagaacctctagaaagtactccaaactatcatcagccatcactttcccccaccttatcaatctgccctcctgaccctagaggtgaccatcatggctcttgaggtaattatgtgatctgatttttaatttctactttgtttcgctttcgctctcatggattagtgatgtgtgtagtgttattcatacatccacgcctttttcctttcttgaatcagacaccctaagtccgatttggattccgaccctctttcaaactctaagtagtatttccccttataaaatttcttttatgggataggacatgagaaatttgagtccaattcttaacatgtgtccatgtccttagccggatttggattctaactccctttcgaattccaagtagtatttccatgtataatttcttctatgtgatagggggtatgacattacaaatccgactcgaattcagaacaagtttccatgtccaggtgacacagatcaagagtgttgatgccgtctgttctgatcattcatgtcaactaataatcatcacttccttaacatgtaacttatccaaatcataggaggcagagtggccatgatagggattttttatgaggtccctcttggcattagtcctatgatatgcacgttcttcattggtagcacaacttacttgtgtcagtgagacattagcgagcggcaaatcgtgtcgtaaaatgttttgagtgtcatatcctagaaccctaccatggttacatgggcgaaataccttatattataagaccgacacacacaaacacacacgcacgcgcgtgcgtacatatattagctatgatgtattagctacataagagggggggggagggggttctctaggagccgtgatatactgtataacaacaatatagaattgaacaccctatttatacttatatctttgattgaggagagttattgcaaggaagaaaatgcactatttcaacaaattattctctactaggtttccctggatagcttccatatacatcataaactttatgttctacttcaattttcttttctgaaatataactaatatttttcttctaagttctccttccagtcaaacttaatagtttagttttcccaatgtcaaatattttttcctggagtagttttgaacaaaatgttggattttttatatttgcttgtagaattgtgaagatatttggttactttatttcatagaagcacacatatttgtaactagcatccctttgtttatttaaagtacttaaatttcatgttttcaatgtttactgaagatgttccaattatgtcttgcatgatattattgacaacaacaataaatttatatttgacaggggaaaccaggtttcattaccatgtacgccatcacatgctgcaaatgcgagaaatggcgtacgattccaacaaaagaagagttcgaggtaatccgtgagaactaccccgcgaagccatggttctgcagcaaaaagcgcgactgctcatgtgagcaccctgaagatatccagtatgacaccagccgtatttgggccattgataggcccaacatccctaagcctccgccgaagacagagaggctactgatcatgaggaatgatctatctaaaatggatgcctattatgtcttgccaaatgggaagcgtgcaaagggcaaacctgatatagataggtttctgaaggaaaacccagagtatgctgctactttaccactttcgagcttcaacttctcaacacctaagatagttaaggagactgtttccgatagtgcaaagtgggtgatggcgaagtctgagagggaagagcagtgtatgcaactagacgcaaaagaagttccaagttccagcagcaagtagttaccattgtgacctctgaatctacatacgcgttactttaggtgatgccaaaaacttaagacaatatggagcagccaccttaaaaacctatacttctccttccttgtttacctccagaagttatgttatgttttgcactacatgtgcttttgtgtgttgaaccttttcattctacctcatgtcgaatcctgcaaagttctggagctattttcatgtggtgattttggatattttctacatatgctttgtttcgcatgtatccggaacttctcgttgtaggtccctattttaataactatacatattaacgataattaattaaatattagcttaaaaaaatttaaaagtgaattaatataacttttaaagtaacttttgtattttttttttgaaaaaacatatttttcacagtttaggaagcgtgtgtgtaaaatgagagtaaagttgggaaagtgtcccgaacacaacctccaaggtaggtgcacactgcacatcaccgtatgtgtgccggtgatatgattgccgtgtgatgccgtttggatggctgggcaaggcccgcatcccgcaagggtcaaaaccctgtcggtctatccccgtgaaaaggcccgctttgccgtgccgtccctctactctcgggattcactcccgctgtccgtcctcgtttccgccccccacacaccggcccagcaacgcggcccgaggcttcctcttctcgcctcgcgaccgctccgcccaacctccgccgccgccgacgacgacgggcggccaaccgccccaccgtcgagtatggcctcatccccgtcaccggtctcgcccccctcggcgccctccacacaggtccgcctctcgccctttcgcctcctcgatcgtacgtcgccatctacgtttcctcgtactggtatttccccccgcagcttctttggtctgttcctccgaatccccgatccggtttggtgtatctggtggtggccatagcatgctcggttgttggtttcatctggttgtttggcttgagaaattgtgccaaatggtggcgcctgcatgttgcgactatatgcgtggatgcggtttcagagttcagaataggggtttggttattccactaggttattccgtaggatgaaatctttaatcaaatagtatcgtcaatgccaagaacaggtgagggaaggatcgatttagagccttaacttaatctgatgagctgaaattgtgccattttggatagaaattgtaggcgtgttgctttgtactgctgtgaatacatgaagcctgaagtttgtttgtcagcaacgggagtttatgggctgtaaagaaataaaaaagatcagcttgcattggtttctcaaaattttgtttgagatccaagaggaatttagaagcatgaaggataatggaatccgtccaataacaaaaaatgcatatactttagattgagaacataagagttaatgtattacactatttaatacttttgcagttcttaagttctgatgacattttatacattagcgaaggggggctgcagggaatggagactgtagagggttataagagaaagaggaaaatgaggacttttctacttagagctgtctgaaccatttcttcacatcactgggtctatgaaacaattttagatttcttcacaaaatgctgcgcgatttttttaaatttctgccccttctaaaaactgaatgcagaatctttttctatggttgcttttgtgcagccaaacataagtgtgccttatactacatggcatctgcattataccaaaagtggccttaccatatggactctatgcaaaatataacttccaacttctaagaagcagcttttatggactgtaaagaaaaaaacaatgtagcggtctttattatttctatttgtgcgttgggaagttgttctgttatcctatccactagaagtatacatcatgtcattaacatccattttccattagtttgtgcctgatagaattaaaatttacattccaaatgcatattttaggatcagaaaaattattttgcttgatatacaatagtaatgaatggtaacgttcttatttcaatagagaaaacgaggctcctccacagactccattggcatgtatgcagttcaatgttgtgagtgtcacaaatggcgcaaggttccgacgaaggatgaatttgagacaattcgtgagaatttcactgaggagccatggcactgcagtagaagacctgactgctcgtgtgaagaccctgctgacatcgaatatgatagcagccgtatatgggtccttgacaagcctaacataccaaagcctccagcaggaactgagagactagtgattatgagaggtgatttgtctaaaatggatacctactatgtcatgccaaatgggaagcgtgtaagatgcactgcagaggtggataagttccttgaggccaacccgcagtacaaagatcgcttttcagttgaaagcttcagctttacaacaccaaagattgtcgaggaaactgtttctcacaactccgtgtggaagtctggaaaggctaagaagcaggacaagataaatgctttgagcaataacaattaatttctttcaaaagactttatattatgcttaggtgatgctcatctcaggttgtggtgctaccctcatctactttgtgggctggtcaaatctgtttatatttgcacttagtctgttcggtctctgtgatctgtgtgttatgatgcgctgaaccttttctttcttcttcattatgtattaactcttggcaaactttgagatggttgagaagggttgtgggtatgttggccataactaaccttagttataggcatgctcttttgttacatctcacatgtttacttttcatacttctacgttgtgaaatttgatcatataacctccctttagattgaaactaggatttacccacctgacccacacatgtcagtggcacaaaatggtaattccttgatcctcattttccagataggaaaattcaacaacaaagtactaatacaagttgggtcagctgctatcatgtgagagctgtttctatttgagatttctatacatgggtattgctaccagaataatcatttgagatttgatttgatgtaatatgttaggtttccatttaagattagaaaccaagcattagcataaactaattccagatcaggaatgttcagtaacaacatataaaggatagcaggtgtgctgacatacctgtgaccaaaatcgccttcttccatgttgtgaaatggctcttcgtttttagtgtgattgtgcagcttgtgggaagcccgtggaagcgcatgcatcaagtcctggtttgcattgtgagatggtattgcatgaggctttagcagcaaatcaaaaaatacaatgtgtaagaagcagtggaatcagatagtgctgtcttacatgaaacggagtgctcaaatctgtggctaagcccataagcacttcactcatcgtgatcagactttgaatgtggctttttttggattcttgtctcctgcatgacttgcagttccgttctcgcaattcccattttgactgatccacaaaacttcaaagccgcttcttcatctctgcacaatcaaacataatcatatgcacggttccaaaagttagcagaaatcattccaggtcaatcgattcaaaaccatcaggtattcaggtcagatgaacatcatacttttcagtggcctgtctcttgggtcattctcatctcaaagacttgcagtgcaatctgcactgttcctccgacttatcctacttcccaacttttttctctgtcataaaacgcacaatcctgtcaatgatcaagaccaattttcacggacaatgactcaaataccaggtctctgaaaactgcttaccttccatagcctgtcattcaggccctttccatcctttttctcgccgggctaaagaaggaaggcggccaaattttattcagagttgaggtagttcgtcatctgaattatcttctgtttttggtcgagcatttgacgatatcttcgtatctgaacagcagcagaagtttgccctcagaaaaatcacgagccctcacaaaccctgttctgccactccctaaagtagatctcaatagctcttaaaaagaagagtagatctcaaatcctcaatacagcttaacgtgccaaaaattgccaacgaggctgaaaaccatggccaatttgaccggcactgtccttgcaaacttgttaagaattcgctacgaaattcagaacggcagaacatgtagtagtatacaagcatctgtggaccatctttgcgaaggatccagggagcagaactctgatgaaccgtggccttctaacagctgcatttgtcttgttattaatcaaatctgccgaagtgtcaacttcacaaaacttcaaaaagcaaaagttatcagtgagtcgtagtcgtagaaacatcgacaatgcaaatctaagtagtagacaggttggtctccagaagaatttatgcgatcttctgtaaaaaaaaaaaaccagttgtttgttgcgacagttgaattgataagttgccagagtagccaccttcgccctgagaggggcatctgatcgaacaccttcacggcgagttacgcggcgcccccttcgtgcctgaacctgaacacgagaaaaccacccccatgacaacgccatgagcgcgcgcgagctccgccaaacacggccgcgtgtgccaggaacgcccggtctcccgctgaacctccatgcgccacaccggcacactttcgccgagcgcgcccaacacaaggagcaccccgcgctgccgtcgccggcgagcgtgcgcgcgccgcgcgcgagtggtggataccttggcgtaggagtgggtttcgtggcgtatacctgagctagcagtgccggattagtaatgggcaatgggcgtggagaacctagggcaccgacgatgaagaggcacggcggtcggagtcctccagaagttgaaatgttgaattctttcctgggaaaataaaccggcggataaaatcgtgccacacgcgtcaggaaggaaagctttcaatcgtttcatttccttttgagaaaaattgcttcgcaccaaccatcggggaaaaaaatcactgcacagtataaaacagagatgttctcaaattagtatcatgtaaatgttcatgtttgtttcatatcgtgtccaaatatttggatgaatatatatgtttctgtcttttgtgttcggtttattttaagaactgctaatgtaaggcatatcaattttgggatggtataaattataggagatcgatccgtattcgcggcttccttgagacacctttactttgcctcatctgccacgagcatgcataccagatcctcgtgtcttcgtcccaatcaagtatccatggttcaagtatgtgataccttgtcgacgttgttgccctctcaattcatccttggtatcttgttggcatagcctcatccacgatgttacctcgatactttatcagctcaggccttgttaggtcccactccaaaaattttcaccatatcacatcgaacatttgaacacctgcatgaaatattaaatataggctaaaaaataactaattgcacatattgcgattaatttgcgagacaaatcttttaagcctaattgctccatgatttgacaatgtagtgctacagtaaatatttactaatgacggattaattagacttaataaattcgtctcatagtttacagacggattctgtaatttgttttgttattagactatgtttaatacttcaaatgtgtgtccgtatatccgatgtgacacgacaaaaacttttacccctagatctaaacacagcctcagtcgttttgggagtttgggtaggtggtaccttgtcggcgccatcatttccaaaattccacctttgtaccttattggagtcttcaccatggttcatcaatccctagtactcacgtattattgctagcccctttaggcccttcccagtgcgtgtacatggcatgttaccttcacctgccatattggactcgcttacgtgtcgacgaggctcgcgcctctgcttagccgctcgccccttatctgggagacgagtttcttcgttgcaacgagggcgcgcagcgcaagaaaccccctccgcccctgcaacgtggaggtcgtcgctccgattcgtcgcttcctcgcgccgccccgaaaagtgaatccccaaaatcaccctcccaccccaccgattcttgcctcccgcgcttggatttgggggagaagcggtgcagtggatgggcgaggagaagtggcgcagattgggagaaacggtgcggtggatttgggaggagaagtgtcaaatttggggagagaagcggcagatctgggaggagaagcgcgtggtgtggtgaataagaagaagaagctcggtatttttttaaccgaaggggggtgggtgggacggggaaccggcccgcagatgggaagaagtgacgggatttttttctgtgtagaggataagcatgaaggggcaggtggggaaaattaactctgttttcgttcgactgggagttccgacttgatagcgtattgtgggtcacgagcactgtggggtgtgtggcctactggccttcgggccaattttatcgcacaaatgggctagaagcgcgctatgcgtgccttgcactgttactgcccttacaagtataatgtgtggtactattagagtattgttccataagtatcggagttgatacccacatatatcattgctggtacatatatggttagttttgttgatctaatcaccacgatacaacatatcatggaagaacgtagggagagagagagaaagagaaaagggaattgggtcgttgcgctatcaacatggagaacaacggatgggttattaaggaagggatgaagggaatgtgtaacgccccgattttcgttcgggattaaaaatcattaaataatgcattttctagaaattaaataaaagttaagtcaattcaatcaagtgaaataatgggagaatttgaaattttcctttaaaaatcattggccgagaatattttgtaatattctttgtgccctaaaatactctccggatttttccgcgaattttcggagctcaagaaataattataataatacaaagttcatttaatcaatttaaataaaaagaaaagaaaataatcttccccttcctccctttcgggctcggcccaaattccatcccccttcccctccggcccgcctccctcccctctcctctttgggccgctcggcccagctcggctcctctccccccccaaagtccagaaaacccccacccggcttcccttctctcttccattagctgacaggtgggacccgcgaccccacctgtcatccccttcccctacctccagccaccccatcgccatggaccggcaactgccgccattgccaccccaccccgccgctaaaaccgccggctctcgccttccgcgcgcacgtccaaccgtgcggacatggtcgccacccattcctcctcattttcctccacttttccccaaaaatcacgccagtttgacctccctcgagctccacgtcgccaccccacgtcgctggccggttgcctcctgattccggccctctcggccacgatttccctctcctgagcctatataaacaccccatgcgaccctcgtccatttccccaattttttcgtactccccggactctcccccgctctccccacgcaaaaccgagccgtcgccactctccggcgagctccggccttctctagccggcgctctcgccatcgccggactgcgccgtcaccacca

SEQ ID NO: 22556 - DNA, 18975 bp, Oryza sativa
gtgagctcctctactcacggtcggcctttggccactgttgccttcgccaagcccgtcctctcccttttctaatctccccttcgtcctcctcaggctcttccggtcgtcatccgccactcctcgctcgcggactgccattgaaccgccgtagccgtgcctccccgaggaagcgtcgtcgcctctcctcgtcgtcggtcgctctccggcgccgcctccgtgccttgtgcgctcggtgagctccccatctccttcctctgcctccctccgctgcctcccgcgcgtgccgtcgcgccggtggtcgtcgccggcgacctttgggctgctcgccgtcgctccccggccggtcggccggcgagttttgccgctcccgctagctgtggccgcccgatcccctttggggtgatccgggccgtctacgtggctctggcgccgccccgcgccggtgtcccatgtggcgccacctcggcgccatgcctttgccacctcgccccgccgtgccgtcgtggccgccacgtggtcttccacgtggtgtgcccgcgcgcctgtgctgcggtggaccgagtccaccatgagccaccccctttgacccgctgacgtgtggggcccacctgtcggcgcccttcctcttgctgacgttagcgcttatcatttcctttggaaaaatatttaataattgtgcaataaattggtattaattatagaaattcatttaaatggctcaaaacttctaaaattcatatctaattcattcgaactccaaattgggccattcaacttacaaaattcatctaaaattgagatctacatgtttgtttactttttatgtactgtttccttggtttttattagattttttcctcgttttgtgtgccagcgtgtagaatccgtcgtttcggaagatcgcggtcacgaggaaaagagttcagaagatccaagtgaagaagcaaggcaagtcacacattccccttgaacattttgatcctaatttacaaatgttttattgtttgcaaataaaattgcatgtcttgctaattacatgggatccgggtattacctatctgtttgcttgtgccatatttacttgatatctgtcatttgtcaaccttgggtaataaatagactagctcatgttacttatgtgacctagctagaactatatacttagtcatgcttaattaccactagctcagttgatgggataattacagtattagatctttttagtatcagaatgagctgcgtgctcaagacatctagccatacttcatggtcgtaattatccaactaaaatgcgactacatggtgggctgtgggtgcatggttttgctagtcgtgcccatggcgattaaggaccggttcgcgggaaaccctggaagaatttatcatgcttaccataagccagcgtgggcaacggctgggcttgtagtgtagctttcctctagctgacgcatccaggcaagggtgggcgtgatggagtttggatgggtcctgcgacggcctatgcggcttccggattcacctaggcacgagaggggactgcccgctatcttgcgaggagtgggggtgaaacctgaggtgtggtgtgcttggttagagggggttatgtgaagggtcctgtcacgacctctttccggtatgtcgtggtggcatgtcggcgcacggaaacgtgtcgtggggctgtatcttgtaggtacagttgtacacctctgatcagagtaaaactattcgagtagccgtgcctgcggttatgggcagtcgaccagattcaccgtgattagtcccaccttaataaatcgactcaatgcactgtagttcagatgggttggttgggcctgttcaacgtggtgtagtgttgatcagtgaagatttaatgttactttaattactcaatagttttacggttttgctcaataaaatgttttacaaccgcctttatgcaaatagccacaaaccgtccttgtgttccccttgcacgtttgcatcattggtgtggcttgctgagtacggtggttgtactcagcctttgctattattcccccttttcagaagtgtagtgcttctgagctgaagacgaagttagaggaccaagactcagaccccagttgagttttgcctgtggagtggagctgaagccccgctaggatcgtcttttctgctgccgttgcttttgtttcggtgtgaggactaagtgcctctcctgtaagtattttacgctttatttacgtttggaactgtttattacttgtcgttttgtgtaccctggctggtcctggatagggatttaatacacaaaatagtctagaaatttgggctaaatttctgggtgtgatagaatgggattaatccgaagcgccgccaatgtagaggcggtcgatagggacaatatatatagatggagcgttgccttgtccagaatagggaaggagaggcgcgggggaagagagaataagcggaaattgaaccagagtgtggtccttgtggaacaagcttacaagggtgacaacttgaatgagagtgttctcatgtatgacaatatgagagaggcggacataagagaggatatattttcacatgttattttctcattaagattcatattttatctcgatttcgatagcatgtttttcaaactactagatggtgtgtttcatacgaaaattttctatgtaagttgatttaaactatcaaatttatccatttgttaatgttgtaataattaaaacttaaataatcatgtgctaatagctaaattaatttgtacaaaaactttctcattacatgcacatgattaattaagttttaattattataaacttaacaaatatatatatttgatattttaaagtaacttttatatagaattttttcacacaaaacaaaacatatagcttaatagttcgtaaaatgtgctaacggtaatgagacaagaagggagccgctaaataaattggacggctgagatactatctgctataggaagcgaccaaccaacgtccacgcttctctgcgaaacacggaagctgcagccgcggccacgtcggcacaaaccgaaggcgggaggacggacgacgaccctccattccccatctcttccaccatctctcctctccctccccacaagaaaaacctcgcgcgaacaatgtacagccctctcggcagcggctgcgcgttcgcggccgcggccagctccgcgttcccgccggccaccgtccccggcgggatattcgcggggaggaggaggaggaggccggcgaggctggttcttgcgtgggcgagctcggatggctcggacggtggtggtgccgccgctggtgcagtggcggccgaggcttccgctgtgggagagagcaaagaaggggaggtggccagtggcggaggttcttccgctgagtcgtcggcggagaagaagccggctcctgttgatcccaagattgagaaggagctcaagaaggtcggctcttttctttgtcccttggtctaagaactaagcattcagctcaggagatggtatctaatctctcgggtggacgtccacccgtttcttgcataccacctaaatgattatgaaaaaattccaaaaaaaattataagataggttaatatgtaatatatcatctcacaaacatgcaagtccaaattcgacttctacaagttgtaacaaaaataacaaattaaactctaactagtatacatatattcacaatcaaatttgttatttttattacaacttatagaagttgaacttgaacttgcatgtttgtgagatgatatattacatattaacctatcatgtcaatttttttgaaaatttttcataaccatttagatgacatgcaagaaacgggtggacgtccacccgagtgtttaaaacagtttcccattcagcttgttcgatataattcataagttgttgcaaataatactaggcaactgtaagaattcgaaacacttgaaaacttcacaattcgatagaaacctagtacaatgaattgcaggaagaaactaatttgagccatcagaaatgttgtagtcttctaataggtgatttaactttagagcaagtttaatagtatagccaactatcggctccaaattatatatagtcaatttaatagccaattcatacaatagttacctatatgtactacatcattaatgtttagtcccacctgtcatatacatatgtatcttggagtccgtattgtaactggctacaaatctgtagcctgctactcttatctctcctcttttatctctttaaaatatgtgtatagctggcttatagcctggtattgtacctgctcttagcatacatctagtttttggtcgtaggcccatatgcacaaagaaactcaaaatgttattttaaagggtagaaatgctaaagatttttgctgatacagcaaacaacatgacttcatgaggtcaccaccaaataactatgctgtgttcttgagcaggcagttcagaagaccgcagcaacgtttgcaccaagggcgtccactgccacaaagaaccctgcagtgcctggaacagctctgtacactatctttgaggtccagggatatgcctccatgctgttgggtggagccctttccttcaatctcgtgttcccgtcgaatgagccggacatttggaggctgatgggaatgtggtccatctggatgttcagtaagtaagaatttgatttgtggtacttgtcgttgtgcagtaagtttatacgtttgtaaattgttcccatcagcagcaaggattatgatctatccatgcatcaaccaagcccttgctcttttttcgtaagcagcaatggctaaaaatgtattgaaagtgctcttgtgctacaacattttgaatcaactggcacaaggggttaattcgtgcttcactagccataaactttatagtgcagttcatccagttctagataaagaatagttctaagagcaactgagaatttattttctttctagcacggtgtctgtttagctgttctatatatgcatatatgctgactggaaaaacatgatgaaatatccttctctttgccaacctttaacaaaaatccttgaggttgtcatatcaagtagtaattaacagtgaatctgtctctcaatattaattattaatctgaggctgtcgataaaatgaacataatttgatctctagatgctgtgtcgctgttgaggttaataagattcaatggatgcaatgaattagatacattttctgtgatgctgtaactgatcaactacctacttctgcagctataccttctcttcgggcccgtgactgctcaagtaaggagaaagaggctctcaactacttgtttctactggtccctctaatcaacgtcattatcccgttcttcgtgaaatccttcgctgttgtctggtcagcagatacggttgcattctttgtgatgtatgcttggaaggtatttcctcatgtcaaatgttgtctgctccttcaatattcagccagttttgttgtcaaatgtttaacaagattcatttctacacagcttggatggctgcaacggtcagagtgaacaatttcctgaacgaaggagcatttgaactgcaaattttgcctaagtgaattttggagggcacgctacatgcgatgaatttttcctagatttagtttcgtgtacatccatggagtgtaaagaagcttgctatgtagatgtaccttaaattgtcaacattagtgttgactaggaactgggcatctctcaacctgttatggtttcccagtagatcatatatgtctgcgcgctggcatgaaacggttgccaattgcatctgcttcgttcttggggctacaattcgcaactgaatttgctatatatttgtcgacaaattttccaccaaaaatttaacagatgtaattatagtacaatcgtagtgtaattacactgtaacttgcatgtaattacactgtaattataatgtaacatgtatgtaacttttaaaaatctctccataacatttatttcggtaaaatggaggttgtgagaacaaattctttcacatatgtgtatgatgtgattttttttcttcctcaccagaacaaatcttataatagatctaacgattcaaaattacgtgaaacttacatataagttacactgtagttacatgcaagttacagtgtaattacatatgagttacagtataactacactacggttgtattataattacatctgtcaaaaagaaaatttgtcaaaaagaaaatttgtcgacaaatgtatagggagtattcctttcttaaactatgaatttactcttttggaaaaaataagtctctttgtttgaattttagaactttgaattttttaccctgaaaaaaaaaagaaaaacctaaccatttaaatctttggtatccttcaaatcttcggtatccttcgagtcttcggtacgcttcgaatccttatggggaagtctataaattatacgccccttgcttgaatcataacgacttacttcaattttgactctatcccccatcagtattcgcatagaactagaccggatctttcctgaaatatagcccaggatgatggtgtcattctctaggcgaacgcggaacattccgttgggtagggcttccataactaaaccctcgaaagtaatttttgcttctctcggggtttttttttctctcctatttttcttttctgtcatatttttttctcctatttttctttttttattttcaaataaaaaaatgttgtatttttgtttgaaaaataggaagttcaagatagaatttgggtactataactataggtggggcgattaccatatataacataagacttctcctccaattttgtttagtcgagcttctcgatctgtcattatacctcgagaagtagaaagaatagcaattcccattccagccaaaaccttaggaattccttgatagttggcataaattcataagccaggtcggctgatacgctttaaaaaggttctagttctatatattccctttctagtctttctcttttgatgtcgcaaagttgaaaccaagaaatatctattactttcctgatgtttccgaacactttcaataaaaccctctcgtagaagtattttaacaatgttttcggtaatatttgtagatactacccgaatagttccttttttattcatgtctgtgtttcttatagaggttagtaaatcaacaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactagtttagtaaaattcaattctctcaattcctcgacgatcgtgccaaaaacgcgagttccttttggatttcctttttgatcaatgataaccgctgcattgtcgtcatagcgtattattataccgtcttcgcatttgaactctttacatgtacgtacaattacagctcgaattacttgagatctttctagaggcatttggggcactgcgtctttgattacagcaacaataacatcaccaatacgagcatattgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggtttttttattttcaatactactttttttggggggttatatttctaaccgaagaaattgacttcgtatgggcattttgctggcagctatggaaatagctgctctagctatagtttcggatactctgcccatttcataaagtattcgacttggtttaacaacggctacccaatattcgggggatccctttcccgaacccatacgtgtttccgtcggtcttattgtaaccggtttgtcgggaaatatacgtaccagatttttccaacacgacgtgcatatcgtgtcattgctcttcgtcctgcttctatctgcctcgccgtaatccaagtaggttcaagtgcttgaagagcatatctaccaaaacaaatacaattgcctcggtaggattttccctttattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattaaatttattaaaatactaaaatatatagtcaagaaaagaggatctagaatatatctagatgtgtatgtttatttatctatattctatatttaatgtaattcttttttttaatctcctttttttattttactcttattgaatcgcggtaaagtattctaattcaataaaaatttcgcgggcgaatatttactctttcatgtcttatttgttaattcataaccttatcaaataagacaattttttttggtttgttccgccatcccacccaatgaagtattgggatttttttcaagaaaatcctatccagtcataggttctgtcattcccactgcttctcctttaatggttaggtttgaatctcgcaatggagcttccaaaaaatttctttccgagtcaatttctcagtttattaactcaggacgctctttgttattccttgaaatttgtatttcttgtttcaatcaaattacgatttcgaattctttgttatttttattatattgatgctttatcacattgctttttatgatgtaattcatagaccatacatattggaatcctatatctttcttttttctcttccttctttctatcatccttccttttatctacatcccctttagttttgcttcacaacttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttccatgcccgtatctccaaaacgtatttctgatttacgctttcaaggtgtgcagcgacatcaaaatatgtatatggttcagtgccttatttgaggcaaatatttttcatggaagaaagatcaaactgcaccacatctcattcacatgatcaaattaaccatgtctgaaaacacgcttgtgctttgatacttccccgctttgacagctggaaagcgtgtttctccatgaccgaaagggtccaatgtccgtatctcggaaacgtactttcgatttacgctttcaagaaatggaccaaataggagtccgggctcgagccactcgactcgaccgattcgacaccgacgaaagagggcgaaaaccatgggctcctcctcgagcaacggccggaccgcgcccgcgccgccgcctccggctgcgcctgcgccgccgcacccactccacgtgatggacgccgacgaggaggacgagaacgtgaagcagctcagcgagtgcgccgccctctacctctccctccaggcaccgattctctcccgctccctttcccctctccctcccctgcgtgttctcttccccgcctcgttcttagtagttgaggacttgaggaggcgaaggcgattcctgtcctgctgccgcgcgcaaatctcttcctgacttaacagtctctgatcttgctgttcgcttggatcctttgcaggattgcctcgtggagtccaaccgcagctggaaggcctgccaagcacgtaagcatcgcgacaaattcgtcattcctttctctctctctatagtaggccttggcgttcatattggtgaactgaatgagttgctgaaagttgctgattgcttgctcagattggaactgatcaactgaatttgttgtcaaatggtttggaattaggcaaaaccttggatttgtagtgttgtgttgaatacccaggataactgcctcatgttacatgtgaatggtttctggtttatcaagtgttaatgtaaactcaggaatgctacgaaattttcttcttcaaaagagagtgcttatggtatagctgaagtgaggctcacttgcttatcacattacactctcagagagaaaaggaaatgtggggaatttttcttgcttctttgggaattgaattgttttgtatgaaattcttgcatatagataggttcttaatggcatgatatggccttcaatagcttaaaacgtgctagaatgggagttagaatcatccaagataaatctacatgtgaatgtggtttagcttcatgtctttcctgaaactattctaaggcttcgtgaagttatgtctttcggcgcttctttacaaccatgcgcacttgtgcgatattactgggtaattttctagtaaaagaagttgctgatccatgaggcaatttgtacacatttggcttacctaacagctcgcaggcccttaacaagtaacaacagcaggcatgcagatccaactttgccatatagcactaatgtcctaggctcctagcactgcacaaagtttggtcacacatttgcatcctagttgctttccaaaatcgaataacttacagccacattttattttgtcttttggctgtacaattgctgtgatgaggttaatgtttgctcaagtcaaggggctagacctgagttgagatgttgcaattttaagatgccttgcattgtgatccgagctaaatgtagcatttctttgaggataaaagtatggtagctatgatagttacatccatatttgtttaaagttagtgctgtcttagttttccacaagctggattctggttttattatcgtaacattatctcactttgttctaacaatatctgtgttgcttcctttttatggcagatgttcaagccttgaaagcatgtgaggcaaagagaaacaaaagtgaaacaagataaaattattttgcaatatttggcactaataccaggcaagtagaaagttaatatggtttgaagagttttgaaatcaactgacttgtttcttcaaatattgcgttatggctgttgccatcagcatcgaactgaacactatgttttttcaccagtctgcttttggaaggtttatcatattcttcattgaggatggcgacaccataggcagcgtgtttagagctgttagctgatgatggagaaggtctacagcatcataacctggagttaacttgttaaaagaacctgtagttagatttcgaccgaaaggacacaggatgagctcgccacgttaactgaacttgcttgattgtttctggtggcagtcgctgtttcttcacattttcatgaaatgagacaatatcagcattacatgcgcctttggataactgctgatatgagttcatagcttaagattatcattgttgctgagatgcctttaggctttttcaatacctgttttggctttgttttggggcgcacatggttcgccacatcgtctatacaagtgacatcgtagcgacagaatcagcgtcttcagtgacgcaactgccattgcagaccgagaacaccaactcctgccattctcccggtggctttctccatcggatagtttcttccgtgttcaattatgtacggatatgaacttctctggttatcagaaaaaagtagaactggaagtgtaaataggttacagccaaaagttttcgacaatcatcagacttggtatttcgcattattgacaaaccgcagagtataaattgctttctgaaaaatccgatacttttttaataatcacaggtttactatgactgcgcagactgttctattgcgggcttatacttccatgctcaaagcttactatcttctgaggctggaatgaacttgagtgagatactgttaacacaatgccgctcatctgtaggcgtgttgaacccctcccctttgaagacatgtcctaaatgtcctccgcaagccgcacaggtgatctctattcgcctgccatcaggatcaggctgaagttgcaaaatagtgccagcatcagtaggagagtatggaacgaccgaaagaggaaaacaaaacaccatatatattcatcgccattcgatgtagaagacaaaaccataccgttcgtgcgatggctccgggaaatccttcatagaatgctggccaaccacaacctgagttgaatttagtagatgacttgtacaatggagtcccgcatccagcacattcataaacaccctcagcgaagagcttgtcatattcacctgttccaggatacctggaaaaaaaaaaagatcaaatcaaaaaattagttcaagactaccagattaaccatgtcatacaccagtaattcgttaactgtacgacaacacaaatgttgataatgagaataggatcagcactgcaacttcgtacagaattatctttttgcagttttgttacattactcaactgtcaggactcaggactacagttgcagatcaggaacaaaacaagcctcaaaggatggtaagttggttacaaccaacaagcatttgtagtgacttcgctttagtaactttggctgagctatttttcgcttacattctgcacttcatgatatgcagctgtgtccaatgagacaataacatattggtcgaatagtagacaaaagaaatattaccgagaaaagggttcatgcactagtactatgtctgtatagcaagatacaatcctggtcaagactcaagacaaagaggatatgtctagagacaaacctaaaattaacatttcatacaggatcatagtaacaagctgatttttttagacaatcatatgtatatacacagccagtagtaacgggctggtaaactgataaattttgtcttcagagtaaaatatcagatactgttacacatgaaattccacatgtaattctaccatttgatatccaaagtacagctggtacttaatttatgaacaattgtgtgcacaaaaaatcattatgtcatcaaaatgcaaaaaataggaaggcatccattccaagaacgtacattcagtcattcagatgagagttatgttttttcacaaactggcaaaaggattgcacgtcattgtattagaagaagcaattgtagtttacacgacatgatgactgggagccatcgtgagtttacatatcagtttccactttcctactaaatctgtagccataggtgcgtgtttttcttgtgcttgagccgatgattaggaaactaactatatctattgtcacatcattttaattttaaacctctggaatattagtccttcaatttgttgctaattttgccaagttttttttttctaattactgtcaatttatatagacttttagctctgatgttttttttatcatctataaaaaatctttgaatttatgtaatactttttatacaattttttttatcacaatcatttgttaagctgcccccctcatagttaaagcctagcttcgcaactgatcacaagcattttagtttgttttttcttcttttgcttggtaaaatcaattggcctggtcggctattatttttgaggctgctcccactgcgaatagctttggctgtgcagctgtacacttcacagctgagcagggccaaatcataaccactttaaattgcattagcagatctagaaacgtttgcagcatgcaaaaatgtcccagaaatgcaactagataacattacagctgttgacccatggcaaaaaaaaaaaaagatggaaactcgggagcagattaataaagagacaggatggttggctgtccagagccagtaaccatgcataggcaagtcatttctgaaagagctcttgcaaagtagcaaggaaatgcacccttccacacatgctcatacatgatccgagtatatactgattcaaagttttaagaaattggcattatcagaaacggaaacagaaacagatagcaaattagcaatgactttacgctagtattttttattctaaggggaaaagaaggataaacagtgggaagaaacacgtcttactccgtgcccttgaggcggaggatgcggaactgctccggcgagaggatggcctcccactcctcctccgacttctgcacggatcccggaggcggcggcggcgccgacgaggacatcgccacgacgacctgcagccgccgccggcccgccgtcccgcggcaccggctggcggcccactggttgtggttgcagtgcggccgcgagcacgagagggtgacgtgccgaggaggaggcgcggcggcggtggaggagggccgggcgaggaagaagaaggcgagcgcggagagcgggcgcgcggcgagcggcgcgccggggtgcgggtgcgggtggggcgacgccatcctcagcttgagcagatgctggacgcccatttttttttcttccttggcgtgtttcgtctggcagtccgtagtacacgtgtccttttcgttttctggtggcgctgatagctgataaggttcttgtgcaagtgtagtgactggataacttcataaggccatgtacaaatgtacaatatggtgcctcgtaactcactgaaggtttgaagtgatctcgcaggggggcagatgaaacagtggttgaactgtggttctaggagagagagaacgatttgtgtgatccagaaagttacagaggagaaaaggggaactagaggccattgacgagttgacgggctggaggtcatcgccgccagcccatgcctcgttgtggcccgtgccgccagggagggaggagagggagcccaacggcggctccgaacaaatcgacgccacctccgggaagacgctgacaacggcggtggctcggccagatccggcgagcatgacgccagatctgtggatctctctggttctcgagctcggccagatccagcgagcatgatgccagatccccgctggaaagctcaagctcgagcgccaccgatcctgtcgccctttgccacacgaagctcgacgtcaaagatctcatcaccaccatgagctgggcgggccacgcctcgtcgacaaggcacagagaaggagaagaggagcaccgacagcaaaggagaaggggagcgcctccgtcggagaaggagaagagggaaaggcgagaatagcgacagtggtggtaagggggtgggggtggaaaatgaatgtgagaggctaactgtgggaccgttaggaggttagagtatatatatatatatgtgttcttttttgttgttataaggtctaaaatataaaagtattatcgatgtgataataaaaaagttaataaggactgaaatgaaaaaacatttagcacttagcagtagtctccattaaagaattgtgtgtatattagtggccttagcctatgtagtaacttgagaccactaatagtagtagcctccattgtacatgtcctcttggaatacaaccatttatgaagaaaatgcagatctcggataagtcagcctcatccttttttttatacttatacctatcagtcaaaatttaaattttaaacctaaaatttagagttaattttagggcctttcatcatattatatcttttagcttttgcttgtagatgtataaaaaagttttattcacaaattatttttcatttgcaaatatgccgtttcactttttcctccaatatgccaaaccatggtgctgatacctgctgcgttccaattgaaaggcagccactttgttcttgtgacaacttctaaaactaaaacctgtagatatctctgcctttttctcttactgagcatctgaaatacccttttccagaaatgcagaaaatgctgcaacttcgttgctctccttaaagacaggattttagtcttagcacctgcaagttatggatttagctcatctattggcaatctatatcagttttgagtgtatggcacttgctggtgacgaaatctcttttccagcttgtaggcataagccgtataatcctctcaaagaaaatcataaacgaatggtacgtttcatgaaaaataacaagagatggaaaaaaaaagtatgcaaggccaacaaatgttctatgcagcacaactgtccaaattctgaagaaaatgtgagcccctaatgcactggccagaaccaggttaaaatgaagtttcgtattcaggaaatatgaactgtccacacgaggtattttttctcaaaaatatgtttctaaatggaaatgccaacttgtcagtaacaaatatgagcaatacagcactacacagatcaaggatatctgaatgcattggacctctaagctacaattttatatatccagcatttgttgatcaagccaatccttcaaaaacaaccacctagtgaccgcatgactgcatcatatcatgtacaacagagcatcaagctgaagacctacatgcaagttcgtcagcaaacagttgatacttgaagcatgttactcaataaactcatcatcggtgctgtcataatcactatcctcatccagatcttcatcttccacctcatcctctactcgctccgacaaagtgttcgtgtcaaaagagttatcaacttccatttcctcgatgccaatcgtatcatatttcatgcgctcatcgaatttggcatcagaacagtttagaagccatgcaagagagcatgtgaatcccttcttcgccaccatctcatgccgtggccttacagtcgactcaaggccatatgtaaagaatgcagggaattcaaccagctcctccaaatccctctccatctcattctggaagtactcaaagctcatcttcattatatccatgttcaatgcgagcagctgtgggcatgctacgaccatcttgctgacctgagagagcaagaagccacaagatgtaaggaaattaacatgctttagaactgcagttcggccaaggctaatggcttgtggcatcctctctatcactctaccaaaatcttcactgctgaccaaaatgctagactcaaacaagctctgttgtgtagcaagcttgtctctcagctcaattccaagaatgtctgggtattgtgccacaatgaatgctaatgcctccttcctcaccccaaattccagaagcgcctcaatattaggcttcaccttgtcctccaacccaaaaccaagaacatatggcttcttctcgatgattcttgcaatagctagcctctgcaacccaatgccctcaaggtgttcgacgaaaggcttaatgatcttacccacccgcatgcccagcacctctgggaaacgggtgatgacgctgccaacctgccgccttgccacgccaatgccgacgaggtaggcgatagaggtgctcatggttccctcgagcttgaagccgaggagctcggggtagcgctcgagcacccgcggcacgtcgtgcggcctgacgtccatgccctggaggtacttgacaacgggggcgaggtcgacgacgacgctggcgtggagcacctgcgggtagcggcggagcaggtccgggagcgcgtcctggcggacgccgagcttgccgaggtagtcgaggacggggaccatgttcttgcggacgctgcagcccagcgcgagcgggtacgcggcgaggtcctcgttggagaggtcgagggagtgcaggaactcgacgcgctcgcgcatgacgtcgacggtggcggggagctcgaggccgccgagctcgcccgggtcgactccgagcgaggcgaggaacgcgtcgacgtcggcgcggcggccggcgcggccgcgctccatgtcaaggaggctggggcgcgcgtaaagggaggaggagggggaggggcgggggctgggccggggcctggcat

SEQ ID NO: 22557 - DNA, 14723 bp, Oryza sativa
agcttgcggaggtgggggaatggggggagaggaggcggcttggggtgggcggaaaagaggaagagggacttcatcatttggcgagaggaggaagagaggcgaggagaggggggtttggggcgatgagacgatgggagctcggcccgctcggggcctcggggtagagacggcgcaggtggccggccgagtagtcgatggagggggatatcttcctctgaatatcgattcccctggttttctttataataaacagttattaatccgtttagtatagttattactaatattttaaaaaaaaattgaggaaaaaaaagactctagccattacctgaaatattttttctagaaaacaaccattttgtagaaaaagatttaaatctcgaaaaaaatgccccacgttccaattgaagggtattcagtagtcactttgttattctgacaactttctaaaatccgaaaagggagttgtcagggttacgggtcaggcataccccctacccttcgatatacgttacgtgtcgacatggcatacccacgcgcacgcggatatttcctttatgatctaaggaaacctttcacgaaatcaatagacgggaaaagtccttctcggataagaaccgggttacctacgtatcgtgctaggtctggtatattcgagtcctactcgaagagcactagacctgcgatataaaagggaccccccgaggagggcataggggatcgaatctcagagccaacacaacccacacagcctacgaagccggagcctgtgaggagccaagtcgtcgagagctagtcgaatcaactcgactacaatctcgccggatctgacaagttccatcttttcctttgtaacctgtgttttccaccatataatcccatatcaactggattagggctattacctgtcaaggagcctgaaccagtataattcttatcttttgattgctcgatgtcgtactacgtagatccttgtaccagcgtaccccaataccctctatatccggtctgcgggtatcacccgtcgacagtggcgcgccaggtaagggcacttggtactcaaggttctactactatgccatcaagcttcgtcgacaacaacgtcaacaccagctccagccaagcactctcaacttcaacaatgctggtatggactcaagtcggcgaaatcgtcttcccggtttacaccacgatgccgatctcaatcggtccttcaatgactgaaaacgagaacgcagtggctacgaaccaagacggctctatgtcgaaaaatccacccgttgaaacggagaatggattaccgactacatccaaactcgggaaggattctgatgcggccaagtcttgtccctccgacataaatcacgggccgacaaagatgacttccgaagctatcaggtcttggtgtcctatccacaaaaccaagaaacatacccttcaagattgctgggtattcatcaacgtccgtgctgaacttcgcgcctgcaaagaacgtggaattcagcgtatttctccaactcgggatgtctattgtcctatccaaaagacaaagaatcacgatctctcgagctgcaaagttctcctcggcgccatgaaaaccccgtctcctaagtcatacgtccccgtcagggataacggcaaggaacagggagcgactccagcctcagatcgattcgttggggtaatcgatctcgatcctcacgaaccatcggtcttacatctcctcgaagactacgggtcatcgacaacaagtgcgccgcgggaggtactagttatcgatgacgttggcacgacagcgcaagccaacgcagaagcggcgaatcaatcgattactccagcccagcacatcagggctattcaagctatactgagggaaactccttacgatcccgttctgaacgacgacctcgagcgttggacagaacgattacgggagtcggtgaccaacctcagcaatgcattcgaagaggccgttaccggggcacaccaagatcagccaccaatcggcgaccccaatggtgaagatccggagcggagggaatcgcctcgacaggctacccctccacctcgtggcactggcgatcttcgagatcaaattaatggtcgccgagaagcacggcgcacacgggatgacgcaaatcgctctcggcgtcatgtttcttcacggcgccatgatcgaggagaccgcccaaacgaggaccgagaatgcaacgatcgcgaacggcgggggccagacaatactggtcatggccgtcgccgcaacgacgacgacgaaggagatcggcgtcgaaataacagcgagagacaacgacaagattcctgggatccaggtcgtcatcctcgtaatcgtacgccggagccaagcgacccatcgtcatcgtcatcatccgcgtcctcttcatcatcagacagacatccacgaaggtcacgcgaccgccggcaacccaccgcccccagtgctgggtgtagagcttttggtcgttccctacgtgatgtctgacggcctgagagattccgacccggggccattgaaaagtatgatgggagcaccgacccggaagaattccttcaagtctactcgacagtgctttatgctgccggagcagatgacaacgcgttggcgaactatttaccaactgcgttgaagggttctgcacgttcatggctaatgcatcttcctccctattcaatctcttcatgggcagacctgtggcaacagttcgtcgccaatttccaaggaacatacaagcgccacgcgatcgaatacgacttacacgcgctaacacagaactcaggggaatcattgagggaatacgttcggcgcttcaacgagtgcagaaacacaattcccgaaattaccgacgcttctgtaattcgcgccttcaagttcggtgtcagagatcgctacactacccaggagttggcgacaagacgcatcacaactactcgaagattattcgagatcgttgagcggtgcgcccatgtggatgacgcgctaagacgcaagaacgacaagccgaagactgggggagagaagaaaccaaccgcagacgcctctgagtcaaataagaagaaaaatcgcaaaaacgggaaaaggaaagctcaagcggaagtcctcgcagcagaatacgcgaaccctcccaagcgcccagacccacaagccagcgatacaaaaaaatcatggtgccccatacacaaaacggacagacattctctggaggattgccttgttttcaaaaagtcgctcgagaagcacatgacgtttgaaaaaggcaagcgagtacgcgttgtcgagaagaacgaggagacacctcctcacgaatcggattctgcgtacccagactccgacctccatgtctcacacatcttcggcggctccacaacgtactcctccaagcgggaatacaagaaagtggaacgtgaagtctattcgacatggcagggggctgcacccaagatgaagtggtctgaacagagaatagagttctcggaggaagaccaccccaagacctctgttagcccaagacgatatccgattgtggtcgaacccactattcggaacatcaaggtagcacgagttctcatcgacggtggcagctcgatcaatctcctcttcgccagcactctggatgcaatgggaattccacaaagtgagttgacaccaaccgatcaacccttccatggaattactccccaatcatcgtccagacctctgggcaagattacgttgcccgtgactttcggccaagccaacaacttccgaacagagcagatcactttcgatgtcgctgaattcgatacaacttacaacgccatcatcgggagaactgcacttgcgaggttcatggccacatcccactacgcatatcaagtgctcaagatgccgggaccgaagggaacaatcactattcaggggaacgcaaagctggcggtgcagtgcgacaggcagagcctcgacatggtcgagcaaacgcccaccccacccgccacgtttgagccacccaagaaagtgaacaagcaaaacaaggcgcccaagccggacggcacccatcaagatcgttccgctctccagtgctaaccctgacaagactgtcaaaatcggggctacactagacgagaaaataggaactcgcgctcatcaccttcctccgcgataatgccaacgtgtttgcttggcagccgtccgacatgccgggggtccccagggaggtgattgagcacaaacttatggtacgacccgatgccaagccagtaaagcagagactgtggagatttgcaccagaccgaaaacaagccatacgagaagagctcgacaaacttctcaaagctggcttcatcagagaattacttcatccagagtggctagccaacccagtcatggtgcggaaggccaacggaaaatggagaatgtgtgtcgacttcacacacctcaacaaggcgtgccccaaggatcactttcctctcccccgaatagatcagttggtggattcaacagccggttgcgagctattaagcttcctcgacgcttactctggctaccaccaaatcagcatggcaaaagaggatgaggagaagacagcgttcattacgccgttcggggtattttgctacgttaagatgcctttcggactgataaccgtcggaaatactttccagcgcacggtccagggcacacttagcaaccagcttggcaacaacgtcgagtcttacgttgacaacatcgttgtcaagaccaagacaagcgactcattgattgacgacctgcgggaaacgttcgacaacctccgacgatatcgcctcatgctcaacctagagaagtgcacattcggagtaccgtcgggcatgctactcggattccttgtttctggcagaggaatagaggcaaatcccgagaagatcaaagcaatcgagaacatgaagtcgcccacaagactcaaggaggtacaaaagctaaccagatgcatggcagcattaagcagattcatcgctaggatgagagaacgaggacagcctttcttcgctttgttgaagaaacaagacaaatttgtatggacacaggaagccgaagagtcatttattgcactcaagcgctacctatcaaacccacctgtactcgttgctccccaacctaatgaagaattatttctttatattgccgccacaccatattccattagcactgtcattgtagtcgagagagagaaagtacaacgaccagtttattacgtcagcgaaactctccatgacgcaaagacaagatacccacagattcaaaaactgctctacgcagtcatcatgacatcaaggaagctacgccactactttcaagcccacagagtcacagttgtctcctccttcccccttggcgaagttgtgagaaacaaagacattgtcggccgcatcgcaaaatgggtagtcgagctaagccaatttgatatccactttgtgccgcgaacagccatcaaatctcaggtactcgccgacttcgtggccgattggaccatgccagataacaagtcagacaaccaaggcgacaacgagacatggacaatggcgtttgatggcgcactcaacagccaaggagcagaggcaggatttatcttgacatctccctccggagatcaattcaagcacgcaatccacctcaacttcagtgcaaccaataatactgcagaatacgaaggactactcgccaggatacgagctgcagccgcacttggggccaagcgactaatcgtcaaaggggactctgagctagtcgcaaaccaggtgcacaaagactacaaatgctccaatcccgagttatccaagtatcttgcagaggtcaggaagctagagaagaggttcgacgggatcgaggtccgacacgtctatcgcaaggagaacgtcgagccagacgacctagcacgacgcgcatccagacgagaaccgctcgaccccggcacctttctcgacgtcctgacgaagccatcggtaaaagaaattaacggtaaatctggcccgagcacccccgacattagctcggaggtcaccgaggcagaacgtgccgttgctgacatcgaaataacagacgactggcgcaccccattaatcaaattcatcagcagcgaggaattgcccgaggatgatatagaggccgagaaaataacccgtaaagcaaagatctactgtatggtcggtaacgatttatacaaaaaagcaccaaacgagatacttttcaaatgcgtctccctcgacatacatgaaggcatatgcgggtcatacgccgccggttggacattagtcggcaaggcctttcgacaagggtttttctggccaaccgcccttaaagatgcatgcgacatggtccagcgatgtgaagcctgtcaattccatagcaagcacacaaagctacctgcacaagcgctccagacaatccctctgacttggccgttctcgtgctgggggctagatatatttgggccattcccacgaggacagggcggctatagattcctatttgtagcgatcgacaaattcaccaaatggatcgaagcactacccactggggaaatcaaggccgacaacgccattaagttcatcagagggatattctgcagatacggactaccgcactgcatcataaccgacaacggctctcaattcatcagcgccgacttccaggattactgcatcggtttgggagtcaaaatatgtttcgcctcggtctctcaccctcaaagcaatggacaaatcgaaagggcaaacgacatagtactacaagggataaaaacccacgtctacgacagactcatgtcacaggacaaaaaatgggttgaagaactcccatcagtactatgggccgtacgcaccacaccaacaacatccaacaagaaaacacccttcttccttgtgtacggctctgaagccatgctccctggcgagttacgacatcaaagtacacgagtacagaagcattccgacgagaaccaggaggaacagcgagacatcgatgtaaaccttctcgaggagcatcgtgagcgagttgccgttcgagcagctagctatcaacaagccctccgccgttatcatgagaagcgcatccgagcacgcatactttcgatcagtgactatgtcctccgacgagttcaaacccaagcagggtgaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacgccgtacctgtaagcacccttacagtatcaataaagcctatttctaggtttcataccacgaccaaagtgttttcacccgacgatcccttactctgataacacctagtgttgaaacctatccttatgaccctttacgccgtctcgacaaggcctccgaggaacctaagggatcttcggctggggacgcccagagccgataaggccttgtcagatccttcagagacaaaagaccatgtaagatttggtcgtgtaagagttctcgccgtacgtattaaccaagccgtgtactcggaaatcgagctttccaacttcacggctgggggctaggatcagagcttattcaaccaaggcagatcaagtgtccaagagccttatcatccgagaaaatttctccgacgacaaggctgggggctagggagagtgtatgactcaaacggccgaggtcgttaactgagaacacactctaacacataacatccagagtaagatgcgtttgtttaaggaatatttctttatacacataataattcttactgtttttgacataaatctcccactacattacactttttcctaagacatctgtaacaggccacgagtactaccaagagggccaatgccagtccatagactggaataccttctcggctaatggcgacatcgacctcgcaaggtggtctatctccgccggagtcctccgagaacgagcaaacccttcatggaggaattcaagatccaggcgcgggcggtgatctcgcaggcaagctagtacatgtcctccggcatatcggcttgctcgacgacactcttgcttcaaggcctcgtcaatacacttgtcgatgccatcgagttgggcacaggccccgttgagcaacgagatgtacctggccgccgattcctcaggatcgctgcggactactcgaagctccctgcatacccgggccattgaggtacagcaactctttaaatatgacgcaaaccacacctcgcggcctcggagcgtttccacggcttgctctttcttcatgactagcatggttctctcgagttccgccacttcaaatttcgtcttccaatattggatgcgacgatcttgggttgcaagggcatcctcgagacctgctaaacataacgaccactaagacaagctggaaaccactaacccaacacggagttaaataggctactcacttgaggtggttgtcgtcatctcgacctccacatcaagagtttggtcctcgacatcatgtgagacgtgtggttcaaattcgaataccggaattatcgccagtgactcaggctgcccgcgctgctggacatcctcgtcatcagcatctctacaatcgacaagaaaaacttccgagatcaatattgaacaaggatggtaatcatatgcacgaaggcaaccagagttcaagatttacaaatgacaaaaaaatacaagaagtcctactcttcaaaaagggggaggacagactcccccaggtcactgacttcttccatcacctccttacgtgtgtcgcttgccaccccctgatccaagatctcacacagatcgagttcagggcgcgacaactttacacatgcgaggacgtgacacgccccggtgtagataccgttggacgtctcctccgcgatcctggccatatgcttggaggggatttcccccatcgccgtcgccagctccgcaagagaagaagtcaacgagaactcatcggggttcaccgggatcgtagacttaacgccgcactccctggcgagctggtggaggccggtgtaggtgacctgcagcgaaccacggatctcggagagattgtctccaagttccgacatgcggtcctcgagccctttgcgatggcgctcgttcccggccaccagctccctcatcttggcgaggtcctcgcgggctttagccagttcccgcaccaaccgctcggcacgcgcgtttgccgccgccgtctccgccctcgcctctgagatctcgcggccgatgcctcgagcaccagcttcgagaaggcgccccatttcaacttggagctcctcccaggtgaggacggcctctggcagactacgacccccagcgggatcgctgacagggccgcttggcgtcgcctcccgactcccgaccacgggcacgacatctgtcgacaccgtggtaggggatgcgctggacgttcccccaaatttggcccaagcagccttcgcccgcgcctccctacaaacgaccacgaatcaaaactccatttgaacagaagacacgagaatccaaaaatctgtttactaacttctcgccgatcgtcacaatgcgctgacgtcgcggaggtggaggagacgcgtcggaagcctgcaagacaaccaatgtagagtgagaataaaccttccttgctacataacctagcgacaaggtgaaattaccgagggagttgctgccttgcggcgatgtccgagcacagacgagaatttcctcgccttggtcggagcttcgccaccactagtggtggcagcgtcagacgcctccttgacgaccttctccttcagaggtgccgccacctgatgatctgcgagcggtccgacgacgtcagtcaaaggaagggcctacgctaaatcatctcataagctgatttcgagcagagaaggcgggacgctatcgaatgaactcacattgatcgcttcatcgcgctccgtcgctcccttttcacaaaggggcgcggggatgtcgctcgccgtggtcgggccgctgatcatcacctgaccaacacgccgctccacggcttcgccgctcagacctgtcaaaaaggaatcaatttttgataagtcgaagaggaacgcgagtacaagcatgtctaaatgaatgcgagaaagataccccgaggagaaacccgggtcgcgtcgtctggcccataatagttataggtcggatgggcccgaccctagagcggctggattcgcctaccgacgaagtctgcgacgacttcatatcccgataagccccgttctcggagatcatcgatgatgtcgataaatgattggagagagggggtcaaggggggcttggcggtccagaccggaatcttgtccggttgttcctcgggaataacgaggaccggatttgaatccttgatctcaaggtaaaaccacctgttccgccatttgctgagagaagagggacactggaaggggacataacgcgacttcatgccatcacgaagtcggaacccgacgcaaccggataccctattggattccatccagcgcaactcgtaataaaagcggaacagatcaagaaagggctctaccccaatgtaggcctcacaaagatgcacaaagacgctaaggaaagcaatggaattggggttcaagtgtagaagagaaagcccatagaaattcaaaaccagtagaaggaattcggagggtggagggagaaacccgcagacaacataatcttcgatcgtaaccatacgacctaagatgggctgaggattagtacctcctgcttccctctctgccttttcacggccaggaagggcgccgtcctcttggagcttcttcagggtcgcgctggtggaagccgacttgccgagatccatcgctgctggaagatcgccggagatggacctagagctggtgaagctagggttctttacggcggcggagaaggcgaggagtgctaacaggcggtgtgtttgacggagttggcggacttacaaatgcgcacccaaaatccctttaaataggcgcacccccaacggtgcgaattccaaggaactgagagaaatccccgccggaaatttctaggtccgttacgcgcggcagtttttggacttcagttcaaaattcactcgtgaccgttgggcttcaaacggtatgctcgattacacatcatctccgcggttctcgcacccggaatgataacgttctcgacatccgaagtcgcgaatggccgcacgagtttatttttgagcagaagtcgggggctactgtcagggttacgggtcaggcataccccctacccttcgatatacgttacgtatcgacatggcatacccacgcgcacgcggatatttcctttatgatctaaggaaacctttcacaaaatcaatagacgggaaaagtccttctcggataagaactgggttacctacgtatcgtgctaggtctggtatattcgagtcctactcggagagcaccagacctgcgatataaaagggaccccccggggagggcataggggatcgaatctcagagccaacacaacccacacagcctacgaagccggagcctacgaggagccaagtcgtcgagagctagtcaaatcaactcgactacaatctcgccggatctgacaagtttcatcttttcctttgtaacctgtgttttccaccatataatcccatatcaactggattagggctattacctgtcaaggggcctgaaccagtataattcttgtcttttgattgctcgatgtcgtactacgtagatccttgtaccagcgtaccccaataccctctatatccggtctgcgggtatcacccgtcgacaggagtatctgaattctcattttcagagttttgcttgttctgtgaagaggtgatcgaaatgcatgtttgagagtaggggaggcttagagagagttagaaaaaaaaaatcttcctgacccctcttcccccaactctagcggctcaccatgggtgatggccggaagaggggtcgagcatctactctactagttctttagtatagattaggttagagttttctatagtcgggtgtcgcgcccagaaatttagcccaaatttccagactattttgtgtattaaatccctgtccaggaccagccaaggtacacaaaccgacaagtaatatacagttccaaacgtaaataaagcgtaaaatacttacagaagaggcacttactcctcacaccgaaacaaaagcagcagcagcggaaaaggcgatcctagcggggcttcagctccactccacaggcaaaactcaactggggtatgagccttggtcctctaactccatcttcagctcagaagcactacacttctgaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctgcactgatcaacgctataccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaaactacgctacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcgtcatgtcatgatactaggaggtctaatactgcaattatcccatcaactgagctagtggtaattaagcatggctaagcatatagttctagctaagtcacataagtaacatgagctagtcgattcattacccaaagttgacaaagaacagatatcaagtaaacatggcacaagcgagcagataggtaataccctgaccccgtgtaattagcaaaacatgcatatttatttgcaaacagtaaaacatttgtaaattaggatcaaaatgctcaaggggaatgtgtgacttgccttgcttcttcaaacaatcttccgaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaacggctcaattcggagttcgaatgaattaggtatgaattttagaagttttgagccatttaaatgaatttctataattaaactcgatttatttcgcaattattatttatttttacaaaggaaatggacctcgctgacgtcatcaagggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacgggcacgaggcggcgcgactggggcacgggcacggcatgaagccggctcggccgagacatggcgcggcggcggcaagggggaggcggcaaccggctgcagcagccggcgacgtggaacggcggcgggcggccggaggacagcggcgcgcacggggacggcgacgcaccccaagaggcggcggtcggcaagaaagggggacgggaaaaaaaaaggaagggaggagagatcctcaccggaagcggcggccgacgcggaggaagaggacggcgacgacgattgcccaatggcggcttgcgaggacggagggcggacggggtcgcccttgaccttcagaaggagaggagggagttagggaggggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggagtcggcggcggcggcggagagaggtggtgaagagggatgacgcacgtggcggcggcgtttcggagttggacagggcaaacggagtggaggccggggtagagctcggcaccgcaatgccgacgacacaaacggcgcggcgctgcggcccctagggcggcagtagcgggcggctggggcggcgaacggcggtggaagctcggcctcgcggtgggaatggtgctgcgggggtggaaagagaaaacggggtgga

SEQ ID NO: 22558 - DNA, 7748 bp, Oryza sativa
gccaaagctgcttttgcgccagtcagaaagaatcaccttagggaagttgttgctcctagttgaagacctcaacgatggtggttgtttggtccagtggttttgtgcttggctccagatctgcagggaagatgttgacgggagtattgggaagggggggggggacaagctttgcgctatgacatcggccgggacactaatatatggtcatatggagataaaaaggtaatcactagaaagttgactgcctctagatgaaggttgtcgtcctgttgctcgcttctagtcattcctttgctagtacttgttgtcgtcaatgcattggttgtgtgcttgtccactcaatcaatggccccgacagtgatgatggcctagtactgaatgggagtttctcttggttgatttggccatcaagcaatttattcaacatccacaaattgcaggctacctcttcctcaaccactttcgttcaggtcaaaagacaatggttcattcgtcgccatcctaatctttcacttgaaggtcaactagactttagagatggcttcatttttgcttccaaatagtgggtaccatgcagggttcgccattcgcgttgagcacggttcacgtgtgcaaccttggttcacaggactatagtcagtgttcctcatatttagatttagtggtgaactccgtgaaaatcatttgctgtgttcggtgaagctcataccaaaatttacgacgcaataacaaacctctcatttgtgccattccgtggaggcaaccgaagggaattaccggtttgtcaagcagtgtggatatttatagaggccgttggatgtagttgtcgcggcaacgccgcagcttcctgtcaattgacaatctttatcactgtttgctttcattatgaagcatgtttctttagtctagttacccttccttttaacaaggatggtacaatgctttcacttattttgtatggcgatgtacttgggattattcccctgatccctgactatctctaataaaaatgttcttgagtcttaaaaaaaagaattcttagttctaaagctgcagaaaaattgaaattttcttgcacaccttaagacaatgttttagccttgatacctgcaagttatgaatttagcccatctttgtagtttatcatggttgactctctaatacttcgtgatggtgaaagctcttccaatatatatgcatggtcttaaaaaaatcataatgacgtatttcacgaaaaataagaagagatggcaaaaatgtatataagactaatatattgcagttgttctattgaaataagaagatctatcaaagctatgaagaaaatttttgtattaacgtttctgcttaaaaaaactttacaatctacttggtctaataaaagttgttatacatccatcctaaaatataataatttttagcattcatttttttttcaaaaacatatcaattccaagttgttgggttctgtatttgagaaaacaaaatcaaaacttaactatttgatgggaaacaccatatgaaatcttgcaaatttcggattggatcactttgaaattcatgcaataccccataaccataacacctcctctcctccctcctcactcctaccgctgccatgacttggtcaagtgagcgctcgatgccccacctcctgtgtcgttgtcgtccaccacactaccacccggctaaactggtggtcgaaaggtgccgacaaggcacccctagcaagcctcttctccctttcctagccctccttctacttaagggcccctttgattcgcagcatagaaaaaacgcaggaataggaaaaacacaggatttgaagtggtaggattttgaaatcctatgggaagagaaaacagaggaaaacataagaagatccctttgatagaggcatagggaaaaacaaatgaatctgcacatcacttcatttccaagaggtctgacctcttttttagtttcctttgaaatccactgataggagtgcaatcctatggaatttatacttgccttttctatgaatcaaagaggcttgaagaaaaaaaatcctttggaatcccattcctccaaaaatcttttagcattcctttaaatcaaagaggccttaagccagattcaccaataccacccgccattaacgttggcccgctatcttccttcatccacgcggctctctagcattgttgcctacccatgtccattatttctcattcatagtcgtatcactgtttccacaacaatccatttaaacccgttgataccctctatccctaaaccctaactttgtcagggcattgcatgttattaaagcttcgttggagtttaaggagaaggagctgagattgtgggagcgcgaatcaccgaagcaaattgtgaagtaagaaatttataaggttttaggcccaagtctaggataacaaccatttatccattaaaagaagtactcagaataaatccccttaatcccaaggggtaccgtgaaaaaaaggagtacggctaaaccctcgcgagtccccactcttcctctccccgttctgcatcaccatgttcgccgccatctgccgccgccggctcgccgccctattcccccaaatccgcggtggcggcggcggcgcatatcatgtccagtccaacccccaggccgccctcctcttccacagctactcctcaaccgccgtcaccggcggctccgaccccgagccatgccccgacaccgtctcttacctggtctcctgcggcctccccccggccgttgcccgtcacacggccgccaacacccgcggcctccggatccgatccaccgagaaggcggacgccgtccgcaccctcctccgcagctacggcttctccgacgcggacgtcgcccggattgcccgcagcgccccgctgctcctcaccgtcgatcccgaccgcatcatccgccccaagctcgagttcttcgccacgatggggttccagcccagcaagctgtccaccgcgccgctcctcctcgcgcgcagcctcgagaagcacctcgtccccaccatccagttcctccgcagcatcatcggcagcgacgacgggatccgccgcgggttctcccgcatccctcgcgcactcctggtcagcctggacaactgcatgcgccccgcggtggaagcccttcacaggcacggcctcaccggccgcgaggacgtgtccaaagtcctcgtcctccagatgggcgtgctcatgctgtcgccggtccgcatcggcgaaatcttcgaggatctcaaggctatgggtatgtccatcacggacggccgctttgccaactcgttccgcgcgatgtgcagcatgaggagggcgacctggctgcggaaggtggcgctgtaccggagctttggcttgtccgagagtgaggtgttcgaggccttcaagaagcagcccacggcactgcttggcgctgacgagaccataaaaaagaatgcgtcgttcttccgcgacgcgctaaagcttgaaatgcgcgaggtaatggtgcatcctgttgttatggcatatagctttgagaagaccatcctgccaaggtgtgccgtgttgagcgtgttgatgagagaggggaagattaatccagatatccagttgcttcatgcattgcttggcagtgccaagacattctcagggaggtatgtagataggtttgctgctgatgtgccagacgttgttgaagcatatgagggtaagatcaaattcaaaggattcaagggtcagggtcagggtgtttaagtccacggaagccaaaaggctattcttctggagcaaaatcacttcaggttgggttgtctgtttttcttttagagccattgagatcaaggcatatgattctaaattctaacgctgtttcatggagcagcattactctgttgttggaccatggttacttagtatcatatatttgtagtttagcagtttccattttgaagtattctggtcttgggaaacctagatacatgacgtcgtagtgatacctttaaggccaattcctctatcattttctgatttcaaacaatctcgtaaattaacttaatttgtgattttcaaacagttctttcttcaacacacctgaaatatctgtggtttgtctgtgtagattatcaagtgttcagatttcagagtttccttatatgtggttatcctgcagctttacgtataaatctggcattgtcattgagagaaaatgcaagctagcacaatgaggacatcataaaacaagtatagtggaaaattatagctagtggcatgaggcatggcttgcaatgcctataaggcaaagaactaagcttctaagccttgctctccagatcactaaataagtggatttactccctaatacatagtagaatgaagaacatcagaagaaaactaattactggtatattgatatgcagatcaatgctaaacttgaactatttccactgccaccataagagaagaaacatatatttatccctatattttaattgaagattacactgcagtaatcgtgctgtactgctcttgaagcttgccaggttaaccacccacaataacctgcatctaacatgtgcttaggacttgtcatctgcaaatctttgttgtatgattgctaagaatgttcaagagtatctgatagtcttggaattgtgaatgcggagttacggtgacttctttgaactagtttgatgtactgttcttgcgaggtattgtgaagttttgtgaggaacttgctcaaagtttcagtgtccttaattctgcttagtgggagttttaggtcctagaatgggatatccatttggttgagagttgatgacatacaaatcatacttggtactatatcaataggctgaactgttacacaccatctgagtacttgagtccttgttgttctccaaaccacatgttattttctttgctccagtatgattcctgaacttatccatattgcttccatgaacttggaggaaagttagtcttgtttcttcacgcttgttgtcttccttaatgattgttgaaatttattcctagaaataagcacactgctaaagtttctagcctacccttattccttaatgattgttgaaacttattcctagatagaaataagaatactgttaaagtttctagcctcatattgaatagtgattttttacgtttgatacagcagtgatacatgttatgcacacgttttcactggatactgaggtaactacatgattcagtatttcagttatccatacagtagtaactcatgttttggaatgtgacattttccctctaatgatttgagaggtaattaacaagcatgacaactgtgtatttatcagtttaattataggtatcttgacatcttttcatttttaaggatcagatgctgcaagcctgcaacagtggttccgaacaaacggtccaaacggcagggcgtcaactgatgctccttgccgtctattaatgcagacaaaattttattttatgtatagatagatgaagttatgaaacatgctggtagagaaacgctcaactggcttgatgtacatacctctgttggtttaggtgaatcgctgttcaatcgtctctgtggtgcacacaatccttttaacacaagtctaaggataggggcataacaatgaatccataaatctcaataaatttatattgaaaatgtatgcatgtgaatgctattatgagcgcaagaatttaaactctgatgcttaaagtataagcacgactctaccataccaccaaatctctggcgcttcctctacttgagattttgctgacacatggattagtgtgaatgtgattataggcataggagattttgaactagtgaagtactatttggctgttttctttcctcttttttcccaacccacctcttttttctcacacgcacaagtacgtttttcaaatattaaacggtatgtttttacaaaagttttttttataagaaagttgttttaaaaaataatactaatttattttaaaaaatactaatacttaattaattatagaaaagttgttttaaaaaatcatattaatttattttttaaaaaatacaaatacttaattaattatgcgttaataaatcacctagttttacaagcccgaggattatttgctaacctcgtgtgccgaacacagctttacacacgactctacctaccactacacctatttgagattttgttagggcatcagcaatgtgctcgcaaaccgggtagtaagcaataaatacactcttactacctggtattaagcattgtggggctagtacataactacaaccgggtcatacccctactaccggaagcaaggaaatagaatatgcatgtacacagtgttttctgacagcaaaagcattgcttctcccaaccgttgtatgcatgctctgtccttgctacaatttttattaccccatggaccccaccttactgccaacttacagatataagcaatgtggagcacgtctccctctattaccgcctgtcatctgggcccacgctaataccgatgtggatagcaaacattgctgatgcccttagcacttagagtacttgtataattatttccctacatatcgtgttgactttataatgcattaagaattgaattcgattacaaacatgtttgatgcaactttttttttcagagtttgaggtatctcgttaactaattactttatctgttgcatgatatagtaacgtagtatcagataagacgtttgagatatctcgttaactaattatttcctcagttccataatatataatatagcaacacagtattagataaggcattgtattagggatggtaatttaacccgtttgcccgtttacccgtgggtaaaaaccctaatagagttgggtttgttctccatttagtacccatgggttttttattaggtcaaaacctatacccaacgggtatacgggcacgggcaaaaaccaattgacatgtggtcactcagttaaattagtataaatgccaccatctagtactgataaacttgtaatgcttgtattgttgaacttggtacaactgtaccctttctttaaattgcgataatgtctctctgcttgtagagatttgtggttgaaatgttgaaatgtgagtttgtgacaggtaaacgcgcatgcccgcgagcacatggcgcctgcggacaacgggcatgggtagtgttccttgcccgtcatgtagtaacggatatgcccgcgggcatgaattacctcgcgggcacgggtatgggtagtcactatccgtgcccgtcgtgcccgactgccatccctatattgcatagtataacgaatataaacagatacacgtctagattcattttactatgaaatttctcgtccggtactaaattattatattataggatggagggattagctattaatctaagctgcatatggatgaggatattattgcatttcagaaaatgttactactgtcaagtcagttgtagtttgaaatagagtaaattttaggaaaaggtatgaattaccccactgaactatcgcagtcgatcgaattactccctgaatccgaaaaccagacattgttcaccctgaactttcaataccggacgaattacccctctcgacccaatccagagtggttttgtcttacgtggcgtatgcgtggcaatccggtcagcattttatttataaaaaaatgtgggacccacccgtcatactcatcttcccctcttcctctctctcctctctcttctctctctctcatgg

SEQ ID NO: 22559 - DNA, 7729 bp, Oryza sativa
tcccttcgatctccctcccctcccaccctctcaatggcggatctcagtgaagtacgcaagccgcggtgagccccgtcctcccgccccaccctgatccccgttgacgacacgatgaacgctgtcaccagcgatgtccccaacatcaactagttgacgatggggaacgtcacaaccggcgccacggaagcgcgttgcgacgccgggcatgcgccgagtgtgatgagcgtcgacgagctgaatccgacgaggcccacgccctcggtgctctgcagcccgatgaacgccaagaagagcccaatcccggtagacgacgatatccggatgagcttgggaatgaacttggcgaacttggagcgcaacccaatgacggagatgaagaggaatatgtggccctcgaggaagacggtggcgagcgcggtgcggtacaggagcctgccaaagccatggagcaaacactcttcgccccctcgccgtccccctccaccgtcgccgccgcatcctccaccccaacaaccgcgcccggcccgctctccctgttgccatccccactcccgcgtgtcggcgcgaccaacgcctacctcaaccctcgccttgcggccgccgcctcagtccactgctcacccccacgtgccgccgtctgccgcctgcccctccatgccgccgtgcgcacccgcgcccttgcacgcgagagagagagagagagagagagagagagattaggaagaggtgaagaggaggtatgaccggtgggtcccaccaattttttcaaatgctgaatggtatgccacgtaggacaaaaccgctctggattggatcgagagggtaattcattaggtactgaaagtttagggcgagcaatgtctggttttcgggttcaggggataattcggtcgaccgcgatagttcgagaggtaattcatactttttcctaaattttataaagagtaaaaccccacctattatggtccaagtttcatgaaaccacaagaacctgtacacattgtcgacgtttgatgtcgcgattccagtatttgcatagtatggggatcgttggtactagggtatatgcgagattgagataaaaaagatggagacagggatttttatacaggttcgggcccctgaattgtcaggtaataaccctactcctgttggccgaagccggtcattgctcttattcaccataatcacaccagtataatatttgaggtagcctatctatctgttgtcgacttggcggtctaaagtgctgactcgtagtcgacaacatggtagccttcctcctcgaatccgtacccggcgaggtcagagatagcactagattcctctcttcggttcccgtaggtaccatattgggttttcctaggcttatctctgatgtcgatatctggcagcttgtcttggcgtatgtaggcttgtattggcttgtggctttgtggcgtccatgttgcctgtgtcccctctcctcctagggggccttgtatttatacccataggtgtcccctttccaagtagaactagggaaaccaatatggatacaatccgactagtccttgtcgtttccatgtagaactctattcatcctttcttacgtgaaactcctactatatccgaaggttgttcccgtataagacatggtatgtggtgggtcctgccgagatttagtcaactactattagatatgtggtatcaataaccctgacacacatggtacctacccttagactattacgatcctaacgtttttacagaatcacattacttatcactttgactttggcctatcacatttttaagttgtacagtcacatcttaaatttatgagaattttatccatcatataaatggtgcatccgtttttctcttttgatttaggagtatgtcaaaatagttaataatgtgatttatgaaactttagatcataatacctaacattatatgtcacatattaaaatacctatggttttatataactttggacaatataatactccctccgtcccataaaaatcaacctagtaccggatgtggtcctaaatttgttttttatgggacggagggagtaggtgatagggagtaggtttaatgaaatttaatctttataaaataagtggcccaatattaaactcaaatttcacacatggagaggtcgcatcgtctccttctcgcctcaccacatagcgtctccttgtctccttctcgcctcctcgtcccctcgccttgccaccgcccgagcaagctgccggcgtgccgggcggcagcgagaaaggcggcggcggggctttcctgcggagaccacggcacggtttaggggtttaccgggtctggggctccggcctacaaatctggcgatgcgggaggtagcggggccatgggcggcggtggctggccgggccgcacccggcggcgaaggtggttgggagggacacaggcgcgggagttggcgagcgacggtggctgaaatgcacttggcgcgcagcagcggaggggtcggaaggcagtgcggtggctggtcagcgagatgtcggcggcgacgactcttcgagtgaccgtgggttcaatggagaacggtgacagccttagtgtcgatgcccagtcctcggcaaggaaaggcggttccagcgaaggtggtttcgtagccagcggctacactaggggcggcgacggctttcgagttcgagcagtgacctcctcggttgcggtggcgtaagcgccggtgcaaggtggttcaggtgaaggtggatccagttagtgacggcagccctaggggcggcggaggcctaggagtctaggcggaagatgatatcctctctgaccacggcaaaggacgccggcagaagtggcggcgggctcggagtccgagaggaggaggattctaacgttggcagtgaccctatgggtggcggaggcttaggaatccggcgaagcagatcctttcagctcgcgtctggttggctagttctgagtggacgatgatggatggctagttctgactagacgacgatggatgaaggtggactacccagcggcgcgtggcatcggttcacttgaagcagatgaagatggcaccaatggagattcgcagcgacaatgcactaggggcggtggcgactagacgacttccactcgtcgttttcgactgtttcaagagagaatgttgggatgcagggatgtgtcaaggttgtaggtttttggttttttttgttgtgtgttctcctctttgttgaggtgtaaatctaagtgctcttgtatctttttagctatgtatatccctcgtggatacagagggattaatggaaatccattatctaaagaaaatcaaactcaaatttcaaacccttctccctttccaactctccacatccaaacagcagactaaaacctaaagccgctttctaacagtcgcaaactcgcattagcgcttcgaaatcccaggcatgttccccacagccggcggccgccggctcctcgtcctcatccgccgcgcctccgccgccgccgcggccggcgcaaaccctaaccaccaccaccaccacgccacgcttttcacccatcgctactcttcgtcccccctagcaagaacccctgaggcggaatccgccgccgcggcctcctacctcgtcgcctccgtcggcctctccccggccgccgccgccaggatctcccgcaaggcacgcttccgttccaacgccgacgccgaagccgtcgtctccctcctccgcggccacggcttctccgacgccaacatcgcgcaggtgctcccaaaaatcccgggcctcctcatcctcaacccggacaagatcctccggccaaagctcgagtacttcgcctccctcggggtggtcccctcggcactgtcccgcgcacccctcctcgcgcgcagcctggagaagcacctcgtcccgtgcgtcgagttcatccgcggcgtcgttggcaccgacgccaacctctgcgcggccatctcccggaacccctgggcactctggtgcgacattaacagcagcatgcgccccgccgtggaatcccttcgccgccacggcctcgctgaggcgaacatctccaggctcgtcgtcatcaatctcagcgctctcacgatgtcacccgaccgcattgacgggatctttggggacctggaggcgctcgagctgcccatctcgcattcgcgcttcgtgtacggcttctgggcactgtccagactcaagaggggggcatgggaggaacggatgtccgtgttcatgagatttggggtttccaggagcgagttgctcaaggcattcagggagcagcccggtatactagtgttcacagctaaaactatccagcggaagctcagtttctaccaggaaaagctgaaggttgcaccggcagatgtgattgcacatcctcttctcttgacgttcagcttggagaagaacatcatacctaaatgtgccgtgctgaatgtgctattgagggaggggaagattaagagatatgggagagagatggacttgttgagacccttgcagcgtagcaatataagtttctttgagagatttgtgaggaagtatgaggaagatgtgccagatgttgtaaaagcgtacgaggggaagattaagttcacgggattcatggattaggatgtcaatgtttgattatgctgaggccaaggcgccagctttctagggtgtattctctgtagcctgtaggtaaggctaaaattgtcgtcaaattaatgcatattgcttcctccttttttttgaactaactaacatcatataaatgaaaatggaggtaatacatttttacattgtcttgccatgcaatcttatcatatcctatatgttggattacttttgctaccgtagtacaagtaactaatagcatcatgagaataacgaagttgtgacatgttatttagcctttgtattttgtagttttgtggtttatatgcacttagagacacaattgctcttaccctaatcttcactaaagggacagtacatttatcttttatggatagccaactcattcaactgtctgtgctgaataagctaatttcccccctcctaataatggtgtgagcagagtattttcactggcacttgacaaattccacttctaagttatgctgctcaaacagtatatattgttctgtgaaatattatgacactgacaactcctttttagagttaagaccctgtcttgtttgaaattcctttttttttttcatttgtgaagcatgtcctccccatacagaatttgtttcacccaatggaattgacaaacttttcttaagagttagacctgtcatgtctgaaattcttatttataaaatatcatcctcctgtaaaatttcttcaccctcttgacttttgtaagtcttcagaaaacatgaaataactgcaggtccattgtcctgctatcttatccccttttatccttgttggtaggctaggactccattaatttattttatagaaaaacaagtttttttttaatcaaaggagccctttgtaatgttctcatgaggcattagaacttataaagttctgtggcgaacttatttgaagtttgtaagtgtccataatgatgctcagtggaagttttaggtcctgaaatgagtatccatttggttagagttgatggcataccattggtacttggtatatcaatagtctgaactgttacatgccatctgagtattcgaagctttattgatctccaaaccacatgtaagtttagcttcaatatggatcttatacatattgcttttccgttaacttgggaggaaagttagtcttgtttcttcacgcttgtagtattgctgtaatgattgttgaaacttatattcctaaaagtaagataactgttaaagtttctagcctcattttcaacggtggttcttaactttttcttataagcagtgatacatgttatgcgtgcgttttcactggatatttgagtggtaaatgcattattcacttattcacacagtagtaattcatgttttgaaatgtgcttttttttttttggttgctgatgatttgaaatgggtcttcaccaatttcattattggtgccttgtcaattttaaggattaatgctgcaaggtcagtggttccaaaaggcaagcgtctactgatgctccttgccgtagtgactgctaaagacagttatagaatcaaactctggctatgaatctgaacaaccatttgtctagattcaatgacccggaggcccgtacgcaaaaatcggttttggttgtctggaatactagtacgtattgtaaaatactagccctccgttttatattacaagtcgtttgacttttttcctaatcaaaattcttttaagtttgatcaagtttataaaaaatataataacattttcagtacaaaacaaacattgtatcaaaatatattcaatgttaaatttaataaaactaattttgtgttgcaaatattgctagctttttctatacacttggtcaaacataataacttgagtaaattttacaatgggccacatattttaaccaaggtttcataatggactagggttaaatcaatgttttcacttaacaccatacatctttacataagttttcagtttgaactaggggtgagcaaaacaaggggaatatgtgagagagcttcatatgatttacacagggataattataaaaggcaaaacactttatgttttcttccttttcatgtgtggtagttaactagttctattttctattttatttttattcatttaccacaatgtatagatcattttgtgccacttttaaacatgtttacgtcattattttagtgtgatttgctgaaaaaagttatttttagatttgctattttttttctaaagatatttatcttaataccgtggcactaaaattgatgattttaactatcttttctctggcaacttccttctatgtgctcaaccctagtccaaagtgccaactagtgcaaacatatatggtgtttagtgaaaaggttggtgtggaccttgcctattgtgaaactttggtcaaaatacatgctgcaatgtgaaatttactctaataactttaattaagaaaaaagtcaaacgagttataatatgaaatggaaagggtgaaactttggcaaaaactcactctttcattcagagattggtattttcagacataaggccttattttgtgttaaacaccgggggacccaaaatttgtaggtatggccatgcatacttgggaacggggcaaatgccagcactgctacatgctagccgaggcgaaaattattgcaggtcgtctgccgagacgggaggtatgaactgaaccccagccgcgatgcctccaggtcaaactccagcaggttgtcctccatcatgtgcccaccgatcacaaccgacgtctgcggctccgtgccggcgtccaccacgccgaggcagagcgcgcctcccttggtggccaccatcgagttcgccccgaacacaacccacgaggcacccgtgctttgcagcaccagctcgatggtgggcacgggcggccccacgcgcgtgctccccaccttcctcccgtcgtagcacagcttgaacggctccactgccggtgctcgcgggatcgcggccatctccttcgcgaacgcgtcggtcaccgcctggtggatggatctctccagcacggtgtagggggacaccgtgcttaacttggtgcccgccacttctttcttgtcgatggccagcagcgtcgcgtt

SEQ ID NO: 22560 - DNA, 41078 bp, Oryza sativa
  unsure (1)..(41078): unsure at all n locations
nnnnnnnnnnnnnnnnnnnnnnnnnnnnnnnnnnnnnnnnnnnnnnnnnnnnnnnaatccgatggaaaaaaaaatcctatgaaggtctttgaaacaaaggattgaatcctatccaatcctttaaaattcctatggaatgggtaatcctatgtatattttggaggaaagttagcaagaggtctaacctcttggaaaatttcctctgagtctatctctctcatgttcagaatcctatgtttttcctattcctttgttttttcgttcctatgattcaaaggtagaacctcatggaaagaatactttgagtctttatctctcctcaaatttatgtgattttcctgcggcccaatcaaacattcattcctatatttttcttgtattttgcaatcctctgttttacactagaattcctgtcagaatcctatgttttttctattcttccatttttttcattcctgtgattcaaatgggccctaagtgtaaaacagatgattgcaaaatacaggaaaaaatacagaaataaccatttgattgaaccgtaataaaaacataggaattggatgagagagactcaaaggaaagttaccaagaggttcaggttgaacctcttgctaaatttcctccataatttctataggattgtcaatttcataggaatttcaaagcattagataggattcaatcatatgtttcaaagggcttcatacaaaattttcctataggattaaaatcctccaaaatttctatatttttttctccaaatcaaaggggccctaaacaaggccttaacgtggttaggatcaaagtccagacctactacctctttgttgggccagtttaaccaatgttagttaggaaaaatggattttaatatccccttgagatatattacttaaatagtacccctccatcctaaaatataagtattttttgatcctgatacagtctccgagatgctactttgacaaacaatatctataaaagtaagatgttttaaataaaaatagttgcatattatgttagtttgtttaatgataaatctagtaacatcaattttacatgattatattttttatttctttgctattaatagttaaagttaaaaatgtttgactcgttactatgctaaaaatgcttattttttaggacggagggagtaataaaaaaatttaaagagaaaaaagacgagatagattaatatgtgatatataactccagaaacatgcaaatttatatttgatagccgcaagttgtaacaaaagtaatagatttaactgtaacttgtacacatatgctcaaagtcatatttattttttttcaacttgtagaagttaatattaaactagaattttgtgaagtgatatattgtatactaatctatcttattattttattgttctttttaagaaaatcataactttgggacgatatgtaaagaatgaaacgagagctttgcctgttacttaccatctccacggcttcgtcatcgttgattttgtcacgaaccgtgtacaaggctacaaagtagccgtagcaggatttgccatttttgggtgtgtgagatctgactcatccaaagcaaagcatgcattactgtgatctgtcctccagggcttgcttcctgccatgatagctagggcaccatttgtcgccgtctccaacctaaaaccctcgctgctgagtaggaatagctattttttgaattgggaattacctcatccatagaaattttaccagtgggcgtgaagagacagactacgggaggaacaagaaaatcaagcttactagtattggagaggcttttgtgcgtgacagcgtgagagtagctccaatgttaggctaaaattgaaccgtgcgcacaaaaggatcggaccgagcaaactgagagtcgacttgtgtgttagagcaagtttaatagaatagctatctactaactctaaatcatctatagtcaatattataatagccaattaatacaatagttgcttactatactattaatacctgatctcacctgtcatacacatattacatcttggagtccatgctgcagctggctacagatctgtaacccgctgctcttctctctctttcttttatctctttaaaatatgtttatagctggtttatagctcgctattgtacctactcttagagcaaggctaataatgcaaccgacctattggctataatattctttgtagtcttctctcagtctacccgtataaatagttagctctttacaattaataaatggtccacttgtctctctcacagagtttcttagttcttgtgtacaagccggctataagtttacagtccgcttctcctctctcctctcttctctcctccacctcagtatttagctggctctcttagtgaaaaaagcgacttccaatgagcaaaaacatttcctatcatagggtcacacgagtgggtagggcggacgcaggtgagattgagattttcatcccacgaatcaattttcacagcgatcgaacagatattttgttcaattcgcttgcatggactgcactagtcaaaccaacagtagagcactactacaaaacatatagtgacggaagtgataaaaccaacaaatatagtgcctttcctacccacacgcccatcagcccaccaaaataccaagaaccggcatctttatctcctaataggtgccagtttttttaaaaaaccgacaccttttacccctgtcagaaatagatgccggttttaatttaaatctaacatcttttagttggcgctaggcccacccaagaaccatcatctttgtggcaaaaggaataagtgtcagcttttttaaaaaaatcaacacttataatatattatagatgccagtttttaaacaactgacaccccataaaactgagccgcacggggaagggaggcgtccgttcttatccatccatccttctcttacccacctctctctctctcttcttccttctcttccctcccctcggctctctcatgcacccaccccatcgagcggcggcggcggcgtcctggcggtggagatggccacggcgcctcccctctgccagatccgccggggaggggaggcgtcggcccaacacgaggtgccgcagcgggaggcaacagcgccctccgccagatcctaccgggagcggcggcccgacaggaggggggacggggacggcagaggcaggcggtggtgagagggaaggcggcggcggcagaggcaggcggttgcgagagtggaggagacggcggcggcagaagaatcggatttatgttcttgtttctcatgtgttcttgttgttgttcatgcaaaagaatcgagttgaaggaattgagattgtgttattgttcttgttcatgtgaatcgggtgtgttcttgattggtcggggtgaaagggatctactcggctcgatgcatcagccgagtcggcttttttttattcgtaaaaccttaaaggtgtcggttctaaaacgtaaaaaccgacatcttaccaatgtagatgccggttctataaccagcatctaagagggtttccaacaagcaccaaagtgctttaatttctgtagtaatggaggggccctgataggagtagcatttatcccggtggagtgtgcagtgttacgaggacatgctaccgctatagtgtgaggtacaacatccaagtcaacatgaaaaaatgagtaattttcgtaacaccgtataaactttgctaaactagcattcgatgttttctacaggagaaacacaaattttacactcaagttattgcataactatagttttagagctccaccttcacatgaaccgctacaagacaagtgagttatacatgtcaaacatgtagtttttctcgtcaaaacctatcattttcttcagactagcgagagtgcgagactctattcgtcggcgacatggcgttgcacgtactggtggagtctaaacttctagttttatgaacgacgacttagcttaaatttcatagttctatgagatataaaatcatgaatttgtagtagtgtgataatttagataaaacatatttgctccctccgaaaaaaaattctatgaccgaatctgaataagcatccatccattcattcttgaaaattagttttttcaaagacagagggtgtacttggtaaaaattaaagatgtcaagtgtgaaatggattctaatctcttaaggggatgcctcatcgtttttgcatgtcatttaaataattataaagaattaaaaaatagcaagataaaataatatgcaatatattacttcagaaatatgtaagtttaagttcaattttgatctccataggttataacaaatttaactctaaatagtatgcgtgtgcttatagttattttttttaacttgtagaagtcaaatttaaacgtgcatgtttgtgaaatagtatatcacatattaatttgggtattaatttatcttatagttttttaggatatatataatttttagacagacaagaaacaagaaactgataacatccgccgagagattaaaagaattcccctaaaagtatgtatgatttcgccaaatttactgatgttttttcattacaacagagattgcaaaaggctagcaccgagatacttcgcactatcacatacagaaatgcagaatttatacaaagtgagtataactcaactgatcaggtttcctgtggtggaacctgtccaccaggttcaaatcttaaatttaacatgggcttgtgtttgtatcatttatttaaaaagaaaacaaatgagctaccctggcaactgccggcattgctatatactagctagctagccaaggtgaaagctgttgcaggtcgtctgcagcaacgggaggtaggaggtgaaacccagccgtgacccctccaggtcgaactccagcaggttgtcctccatcatgtgtccgccgatcaccaccgacgtctccggggctacgcctccatccacaacgccgaagcagagcgcgccgtccttggtggccaccatagagttcgccccgaacaccacccacgacacggctttgctctgcagcaccagctcgacggtcggcacggccggccccgcgcgggtgctccccaccatggtcccgtcgtagcaaagcttgaacggcgccacggccggcacacggggaatcatagccgtctcggcggcgaacgcgtcggtgaccgccttgtagatggaggtctccagcacggtgtaaggggacaacatgctcagcttggtgccgcccactccgctcttggcgatggccagcagcgtcgcgttcaggggcacggcgcggccgttcaccttgatgcccgtcacaccgatgaagtactcggtcgacttgtcccctgccgtggacaccccccgttgtggtcaccggattgacgagtagcggggtgtagattagtgacttggagaggtccatgacgggctggaactcgtagggcgcgtcgccgaaaacgacgacgccagatgactcagccggcgcgaggcagagcgcgaacttgcgggagaagcggaagatggaggcgacttgcgtggggagcgcgaagcgggcgcggctaagggacatcatgcccgtggccgcggcgccgaggcctttggtcagggacgttgcaccgcaggtgaacagaaaccccggcgcggtggcgcgcggaaccggcatggggcggcaggtggtgtacagcgacagcttgtctgtgatgatgttgccgccggtgctgacgcgcgtgatagtgtactccgggaacccggtgcaggtgtcgttgaggcagcccggggacgccgcaccggagcagccggtggcacaggcggcgctcttcgcgaggcggcaaggcttggacccgcacggcacgcgcgcatacgacgacgactcgtacccggactcgcagtccacccagagcatggcgcccgcgaggtcaaccacggccttcacgggcacactcggcgtccgctgccagaacatcgtcacgtactgctgcgttgcgccgtccttgtccaccggcagcagcacggcgctcgggctactgcctgaagccgcgcggcacggcgagagcgggacgaagagcagtagcactagcactggcgcggtggaagcgagaacgagacgaggaggtaggcatgccatgctgggaaaaccaaggatgtgcagtgacggtagtgaaggatcgaatggtttttatggagcgcgcgcccacgcgcggccaggagggtaggtcgccgcgcagacgcaggcgcaggggcgagaccgcgccaggtcgcgaagtggacctccggaatataactcttctaccacttgctagtgctgctcctgtattttaaggtttgggcaagtgcgatctttgaacaaattaacatgttttttatgggtgagatgagatccaaagggaatggatcctatattactgtgctctttgtgatcctgtgatcatgtccctgtcctgagcccctgacgcggtgacgacttaccgtttgtcgctaatctgatataatggagtaaaactctggttagaatctcggagaaaacctatgacgcttgtgttgctgacaactcacaagtcattttatagagaatcaccctcatgcgaaaatatatatcgatctccgttcaagcccctatatttatagataggttgatttttataggtgggcttttaagatgttcgctttaaaaattataccacatgagaaaataacgatgaaatacaaaaggcattggccacaaaaggagcagctaagtctccttctcacttctccctcattcctgttgcctcctttccggtgaagagaaaataacaatcaaatataaaaggcattgtccacagaaaaggcggctaagtctttctctcacttctcccggcctctttcctgttgcctccctttcttcaggcgacctctccgtctttcctatgcccctctcccttcctagcgacggctgcttcaagcggttgaggcgaaggcgtcgggattcgattggttgatagaagcggccacaggagggcacaaaaagcaatggagacggccgccacgtgcacatctatctctctagatctaccgacgggaagggtcggggatgatggcggactgcaccaatggcagcggcttcgtcgacgaatttttattaatttgccgattttgtcggggagttaggtatcgacatgttatatacccgacaacggtactttatgaacgtagcgtacaactgataccaacatatgcaccagtatggaataaagagacaagtaacattgattttgatactaagttcgagccctcaagaagggtaataacactactttagtttcagtataaaggagaagcaaacaaattaatcatgagaaacaaggcagtgggttgtattatgtggctagctatctgtagggcttcctcgtggtgtaatctcagtgtggtttgtatctatgacttacaagttgtaattagatgtcctcccctctctgggggcttggtatctaaatatatgaaagcaacaagctttctaaaaggaggataagccacatcatctacaatgtattgaccgttggatgaactggtaaatgaaaatacaccgttggatcatcatgctcatctatgacagtggaaacacgttggaccaatccggatgcttctagactaaagacctcaaaaagcagagaactcatgtgcttagtctatttaacactaccgttaaaaaaagtctttttaacactatatatatgtttgcttaattaatctcctggctaaataaaggaaaaaaaatatgacgccttacccgtaaatttatattgaatttatatgcaaatttatatctataatgtatactacttttgattgcttggtattggagcaacacacagcaactaagtagtatccactgtgtaccaattttattttaaaacagtccctacaaacgcacacactacacttaggatcacttagtgttattgttgtctccgttctaaaatataggtgcttttaacattcaaaatttctcataaaatatagctatttctacacctactctctcatcttaaccaacatagtcatatcctatttaatttcttcatctactttataatgtcaatcaattacagcattcctccatttacatctcttgctactgcatcattcccaaaataagtattatggcaaattttatatagaaatataaagcatttctaggacactaatttcaatgcatatctaagtatttttagccaatcaggtgttcgaaagagccaatcggagtagttcaaaatttgatagtaagtgatcgaaagaaatcattcctccttaatcttactctttactaaacaaactagaaatacttatatataggaattaatggagtatatttgaaaacaaagaaattaaagtacttacaaaaccggtaccttcaattaatgttaggatcaatgtctcaagtctaattatataggtaggtacgctaacgctcaaagtcgcacaagtgcgactaagtggctagtttatattgaaaggctaccccttgtgcaagtaaaacttgggaaccctaagtaaggtatgggcagacaaatacctatctttctcgggttagactccataatccttccctaaacaagcagaattccttccttacatgtaattttgtcttagatatatccttcagtataacattaggtatacaatattttcgatggtgaccaatataggtatacaaggtacgccatatctataacattgatattatctttccggaaaacttttttttcaaaatttgtatttaactttttgccaaaaatctttttcagccgaacgtcttaatgcacatgcctgcgaaattacttttcacacgcagttgtggtgcccttttatgtcaaattcattttttcacatacgtgcaatttcaggcggacactccaccgcctgagaaaagggattttagccgtacgtgaaaatgagttttgtagtagcgccggttgtaatatcccgagcttcgaattagtatattttggaaaaaacaatcaacttttaaatcattgtccgaataggcgatcagaaaccgtggatgcgtggatacggcatctggcggttcatgagcaattctaacaacaaagtagaaagggaaaattagaaatgtaggtactagttgatagtattagctaccatgggtccatggctactacaggttgcccacagtattgctatctgctagccgaggcgaaagttgttgcaggtcgtctgccgcaacgggaggtaggagctgaaacccagccgcgacccctccaggtcaaactccagcaggttgtcctccatcatgtgcccgccgatcaccaccgatgacggatacagcgcggggccgccgtccaccacgccaaggcagagcgcgccgcccttggcgggcaccatcgagtttgccccgtacatgatccacgacacggcctccctctgcagcaccagctcaatcgtcggcaccgctggccccgcgcgggtgctccctactttgcgcccgtcgtagcacagctcgaacggtgccacggccggcacacgggggatcgtggccgtctcggccgcgaacgcgtcgatgaccgccttgtagatggaggtctccagcacggtgtaaggagacgccgtgctcagcgtggtgccgcctacgccattcttgtcgattgccaagagcgtcgcgttcagtggcacgtcgcgcccgttcaccttgatgcccgtcaagccgatgaggtactcgatcgacgtctcccccgttgtgtacttccccgccgttctcaccgcgttgacgagcagaggcgtgtagatgagcgacgacttggagaggtccacgccgggctggaacacgtaaggcgcgtcgccaaatacgacgacgccagctgcggaggccggcgggagacagagcgcgaacctgcgggagaagccgaaggttcgggcgagctgcgtggggaacgcgaagcgggcgcggctgagggacaccatgccggtggcgccgttagcgaggccctcggtcaagaacgtgtggccacaggtgaacaagaactccggcacggtggcgaacggccccggcgcggtgcggaaggtggtgggcagcgagagcacgtcggtgatgatgttgccgccagccgtgacgcgcgtgaccgtgttatccgggaacccgctgcaggtgccgttgaggcaggccggggatggcgcgccgaagcagctgttgaagcagccgccggtcttggtgaggcggcacggcttggacccgcacgggacacgcgcgtaggacgacgacacgtacccggtatcgcagtccacccagagcgtggcgcccgcgaggtccagcacggccttcacgggcacctgcggcgtccgctgccggaacaccgtcgcgtactgctgcgtcgcgtcgtccttgctcaccggcagcaccacggctctcggccggcctcctgccgccgagcggcacggcgagaccaagacgaagagcaggaggaggagagcgccggaagcgagaggaggaggaaagcgtgccattcttctgagaggaaggatgcgatattccgatggggtgtgaaccattgcagcggcgaggaaggatatttatagggcgcaccctcgcgcgcggtttggtatttcggctctcgcaccaatcaccatcccagaatacaacggcgatggatggcggtggtagcctggtagggcagactgtatagtcgcgggccgagcgagagtacgactgtacgagacgccgaagtggaaacggaactctgctgttatagcaaggaaaatgctggtagtatttgacggtctgggcatgtgcgaattgcgacctttgttctcgaccaattgcgggccaccatgcaggcaggcaaaccatctgcacagccttttgcaggggtggccattgttgtatgggtgatgagatgatggtatccaactcatccaactaatctaaactggaccagtgctgatcagctggagcgaggggagctgaaatgggagaagactgcacaagcagcgacggttgattacatttgctgacaaagtaaggtcaagtgcttgagattacctatacattttacgataaattttctcttaaaagtttgatagatataattataatacaattataatgtaattacactgtaacttacatacagcttgtatgtaactttcaaaagtctctccgtaacatgctatttccgtcaaacggaggtcgtggaacgaaccctcacacatatgtgcacacagcgactttttttcttcatttgaatagatctaacgatttaaaattatgtgaaagttacatgcttacattatagttgcatgcaagttacagtgtaattacattacaattatactgtaattatatatattaaatttttagaagaaaatttatcgataaatatatagcaaaattaaattacattacgattgtactataattacatcagtcaatattttagaagaaaatttatcgataatatatagcaaaattgattccaaattgttgtttcagtcaaacgccacctctcactatcaaggatatggtaaagaacaagtagatccaagtcaaatgcctacgctggttgactagttgtaatggatgaacaatttattccaacaacttcacacgattgcacaaagaaatgcaaagcatcttttttttttttgagatagtaagctaagctgcagtggcgactgccatgcgttgcacatctagccgaggcgaaagttgttgcaggtcgtttgccggaacaggagggaggagctgaaccccagccgcgatcccaccaggtcaaactccagcaggttgtcctccatcatgtgaccgccgatcaccaccgacgtttccgacgccacgccgccgtccaccacaccgaggcagagagcgccgcccttggtggccaccatcgagttcgccccgaacaccacccacgacgtggcctcgctctggaacaccagctcgaccgtcggcacggccggccccacgcgtgtgcccgccaccttgctcccgtcgtagcacagcttgaacggagccacggccggcactcgcgggatcatggacgtctcggccgcgaacgcgtcggtgaccgccttgtggatggaggtctccagcacggtgtagggggtcaccgtgctcagcttggtgccacccactcccttcttgttgatggcaagcagcgtcgtgttcagcggcacggcgcggccgttcaccttgatgcgcgtgaagccgacgaagtattcggttgatttgtctcccttggtggacacgccccccgtgctcaccgggttgacgaggagtggtgtgtagatgagcgacttggagaggtcaacaccaggctggaacacgtagggcgcgtcgccgaagatgacgacgccggccgcggcggccggcgggaggcagagcgcgaacttgcgggagaagcggaaggtggcggcgagctgcgtggggaaagcgaagcgggcgcggctgagagacaccatgccggtggcgccggcggcgaggccttcggtcaggaacgtggcgccgcatgtgaacaggaacgccggcgcggtggcgagcggccccggggccgggcggaaggtggtgggcagggacagcacgtcggtgatgacgttgccgctggtgctgacgtgcgtgaccgtgttctccgggaacccgccgcaggtgtcgttgaggcaggccggcgacggcgcgccgtcgcagctggtggcgcacgcgttggtcttggcgaggcggcactgcttggacccgcacggcacgcgcgcgtacgacgacgacacgtacccggcctcgcagtccacccacagcgtggcgccggcgaggtccagcacggccttcaagggcgcctgcggcgtccgctgccggaacatcgtcacgtactgctgcgtcgcgtcgtccttgctcaccggcagcagcacggcggacgggtcgccacctgacgccgcgcggcacggcgagaccgagacgaagaggaggagcaggagagccgtgcaagcgacagcgagaggaggaggcatgcgtgccatgctggaaaggcgaaggatgtgactgatcgatggtgatgtcaagaagctctgtggcatggaaggatttttatagcgcgcggcgcgacgggttggtcgctgccacgataccgcggcttgcgacggtgcgactcgtgcgaggcagcgagtgatgcgaagtggtgacgcgcagccgcgggcgggagccgggagacgccgaagttgaccggactatgactcttctactattatgactatccagtatatactcctctattttggcgcttccattaatttatgatttggtcatgtgcgaattgcgatctttcaactagtcgttggcgtgctaagcatggatgctgggtgttgccatttttgtatggatgggacgagatccaaaggcaaatggtttctgtgcgcacgtgatcttgtcccaatcccaggcttatcctgccataagcctctgacccggtgacgcggaaccatttgtcgttaatctcaactaaaaaactcatgttagcgaaaaacttttgcgtggccgacaactaacaagtcgtctccatggagaatataatcgacgcgggattttgtgggcgggcacaaccttgaggccatgggatggaaggaagtctattttgcgtggggcttttgttcagaggagtaaaaagttggccgctgatccggcacgcggggcgtgcgccggcagcttttcttctggtcgcgggtgcacgccgactcgccggcgcggccatggatctgcagggaacgaactggaccacactgtacagtgtccactgtccaccgtgcgaggcgataacgacggttcatctgctggcaaagttggtccaacttgggcgaggttgcaatgcaggaggaggtgggctctgcagcctgcagtccaaccatgccatgggatatgggccatggtccagccccgtgtcgtgatggactaaaagctaggatgggccgaactatcttgattgggctcaattggccagggccatattacaatgaatgagagctccatgttttacatttacatttaagacgccatacaatttgataatgtggtaccttttcagcatgtaaaatattttaagagacaaaatttaaaaatgaatatgcttagtgtaaattatttgaaaaagaggcagtacattaataggcaaaagagttaaaatatgatattggtttgatgccgaaattgtataaatacgagaaataaaaagataggtaatcagatttttctaatatatgtttttgttatggagatttgctctttactaggaacttgcgttaataaattttggtgcatagcaatataaggtttagggttcttttgaaccgtgggcttaaagaaacatatgaatagaggaaaaaaaggggcaattgcttatttgaccctgtttcataaactaagtaccgatttgaccctactttttcaaatcgaacataacgtttgaccctaattgctctacatggttaaagtttctttagaaaaaagaaaaaaataatttgttattcaaatagaccaaaataccctcacttctctctcatctctttctctctttcctggcctgactcactctctctaactctctcagcgcgagcagtggtagcggcagcaccggcgcgagggagggaagtgggcccggctggcgctgtagagaaaagccacgccgccggtgcgcggaggaaggaaggaggtagcgccggcactggcacaggcacgcggaaggagggaaaacggccgcatcggcgacaggcgcgcagaataagggaggcggcactggcgccggcgccggcacagccgcgcggaaggaggtaggaggtggcggcagccaacgcgtggagggaagaagaggcgccgccggtgtgcgaggggaaggaaggcggtgagcctgggatagagctgtgaaggctggatctggcgagggaggggtgacgacggctcggcggagatgaggattggaggcagtgctccacagctgtcggccggtgtcggctcgccctctcactgctcgccgccttctccctgctagtggagctatggaggagagaagaagagaaaagagaggaggagatgagaagagagaatgacgaacgggtcccacatgcaatagggtcaaatgagtaagggcagaagagatattttgtacttcagttaacaccgttagatgcctttaacagaatatggtcatacaatatcttcaattttgaaaagaatggtcaaataaacaaagttgataaaaggggtcaaattggtagttagctttcgaaagagggtcaaatgcgtaattccccaaagaaaaaaactggaatagagcatcatggcctcatggctagcctaatcccataggaaatagaaactctggaattctagtaaaagaagttgtttggctactgtatgtctgtatttgaaaaccacgggaattaaaaatgaaacacttcattacaataagtaaatagggaaaaaaataaagagacatttgccatagcacgtaaaaaaaatgaaaaacactagggctgagttcgacaaaaagaaaaagagtagggagctcatcccataagcacttaaaatgaagtgacttattagtgcatgattaattaagtattagttaattttttttttcaaaaatgggttaatatgatttttaaacaacttaactatagaaattattttgaaaaaaacacaacgtttagcaatttgaaaagcgtatgcgtggaaacgatggagatgagttaggaaagatggttgccgaacatagccttaggttgagttcgtttctaattttcccaactcacctctctcttttttcatgcgcacacttttcaaactactaaacggtgtgtttttttaaaaaaattatgtacgaaagttgatttaaaaaatcatattaatttatttttaaaaatgattaatacttaattaatcatgtgctagtgagttgctccgttttgcatgcgcgagggattagttcccatcccaagtgccgaatacagccttagggtagggcaatgttgtcttcaatctgcattgtgatgcctaagcatgtgcactaaccacttttatcgggtgcccttaggtaagattaaattgtagccagttgagactactctagctctcaatggtgagaatatagaaatacagactcaagttggggagtcgaaccttgagtacctcattggggtttccttgtttttctagagttgaattcatgaatgcgcttcaactagccaagaacaaccagggtttcccctgctggcagttaccgcaaggtagccacattagccgagctttactacagggtacaatagggttgaattcatgaatgtgcttcaactagccaagaacaaccaggggtttcccctgttggcctgttggcagttaccgcaaggtagccacattagccgagctttactatagggtacaataggggtaaccgctggtaggatttggggaattctgtttgaatttaaatttgaataaaaaatcatacaataattcaaaataaattcctacaagtagtacctattttctattgcaatatggtgaacaatatttgtgaaaatgatgaagtttacttcattttggagctccattggaacaaaaaaaaatgaaaaaaagcaatagatgggttgggatataatacctactttgtttaaatataaaaaatatatatagcaaatgttatgccaaaaaaattatgcaatattacattatttttctagagacaaccatgttttttcatgaattgtccatgagtttttctttagaaaatttactacattttacattttttccgcaattgtttcttttcagcttcaacgcgcactgcatggtaattgtgtattaccgcatggagtttcaaattttgaattcgaagtttggaatatgaatttatagtggttaccatgattactgtgctaccactggtcgctaaatagtctgctggcaatagggtaagccctaggaacaattaataagtttacagcattgtgcgtgttcaatgggctatgtgttttccatatatcggataactagactacccaacataatgcacgtgcgcaaagtaaatatacacacatgtatagtgtgagctgctaagcatgtagactgtagagtgggtgtgtttaatgtgctgcaccttctggttgtttttttcccttgctatagtttggtcaaaaatcatatgccattatactctcttaatagtaagtacatatatgccattatatatgtacttataggcaatctctagattcatatattaaatttattcatcatgccatattagagcgccgtcttcgtctgagtggtaaaattacgtcttatgtggaacaaacgcacaataacatggtcttaatttgtattaaaaaaatcattgcaatgaacccacgcctatctttttcaaattagactccaaattctcattcaatgagttttccccattcaatgaaaagacaagtataaacgtgtttcatggatatagacaagatctcgatggcgcttccaagcgtgtcatgcttaatattggacaaaacttgtttttcagaatccgaagttcatggttttagttgtacaatatcgaaattgtacggttcactttaagaacatcaaaaaatacctcagctactcatttctaacatttggtcaaaactaccatgaaatttacttaccatatcgttacgccgtcttcttcacctgaagcatctaggcccccggtgttaattttggtaattaatgacaagcattaattgtggactaaccgttgtgtttgagcttatttatttgagttaggttcacttatttgtgtgcacatggatgatcattgatggattaaaattgacggtgcaaagcaaaaggaagagaagacggtaaactagtgttttctttttaaattgatcgaggcgttgggcgatcaaaattgtgctagtttatttatagttttgccgtactactaagagggggaatgacctagcaaagagatgattttaattgtcacattaggtcattgcattttcacttgtactcacattttcacaacacacttgttatatttttgtcactgctctggactgccagggtcggtttgaccgccggacagatgccggtttgaccggcctgtgtcaccggtctgaccgccatgtcaggaccggtctaaccgccgcaccaaagacggtctgaccggccggctatatggctgggatggcatgctctgggatggccgatcccgagccgccggagccgtattcggtcagaccgagctggtggcggtctgaccgagccgaggccagtctgaccggccaccccatgtcggtctgaccggccgggggcagtggggcccaatgacagccctacaacgggctagaaaactagccgttgtagagtagcacggtctgaccggccacatacctccggtcagaccggtagagcactgagttaggggatttcgcccccaacggctagttttggttggtgggagtataaatactccccctccagcagcaaggggactctcttaacacccaattcaattgcatacatcccttgcacctctctcacacacctttgagcttagtgttcatccattgtagtggttgaggttgttctagccaagagtcaagtgcatttgcttccattgtagagctagtgtggcacttgattgatcatctccatgccgggtcattgcttgttactcttggaggttgccgcctcctagacggcttgtggaggagttgcccggtgacctctccgagaagattgtggaggaggcctggtgccgatttttgagtggtttggagttcaccacctttggagtgaaggaagaactaccctagtgatcgaggcttgggtagtcctctccgtgggccggctcccgccttgtccaccccttgacgaagggggtgtgcggtggcttcgtggttgagcggtggagttgggctcgcctcaatggggagtaggaaaccagcgagtttccgaacctcggtgaaaaatctcttgtctccttgtctcatttgattgtggcatttacatttgtgcaatttatatttctagagacatacttgagatcatatcaccctaggattgctaaacattgacataggagtgtgatttattttcctagagatataattgagccactatcaccctaggcttgcaaaacataacttagttgcttagttagagttgaccctcaccaagcctagcaacttaggttagttttgattacgtgtcatttagttttaaatcgcctattcaccccctctagtcgacatctcgatcctacatcacccctcctttgcaacaacactcaccaactaccgcaacaaagtatgctagatagaacaatgataagcgagctggagggtggcagtacatccaaacaaggttgatggacgatggtgagtgaagtggagggtggcgcatttggcgggctcgagggtggtgcaacatactagctcgaggacaacaatatcggggcaagctcgagagcgccaacataggggcatttagggtctaggtgagctcaagggtagctgcagctagtaagcttgacgtcaattgctattggcaaactcaatagtagcggtggccgacgagctcaagcatggctgcgaagcgtgatcaatgatatggtagggaggacgacatcaacggcaaagcacattcgatgatagcgaggaggatgatattcaatcttggtgagagaggattggaggtaggacaaccgcagaagtgcacgaagggtaacgatatgaatagctagcattttgcacaacaccaccattgttcaacacaatacatgttgtttggctcgtacttgtaacaataacgattactagaatacatggtacaatttaatttgtattggctacaggctcacacgctaaccatgaaaattagatagactcagagccccacgagagactttgatgctatagaactttctgagctgttaaagtgaaccatagaattttgatgttcgatgtgaatgaacaagctttgtattaataagattaaaagagcacatatgcacaaaatatcaattggccataatcattgtaagcactatacagtactccagtatttttttcatgggaaaacaagcgtctcctagactccatcttcttcacgatcttgtccagtactccgtattatggttgttaatctcgacaaatactttagctttacacgcctttataaaatcgaaaagaacgtgaattgaagataaaagaaaaagttactgggattcagatcgccgtcacgttccgcaccgtaacgaaacgtaaataacggccgccgaggaagaagaggacggacgagcagcgaagcagccgcggcggaagaagaaaaaaggagacgacccgtcgcgccgcggccgccgtccggcaaacgcggccgatccgactccgccgacccgagccgagccagtaaaaccccacccaaatcccaacacctgcaactgcaagtgcaaccccccttcctagcagattcgcatcgaatcccgatctgagctctcccctcccccgacgaccacctcgcagctctcccgccccgatctgcgggcgccggcatggcgcggttcgaggtgggcggcaagtcggtggagggcgtggacctgctccggcggcggcactgggcgtcgcgcctcgacttctggcccttcctcgcgctctacgcgctctggctggtggtcgtggtcccggcgctcgacttcaccgacgcactcgtcgtcctcggcgcgctctccgcctcccacgtctcgctttcctcttcaccgcgtggtccgtcgacttccgggcgttcgtcgggtactccaaggcgagacacctctcaactccccaatccccccaatctagccaccgctacgtttggcgcgctttagtgtctagggctaaacagctcccgcttggtgacggtgcaggtgaaggatatccgtgcggccaactcgtgcaaggtaacgccagcgaagttctcgggatcgaaggagatcgtgcccctgcatatacagaaaactgtgagtatggcgtcgttttactgtggagtgttggtgttttccattttttttggtcactgagtgttggtttgggtggctgctcaggtggcctcgtcatcggcagcaggtgagacggaggagatctactttgatttccgtaagcagaggttcatctactcctcgcaggaggacaactttttcaagctccggtacccaacaaaggaaccatttgagcattatatcaagggcactgggtatggaacagaggctaagattaacacagctgtggataagtgggggagaaacatgtaagctgcaacttagctccctactatttgtttatggcattcagtaatgagtaaattgatcgcttgtatggctgtgaatgatattatctataacaatataattcaacttaacaagtacaatctccgcaaaaaaaaaaaaactcaagcactattgtcatttttttttcaatggatgattgtcctggaaactagctaatcacccatgttttttccgtggataaaaatgaatcgcataggctcttatacgtttcaaaacagtatatgtgatgtttcatcaaatatgtctttcacatatttttgttacaaggagtatctgactgtgttgaaacaatcttattctaaagttaactcatacactacatatttgaattacatttaagtttccctaataagaagaaaagaagatgtaaaatatctgttctgtaatattgattaaatttagggtgtaattcataaaatgcagtgtcgatatggtgtgggggagattcactaccacaaccaccgtgccttctttttaaaggagtatagatttttgtgcaattgaagattaacttgtagtcacgtcttgaatggaactcctaacttcatgtaaaagacatgcctgaggagaagaggaacacaataaaagtagactcttgcgttttgcagcatatagggtgatgatgaagtagagtccaaagagcagatgaaagcatttagggcatacttaaatatgtttacacttgggactatctaaaaaactttcacaagtttttttggtcaaaaactttcaaatgtaactgtagtataattagagtgtaattacattgtaactacactatagttacaatataactcatatttaactggtatgttactagaaaaaaaaaaccatgtgagatgagttggctagctacagcacgtgctcgttcaacacatcacactccaccttcctacgtatggctgtgattttttcccaatgttgcacgaatctttaggcgaaacaatggttagaaatttgagagttttgattggaaaaaaactgttgcatgttctgtagcaaatccgttacactttgcactagaaattcaattactatctctttataaattgcgctatcttaagaccactttgataggcaatttgtatctttttttatctgattataaatactaattgggatgtaaagcaacaactgtctgtggtactttttttttggtgcagtaaaatgctgcaaaaaacacaggctaggtgtataaaatctgtatatctgcattactcaaatcaataatgtgaaaaaaaaaagagatttgtatcaaaactgaaacttccatcatatatacatatgtttagctattgtggattagtgtctgatgatcaaattgtttccttctctagatttgagtatccacagcctacattccagaaattaatgaaggagcagtgcatggaaccattttttgttttccaggttagcctatctcatcattgacttggtattttaatggttcatctgcctttgctaattgtgatcctttttttactcttcaggttttctgtgttggtctttggtgtctagatgaatattggtactacagtctgtttacacttttcatgctcttcctgtttgagtctactatggcaaagaatagactgaagacattgactgagctaaggcgtgtgaaagttgataatcagattgttgcaacttatcgctgtggaaagtatgcctgcttcatttgattgattgcttatactgtttttagcatgttattcatcctacttatgtttttttttattatacaaatattcagatgggttagaatacctgggacagaactactacctggagacattgtgtcaataggccgctcagtaagtggagaagacaggtctgtgccagcagatatgttattgctggctggatctgcaatagtaaatgaagctattctcacaggagaatctactccacagtggaaggtccctcctctcctttactcattaattctaatatattcttttttgtgtggtgaaacaaccaagggttacaagcaaacttattgattctgttattttttcttcatttgaatttaccaccaaatttgactaccagaattaaaaagatctaagaaatgttaaatccataataaactcccatgtcaaacatgcacatatacaattggaaaaacccattgtctcttaaaatgtggaacagatgtctccagagaatttacttacatcacaggtgtaggaactaggaatgatgaatttggcaatcagatatttgcatatactttaagcgtgtgagctaggtagttacttttttggcatggaggttaggtaataaaacaatatctggttagtttcccagcccaccattggaggagacactacggcttgtagcatatttacttgaaaggttggggatttgggggtttctctacaatgattgcattgagctggtatttctgctgttgtatttctctaattaaatggtccagtggaacaccccagttcttcttatcagaaacaaatagaattaaagaaaaatgcttcaaagacgcattgaattgtgttaaccaactgtggcatccaacttttgttttgtcctgctttcaaatgtgctatccctagtatttttgttcaaaattttcagttctggacttctggttctgactaatcttctattcttataggtctcagttgctggtcgtggtcctgaggaaacactatctgtaaagcgagataagaatcatatcctatttggtggcactaagatattgcaacatactccagataaggtatacacatctattatacctactgctccctctgttcacttttaggtagtgttttggcatgttgatttagtcattttagattttctacgtaaagttttcccttataacccctatcaaagcttaggaatctcaaaggttttctggttgagataacttcggctatgtcacagctccatgtggcagtgctgctggttgtatcaactgatgccactatgctttgcctaatgggtagatgggcttggaactaatgaacgatattaaactaatgaaggttaaactggctatctagcattaaagaggtgcatcgttctgtggagtatgttagaatgtcaagttttgctgattggagggaggagatgtactgggaatcttgctgacatgtcttacttctgtgcagtctataaatctccgagcacctgatggtggttgcatagcttttgtattgaggactggatttgagactagccagggaaagttgatgagaactatcttattttcaactgagagggtaactttttcatgcattagagttaataatgctgttaagatgtgcaaacataacactctgattctaacaatataacaggttactgcaaacagcaaggagagtggcctgtttatcctatttttgctattcttcgcagtaattgcatccggttatgtgcttgtcaaggtaatgccagatggaattatcaagaaaatccatatgtttaattgtatgctatatagcacacttcaatattatttgaactttggtctgtccgtatgtagggactggaggacccaacaaggagtagatataagcttttcttaagttgttcattgattcttacttctgtgataccccctgaattgccaatggagctctccatagcagtcaatacatctttaattgcattagcccgccgtggtattttctgcacagagccattcaggataccatttgctgggaaggttaataaaaaaaactttgttgtgcttatgtttaatccttcttgcaaaagcttttaaaagctctttattttttttatcaggttgacatatgctgttttgataaaactgggacattgacatcggatgacatggtaaatgatttacccatgtgttgtattttcaattcaagtggaattttgtcaaccgaggtgacatgcatttcaggaattccaaggtgttgttagtttggaagatgatgaagaattaataacagatgcaaataaattgccactccgcacacaagaagtattgtccagttgccatgcattagtattcgtagataacaaactggtatgtaatggactatatgtcagaaataactagctatgtgaagcatagccaacggaagtttagataccttcttttgttgatggtatgtttcatcttatcaaaggttggtgacccccttgaaaaagctgctataaagggcatagactggatctacacatctgatgagaaggccatatctaaaaagtaagttgttgcctgaaataacagatgtaaatatgtgttcattgtagaactgttcatgtgatgacctaaacctgatcagacaataatgtctatgtcatagttaattaagtgttatcaagtagatttgtaaaactgaacattagctgtgtgtctagtcaagcgaaataaactttcatattggttttaacactagtgttatttcaccttgtcagttatgtggcatgctgccaactttgtcccttctctgaagtcaagctagttgtattaggagtaattttttatctttattcatatatccaagattatagtggactacttctctctggacaatttctcttctctcttctgtttgttatatgcacaactgtggctctgtttatagcattggaaagtcctgtacacagatgatagactagatgttttttctatcaaaagcaggatttcgatgtttgattgacttgcatgtattacatccaaatatatctgaaatgtcaataccagtacagttattagttattgattccaaagtaaaaagatattctattatttattttacttgatgtcatcttcattgcaggtctggtggtcaacctgtaaagattgtacacagataccattttgcttcacacttgaagagaatgtctgttgttgtcagtatacatgagaaatattatgctttcataaaggtaggaattccgagagactacataaatgttttacacttttttcttttgttagtaagattgctgcttaggatggttcagaaacaatttcttttggttttggcccagtgtgcccatgcatttggcatgatttcttgttcttagatattttaagtcaaccaaaacaaatgtgattttcataaggtttgaatttctacatgtttatgaatatttattattggtttgaaccaaatgaatagtgagaagaattcaccttgttatcctacatatgttttagatggatattaactagggtacactaaattttgagcggctatccaaagagacctattcgaggcttggctcttttctctttgtttgaaatcataagaaaattagaagtcagcaaaggaataatttaccatttgtcatgttagaacttatcttcattcaaacaaaattaaatatagagtaaaatacacggccggttcttaaagttgagcgcgggtgccacttaggtccataatcttgtaaattgcacatctagatctaccatcttgtttaagtgactcattgaggtccaaaggatctctgaccgggttgactggcttacgtggcggtccagtgtggcaacatatttgcattttgcccccccttttgctttcccgtgtccgatccaatcccttcttcgcgtggcgcacgcaggaacgcgccgacggcgacgtgtgtcagcacgcgcagctgcggcacccacccgtcttcaccacgccgcgcctggtacccctccggcaactgctcaccggcgttgcacagcgcccagaggaaccgcacaccgtcgttgacgggaaggagaaggaggagtggaagggaaaggcccctgctctggctggccgctggcgcgcgcggcaagcggctgtggcagttgctcaagtcgagctcgccctgccgccgttgccgccgttgaggtcgcacccaccccgctcgccgacgcctcccccacacgcacggccacggtcggcgacccctccccccgggagcggccggcgacacctccccccgccgcgcgccgagctcgccgacgcctctggcgccaacaaccagcgggaaggggaccggtggatctggctgtcagttaggcgcgagcgccaccggcgcgctagctatgaagacggtgacggagctccgagctcgcccaccatggtcatggcgacggcgctccgcaagctctcctccggctccctccgccgcccgccaactgctgccgcattcgcccgccgccgctccgcccgcagcccaccgctgcgcttgcccaccgccgtttcgcccgtcgctcgttcttcaagaaggatttaagggtgacgcggtggggcggcacgacgcccgccgtcgagaaggtgatgctcgtctccagcaccggcaccacggccgacgtgctgtggcagggcggtgtgccgtccttggagttggtgccgttcgacatcctcaacgaccacgagttcttcctggggcagcacgtcgacgtcgacaccatggcggcggcaacaacaacgatggcgaggcgcgtcagcttcgttgaggtccacgacggcgtggcgtcctgatcttcgagctcgtccgccacttgcttcatcccctctaatactgcgtcgttggcaatcatgcgccgctttgtcgaggtccacgacaacgtcgacggaggacgctgatgttggcgaggcgaggcgaggccggagaacgtgatgagcaaggcggcacatccgtggtgcgcgacgaggcgccgcatcagctcggccatcggtatgacgtggccggcgaaggtgctggcgatgaggacgacttgcgccggcggtgggcgaggtgacgatggaggtggccgagggatttggggattttttttgtgcctagggctctactgtagcgcgaaggggctatttgcaaattagctgtctacgtggaatgcaacgtagatggtcagcttcggtcaaacgaggtttggacctcaatgagtcacttaaacaagatggtggacctagatgtgcaatttacaagatcatggacctaagtgatatccgcgctcaactttaaggaccggccgtatattttactcttaaatatataaggtctcctttgaattcgttcaattccttcaggaaccaggagaaatccccatgttccaaaggaggcctaactatgatacacattaaactaattaacagttcataaaaaatattgtgtatcaggcaagcaccctgcaatagatatgtttgcttgaacaacagtcttctggatgcattagtgaccatttaatagggaaatctattagcgaaaaaaaatcttgatactagttatttcggagctagctcggtgcattactctgtactttctttattttagatcttgtgatattttaaacattttttgctcaacgtttctgtctaggccttctgcaagaaacctttaatgaagtatcctcttattttgtggttcagggtgcaccagagaccattcaggagaggttagttgatttacccgctggatatgtggagacatacaaaaaatacactcgacaggggtcccgagtcctggcccttgcatacaaattgcttccggatatgcctgtaagttagcatttaacatttctcggttcattaacagcgcattttggcatatcattttttttcttagtactagcaaaatatttgtgccttgcaacagatttcaaaaaatatatcttaagtttcttaacttagaaattatatctttgtttgaaattcgaaaagacacataacttgcaagcaaaacataaaaaaagacatataacttagaaactatccatccttggaagatcccagccactaagtaatggcagattcaccactaccactaggttcttttatactctctgttagcagtcttccagaaagttcctgatctgcaacatagcaaggacattttaactaaagagtaaaccttttcttttaacctgatgtataagagctgataaattccagctatacatagaattctagtttagtaaaagatagtctgactatattctacagcttgtctttgtatccttgtattagcaaaggtcactggagtcctatgaatcttatgtttgctcgaattggtactgataggttctttacctgacatgttttagcacctttacaaggaatgtttgctgaaatgaagaattccctaaggcctaagggcattcgggctgcatgcattaccaatgagttgggtctaaaagcaaagtaatatcactacacatgcatataactactacatgtcatctaatgacatctttcagagggaggtttgatgatggaaacttgagttagaacggtgacgggtgaaggagggcactgagttggggaacaaatctagaattgctggtccatgatcgcaactgaagtttagggactagggacttgtttattatctttggttcattcaagaagatagtgcagtccccttctatatggatgactctacttgaccccccctaagaaataatctgtgtcctagaaacagatcgtcctaagataagtatccaaattcccatcaaaccaacctaatactacatatctaacaatccctctccaatagacctgacccgtttgccagacagaccctctctccatattttgtggttcttattcaaaagttttgtatctgcaccaacttatagttatctaaaactaccattccttacccttccttaactcttctcaacctttgttaaggtgtaggaatttatgtcaggtctcttacttttgtctagtattcatccaggactctcgatcttgtaggcctagagccctcatgttgaatgcatccactattcattacaacattcatcctaggtggatttgcttggatatgtccatgaaaatgctcttacaatggtgcaaaataccatgtagcattttacaggggaatttggtggaaaatactgccttgaaacatctagatggcagtgttgcaaaagacagaatatgggtgtcggaccgacaaggtgccgccaagttattagtgggaatacagatgattaagcggaattgtacagatttttgtcgttcacactagcatatacattaggtgttaatgacaatagtagagaggacatatagaaccttaatcaaatatctgtacatttttctgaatgtatcatgaaaacatcattatttgctgaaagaataccaatgttaatgcattaataccaccaggcttgtccatgaaacgagtgcaattgtgcaactggactgcaagtctacattagtttaatagaaaagctatagctcctgattagactgaaaatgaccaattaataatgccatttggctgcataattgctctgaaacattactggcacaccggttcaatgatacgatacagtttggctaacgtttccatttagacagctgactaaacagtcatggtgactgacttccacaacactgctaaatggcaaatgtttgcaaaccaaaacctgcttgctaaaagcatcatctatttgtactggaggaaatacattttttaggaagacaaataatggattgtcagggcaatgtgggatatgctagaggcaaagaacatagtgttctgatttggagaatcctaggttcagaagaaacatctagacatttataatgatatttgtctatgatccacaacttctgcatccagaaaatagtcattatttattcactgcttacacttcaggagatattgcaaaatttgaactgtcctcaatctcatcattagtcgttccacactatttttaataaattacccaagtctcttcaaatgtatgtgatattcatcacttaatgtatacccttgaactttacaaagtagttgcagtttatttgtttattttgtatttttcagaagcaaccctatatctagtttgaattgtttggtctcttggtatttgaatgacaggtaaatgaagctagaagtttggaaagggatcaagtagagagtgacctaacttttgcaggttttgcggtaaaccaccctcccccactcccatccataaattttataatttctcaagtttgttgatgtgctcttttatggtaatggggttttgtgggcttaggttttcaactgtcctataaggagtgactccggtgctgtcttacaagaactggagcaatcttcccatgacttggtatgtactcttattcatcttgtgtccattcatcaaattacaagggtgcgatatagtgacatctccatgcattgtgcaatattaccttgttgaaggatttttgtggaccagtttctatatgatctttattatacactatgcatcggccaatgcactggaaaatttccatttgtgattaaagttcttaccacctccctgatgtattcttaggttatgatcactggggaccaagctttgactgcttgccatgttgctggccaagtgcatatttgttccaaacctgttttaattttgacacgtacaaagactggtggttttgagtgggtttcccctgatgaaaccgacagagctccatacaggtaagatatgcaagggtctgctctatactactaagcatttttagcaaacatttcatactttttagttaatacatactccattttttaaaactccgtagatgacgccattgacttttgtatgacgtttgaccattcgtcttattcaaaaaaattatataaatgttatttattttgttgtgacttgttttgttattgaagaaactttaaatacgagttattcaaaatttagtgcaaacgttattctaaaagtcaatggtgtcatctattaaaaaacagagggagtactttccaaagattcttttgtacaactgttgtttcttttcagtgaaaaaatgagtcttcctatttgtgctggtgaatattatttttttcctagaatacgcatgagagctgcgtatcattgcattaatagaagaaaacgaggcgtccaagatgctgttacaactgctgaaaagaaacaagctgacgaatattcacatttcttcttcttttatctatggcacaaacactgttgttaggaaagaaattcctagaatttggaaaatgataagcagtgaatatggtttcttttcctgattagtgattaatatataatttaattgttattccaaattcactttcattacacagacatagagcaactacatccattattttacatctctgccatcatgatgactgtgtggaacgtgtatcttctttaatactatgcctaatgtgctgcattaatattttgtagcgctgaggaggttgccgcggtgtctggatcgcatgatctctgcatcagtggagactgctttgaaatgctacaaagaactgatgctgttatccaagtcattccatatgtgaaggtatctgagaacagattacatctttttggtgcttttacggtatcttctactaccggcgttagtatgctagtagggtctaaatctatcagttgattttcatgtgtacttagaacatttcagtagaggtttagcaaggtaattttgaccattcacctgtcgtcgcatcacatgccatttgacatctgaatctatctatcaaccaacatgcacttttattccaattttggggatggaaccaaaatatctgctgtccatactaccaggttcagtaccatagaatcttatccattaggtcaaatgcaatggatggaccaaggtttatcctagggtactataaaaaacagttaaaagtatattgaatccttattcccattgtttattttgtatgtgttgtattttcaggtttttgcacgtgttgctccagaacagaaagaacttgttctgactacattcaaaactgttgggagggttacactgatgtgtggggatggaaccaatgatgttggtgcactaaaacaggtcagttcccactttttttttctcaagttcactatagatttactcaaatatgtgtgcccacaatacatttgttaatcacgtagatgaaactttatctgaactactctggtgttattgatcttgtagagatatttcttactgcatcttttcctttttgtgtgtattatttgtacgtgtcatttggccctcagatataattgtaaccactatatctttactatgcgttatggctatgagttgatggttgctgaaggccccaccctggtcttggcgtttggctatctgtggtacaaatgatatagatgactggataacgtttatgcttacatgctaaaccagccgcacatctgttctagttctagcatcagctgaggtggaaaatttacttttcgctttctttttcatgaagtattaaaaaacaaatccagagactttggatgaagttcttttcccaaaattggtaattggcatgccgagaaatcttagctgggtgaatttttaacctattcaacacaagaatcaagaatcaagcagagcttgcatttggctttaggattagctgtcctggatcattcaattaaataaaacctgaacacctttgtttgtttaaatgggatgggatggtatatagaacctacttttactaacaccatctttagctgatggcttgggaaatacatgtccatgtaataggtgttaggcatgttgacctgtattagcttggtattttcttccattctatcagtggtctgttctgcaagcttaactgtaactgaaaggttacttctaaattgataggcctgaggcatttctatctagtactttcttgtcaggtattattgcttctattgatgctttaaatctatatgaaagagatggggtgcataattacaacaatatttgatgggaacagtttttttgtgatctccaaattttcaggctcatgttggcatagctcttttgaatgctgaacctgtccagaaatcagatacaaaatcccaggcatcaaaatctgaaaataaacaagggaagttgaaaaaaccgaaaccttctcaggaaggatcatcatcacaattgacccaaccagctaacagctccgctagagcatccagtagccgccctttaactgcagctgagaggcagagagaaagactgcagaagatgatggatgaaatgaatgaggaaagtgatggccgttcagctcctattgtgaagcttggggatgcttccatggcttcacctttcacagcaaagcatgcctctgttgcccctacacttgacatcatccgccaggggagaagcaccctagtcactacccttcaaatgttcaagattcttgggctcaactgccttgccactgcatacgttctgagtgtcatgtacttggatggtgtcaagctgggtgatgttcaagctactatcagcggggtcttcactgcagctttcttcctcttcatttcccatgctcgtccccttcaaacactgtctgcagagcggcctcatccaaacatattctgtgcatacgtcttcctttccattcttggtcagtttgccatgcacttgttcttctgatctcagccgtcaatgaagcaaccaagtatatgccagaggagtgcattgagcctgattcagagttccacccaaaccttgtgaacacagtttcatacatggtgaacatgatgatccaggttgcaacctttgcagtaaactacatggggcacccatttaaccagagtataacagagaacaagcccttcaagtatgctctatatgcagcagttgctttcttcacagtgatcacatcagatatgttcagggatctaaatgactacatgaagcttgaacccctgcctgaaggaatgaggggcaaactgatgctttgggctatccttatgttttgtggctgctatggatgggagcggattttgcgatgggcgttcccaggcaagatgccagcatgggagaagcgtcagaaacaggcaattgcaaatcgggagaaaaaacacgaataggatcttgtttttttttccttcacttcaattttttgctccactggcatagtttcaatctaaataggccttaccaaattttgtcagtgccaaattttgataagttttggcatgactaattttggtaaggcaaagttgtgtttggattgaagccaaaataacctaagttcactattgaaatggtctattttcttagatatgccaaaatttggcttcaaaccaaatagatactaaatactattgaaattgcaaaatattggtaagcctaatttaggcctcaaaccaaaccagcccgtagtttaggagaattttgtcggactgtaggccccattactaggagatacatggtcaatatccattctgcttacatgttggatgaagattttaaaattttccatatcttatgctaatgttatagcattgatggttgtacaatgaagctgaattgctacagcagttctctcacggcagaagttatccgaatttactttacattttatcgatttatggattttccacgcctgtggcattttgttttggtggacttaggtagggtggtgaatctgccttgaagcatagcttcgattgagctgataaggtccagcgatttccaaggtgatcgcaaaattggggtaacgtctactagaccaaattgctatttacactaaatctgccgagtagcggtttaaggccttatttagttgggaaaaaaattgttttggggtgtcgccttgtttagttggcaaaaaaaaaaaaaatttaagatgtcacatcggatatatagatatacatttatatcagattacaactacgagataaatttattaagtctaattaatccatcatgttttgtctcacaatttacacgtaatgtgtcaaatattcgatgggatagggtgaaaatttttgttttggaaactaaacagagcctaattccatccagcaaaatcatccatcacacagagaactgataaaaacgatatttcaatccaggcaattgatatttggtaatgtgttacacaaaaaggttccagaattattacgacaagacattttagataaccatagattgccctctagatatcaaaaccacattaagcaacagccgcagaatgttccaatggtagccagcacctcccaaggcaaatcagtacttgtagtccttgacgtgaaggctctcggaggcgccctcgccgaggacagcgtcacccttgtatgtaccgagggtagcctcggagttggccttgcacctggtaaggaaggccgccctggccttctcaatgttctccgccttgccggaccaggccttgagcgtgctctgctggagggcacggccgaagaagaaggacagtgaccacggcttcttggtgctgagcttgttcatggcgttgaggttcagggtcgcctcctcctcgctctgcccaccggacaggaagacgatggcgggcacggcagcggggacggtcctctggagggtgcggacggtgtactcagcgatgacctcgggagacaccttcttggcgtcagagcctggggtgaccatgttgggcttgaggagggtaccctcgaggaggacatggtgctcgttgagggccttgtagcacgcagcgaggaccacctccgagacgtaggcgcagcggtcgatgtcgtgagggccatcaacaaggatctcgggctcgacgatcggcaccagcccgttctcctggcagatgatggcgtagcgagcgaggccctgcgcattcagatcaatggcgagctgcgacggctcgttggggccgatcttgaggacggcgcgccacttggcgaagcgggcaccagcctcgtagtacttggcgcatctcttgccaaggtcatcatggccctgggtggtggtctccttctcggtgccggcaacctcgattgtgcccttgtccaccttgatgcccgggaggacaccaccctccttgaggacatcgacgaagggcttgccatccttggtcttctggtacagggtctcctcgaagaggatcacgccgctgaggtactggagggcgccaggggtgcagaagaggagctcgcggagggagcggcggttctcctcaacgttctcgacgttgatgctggcgaagcgcttgccaatggtgccagtggactcatccgcagcaaggatacccttgccaggagtgccaatgtaggcagcgttcttgatgagctcgtctgcaagatggcaaacactatattattaacaaaaaaaaagcagcatctctgtatggcctaaataatagatctatccaaattgccaggcataaactatgtccaatgctcaactagaccaccgaaaggctgtcacttgaacagatcaatattagatataaaatttctgctaacagaacatgcatgtctagatcaacccaacttatttctgtcccaaataatacacgacttataactaaagaaacactatgcataatttaaatcacttgaacagatcaatatagatagaaaatttctgctaacagaacatgcacgtcatctagatcaaccaacttatttctgtcacagatactacacgacttataagttataactaaagaaacactatgcataaactaaatcaatatggcagaaaatatgttttataatcaatcttttaacacacaagaacaagatctgctccacttatcactaaagaacccttatgtataaactaagccaatatggcatacagtaagtcaactagtaaccaatctttaacctatagacacaacaaaagatttcacgattacgatcacataaataaacgccactccatcgatttactgttcccgaacagatctactaacaaactcaccccgaaaacccaacacaagaactagatctaaacagcacgcaactgaaagcacgaacagatggagagaggagaacgacatggagaagaatgctgatggatggatggatccatacccttgtacttgccgcagtaggccgacatggttgcgggcggagcgaacgagggaggaggctacgacgaatagggagatcgaggagaggaaggaggcggcggctgtggggaatgaggcgagaagggagggggaggggggtggccttttgaaggggggcgatgatgagttgatgacccgatccgatctgtgggcgtccggccgccttgtaggaggggtaagaaaccaacaaatcgggtgccagtgtgcgccgcgagtctgcgacccgtccgatccgtgggaagcccaagaggcggctgctgtgcgcggcggcggccgccacctgtggcgtgggccggggtcctgtcctggtaggtgaggtgcccgcaattttgggccgagatagatttgaccagaatttttttccgttctacattattttttttaatattacagaaataatatatcgaaccaaaaattgcagaaatagcccctaccgcccacctctagggcgacaagctgacgtggcaaacgggggaggaacgggcggtgacagagggagggtttttttttaggaaaacccggcggcaaggggcccgaatgcaaaaaaagccagtcggggccggctattttgcaggcggccccttgccgccctctggccgggcggcaggcctcgttgcctataaaaggcctgctgcccatcccccagccgtcattcttctctcctcaattccagtgaaaaaaaaagaagagaggggaggagaagagaagaaggggcgaagccctgccggattcagacaccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgttcgttacgggccaactggggtagatctgtcagattttattgtatcagaaaggggaattgatagaccggctgagaggagtgtaccttctataaaaggatggttaatgaggggcttcagagttgatccacagacaagtgacataacaatcaatgttatagtaagtcgggcaactgagggtttttattggaaactaatgccagttcaaaactctcgagtgtggagatggtatttggaaaatgcattgcaacgcgggtggcctctagctttggttccgtttgttcacccaaaggatccaggtgtgcagacgaacatggatgatggcgagggaccaagtgctgaagtaaacgagacttctgtgtaggaggtcaacgcacgagaggacgggggcgtagtagctccagtgggcattcaaccaggtggagtggccgacgagggggagactgtcggtgccattgtggatgaaatggagagggacgattctgacaacgagcgtgtagaggaaggtgattcgtcagatgatgagacggatattaatccagcagaatgggctagtgaggatttttctgggttgatcgtctctgaagaggatagtgtgagatgggagtacaaagaaaatgaggttattcagggagcgatttatagtagagcagaagatatgaaataggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctgacaagagtgtgctgcaaagggcgttcttagctctacatgcatgcaagatggcattcgtgaactgttgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgtgagcgataggagagttgcagtttgggagtatggaatgaggataccccggtatttgggaagatgtatagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttnnnnnnnnnnnnnnnnnnnnnnnnnnnnnnnnnnnnnnnnnnnnnnnnnnnnnnn

SEQ ID NO: 22561 - DNA, 5248 bp, Oryza sativa
  unsure (1)..(5248): unsure at all n locations
tccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatggaacatgcaggtattttagggatcggttccaggaagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacaatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactattaggatcagcagcagatggagctcgccctacgggtgaaggcactacctccactcgaccacgtcctaggcgtcgtcgtgccacgtctggctacgtggtgtagtttttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcatgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaatagtgttttactataagttagttgcactataatattttttataatgacatattaatttgttattgcaggctacgtgaggccggcctcctaccgatgtgtcggctggtggaggctgcggccggtgacgcggacccggccagacgatggactgtggacaggtccctcctagcagctttggtcgatcgatggaggccagagacgcacacttttcacttgccgtgcggtgaggtagcccctaccatacaggacgtatcgtacttattggggctaccgctcgcgggagacgctgttgggccagtgaccacggctgtggactggcaggatgatctgacggcacgtttcgcactagtacagcgcgcaccgcacctcccattcgagccgttggcacaccaccgcaacaccggacctacgaaaaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcggacttgctctggctttttggctgggtgatgttctgtggcggtcacgggcacgcggtcgacaagggacttgtgcactacgccaggagcatcgctgacgtcgcggtaggcgaggtgtctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactttgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccacggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccaaccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcatatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaagccgcccacttctcccaggctgcagggtcagcgtctcaggcagctgtgtcgacctcgcactcagcgcagttctggcagtacaccgggacttcgtcacaggcagccggcacgtcgagtcagggtccacccctggaccatgctgggacctcgtcggaccacttgttgccttccaccttcctgtggacatcactgacttcgacttcacttcaggctcgacagaggacgtcatcggcccctcacagctgggaggcgcaccgccggtgcagacgcaagactaggcgcaggccactcctccgcgggacactcgtgctacccgtgctgtgccaccggatcgtttcacctactcccaggaccacgtgcgagcacaggcccggaggaccaagcatggtcgcggcgcggggcagggccagtagagcagtcttctctttgtttacttgcttcactttccagtactgtatgcttgtgtaatgactacattgttgttatatgtgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccactgtcacaccctgaagtttccccctctccttgctttaaaaattggctaaataaatcgtccgaagaaattatcttatttaacctagagctaattccctaattaataaatgcaattaataattgaattcggcgtggtggaatttttcttgagttccccatgctccaatgcattaacaagatttttagtggaattttcagagccttggaaataattttaaccaattaaaaatcaccaaagtgcaattttaatcccaggaaaatccttcccctctttttcttttcttttccttcctttttctctagatgggccgtcggcccatctctctccccgcgctcggcgcccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctacccacgccgcccgccttctccgcccttttcgcgccccactccgcgcccgcgtagacgcccaccttccccacatttnccagcccgtgcgcgcgctcgagagggcgggattcgatttcgaatcccacccctctctctctctccccccaccttttcacgtcgccggcgcaatagggtgggttcccggccacgaccgcctccccctccgcctataaatcgttccccgcgtccttctctcgttttttcctcttttcaccg

SEQ ID NO: 22562 - DNA, 3618 bp, Oryza sativa
  unsure (1)..(3618): unsure at all n locations
nnnnnnnnnnnnnnnnnnnnnnnnnnnnnnnnnnnnnnnnnnnnnnnnnnnnnnntccacctaactccggccggccgctctagccgccgtggtcgctctccctacccctaaccccctctctgttttctcctagcgtgccgccgccgcccgtccgcacctcagcatcgccgggtcaccgccgcctttcatcctccgctttggtcgccgtgctcgccggtgaggctcccctccgctcccttttttttttccctctctcccgtgtgcgccgccgtccttcgcgcgtgcgccgtcgccttcagccgctgccgtcgcttttcgccccgtcctccgtcgcttcccacgccgccgattgccgtcgccggcgaccgtgcgcgtcgccgccggttgccatggccggccggccggttttgaagccgagccgagccgtgcctagccgccgccgtgccgtccgatcggcccctcggccgatccggaccatcggtcccgtggaccggcggtggaccacccgcgtggtcctggtccacggtagaccggccgctttgagccgctgacccgtgggccccgcctgtcggcgccgccccctcccctcgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgagggattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgttggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttacttactttgcttgctttacacctattctttcctcccatgaaccaccaaggagatgtcaatacagagaatggatagacaccagaagggtcctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttt

SEQ ID NO: 22563 - DNA, 6079 bp, Oryza sativa
aaaagtacgaccgcaagctctttatgggcggccaaaattgcaattagccccttgccgccctctgtacgggcggcaagggcctaatcgcaattttggccgacggcggcagacggcgcggtcgacccaccgtctaccacgtcagattgccgcccaccattagggcgacaggggctatttctgcaatttttttggtccatagattatttctgtaaatattaaaaaaaaatctaaaaacgaaaaaagttcgatttgacgacgtgtatgttcggcgaaatctttgggcctgggattgcccttatcaaaatttgcctaaccaaccaaacatctctattactccctccgttttgaaatgtttgacaccgttaactttttaagtacatatttgaccattcgtcttattcaaaaacttttgtgaaatatgtaaaattatatgcctacataaaaatatatttaacaatgaatcaaatgatagaaaaagaattaataattacttaaattttttttaataagacgaacggtcaaacatgtgttaaaaagtcacggcgtcaaacatttcgaaacggagggagtagaacacaactttaacatgaactagctgggtggcccgcgcaattgcgcggctagcaaaaaaatcatatattttttaagtatgattttacttagaattaattaaatagctatctcattgttaagattttgaaaaaccaaaccttatcatcctcatgtttctaattatatagtttttaaaaatttgctatcccttatgtcatctccttttttatttgcttgctcgatctatcactatttctattcattcttcttggaacatttaaaaattggattttctagtttttagagtttattatcacattgggtttcgtttttataatttctagatgtcccgtcaaacattgccattatgctcctctatgcccatccactatctcttctctttattgtcattgagattttaataagtcaaacataattatcgtttgggttcatttttactttctagaagtcccgccaaactgtcagcggttttgccattgtactcctctacggctcgctcgctgcctcccttctttattgtcattgagactttaaaatcggacatgattatcattggttttttttttactttttagaattttcgaaccttcaaaaattagacttgtagtttcattttttataatttttagaagtcctagcaaacgatgccactatgcccctctacagaccgtccgccgcctattctttattatcattgtgattctaaaaatcaaacataactattgttgtaattcattttttattttctagaagtcccgtcaaccatcggcggctttgcaactatactcttatacaccctgcccgctgcttctcctttttattgtcattgagattttaaaatttgaatatgattatcaatgtgttttttttttactttctagaagtcccggcaaccgccttacttgtttgcttcacggcatgcccgacgtccctccttttaatcgtcattaggattctatttggtgttttattaacaatttttatatgacgtatcaaccgccaccaactctactcctttataggcatgttacttaatttatctcgtcacgtgttttagatggtcttttctttcaatagtctttatttttatcaaaaaattagttatttataaattttattcctaattgaaatcttttttttctaatttcagaatttattttttttaaaaaaaattagttaataccgtattgtgttcttttaatgtttttatttttttattttcaacttcagttgtttcaaaattgtattcctacttgaactctcttttaatttttctaattttggatattattatattttttattcaaaattttaattaatctcgtattgggttcttatatagattcttgtttcaatattgcttatttttaattatgaattttagctatttttaaattgtattcctactttgaactcttctttattttcttttgctaatttcggatttatttttatttttattctgatttttaattaatcttatattgggttcttatatggactcttcttttaatatttcttatttttaattccgaatttcagctatttttaaattgtattcctacttggactctcctttccttttctaattttggattttattttattttatttcaaaatttgattaatcttgtatttggttcttatatggaaacttctttcaatattgcttatttttaattcctagtttcagctatttttaaattgtacttctacttggactctccttttcttttctaattttggattttattttatttcgagttttgattaatctcgtattgggttcatacatggaaacttctttcaatatctcttattttaattccgaattttagctaatttaaattgtacttctacttcgactctccttttcttttctttttctttttctccgattaatgtggaaatttctagcccaaacagtgaacatggtgcctcctttcagagctgttttaataatataatagatagatttagctttgcctgtaaacttgtgtcttataagcatagtttgacttcaatccaaatcaatattttcaactatagcatactaaaattttgttggtgctaaaactctaccaaatatttagtttaatccaaatagtccctttaatccacgaactatcgtggttaggtcaaccaaattatctccttaaactaaaataccaaacattttacaacatgaactattcatactagacaaataatcctcttagcattgttttagtcggttttaaattgagcttgcacacatgacatcagtgtggcaatccaaccaacaaagaattttctcttcctatgtccaatcacatccctagtcccctgctctctctctctctctatctctctcatgctggagattggagaaggtggacaatggtggaagatattgatgcaaagctcacggcgatggcgaacttgcgagcctccgcatggcttcagcttggttgggcaacaccatcctcgtcgtagagcgagtggcctccagacctatggtcgcgtgctccactgctctagcttgacagcaaggttagaggagagcctgcaacggagctcaaacttcattggggaggtgttggcggcggagtcaagctctttgtgggaaggatagctgagctcaagctctctaggcattatctcctggagctcgattgggtggaaaaggccgcaggcggcggcggagtcgagctctttgtgcgaagggcagctgagctcgagctctctaggcattatctcctagagctcgatttggtggaaaaggccacaggcggtggcgagcatcagtgcacgtggtggcgaagatgttcgaagagtattttggttgcggagcttggcgagatgtgcagctgcgtccgtgtgagtggtggtggagatgatgcgaccgtcggggtccatatatgagacttgtgcttttatccggatgtgcggcatcttcgttgtctccctcgctatcactgtcatattcccatcctcctcttcctcccccgtgtatcctccctctcccatggagaccagtggccaaacgtggcgtggacgcagcaagcgacggtgcgacgtatggtggtggtcgccaccggggacgagttcctagtgaggacgggattctcgaccccaagttggtttcgagctctacatccatgtgcctccactctgcctcgggttgctgcctcctcgatccgccttgcccaagcggtctccgcctttgccctccttctctagccataggtgtagagagagaagaggggaaactagggatagattggcttaggggcgggtgggtctagagattttttttatttgttaattggattgtcacgtttggcgtcacgtgtgtaagctcgagcaaaaaccacccaaaacaatgctcaaggagtttatttgtccaatattaatagtttatggtgtaaattatctagtattccagaccatgaagtaattcaatcgagcgcaatcgttaacagtaattcttttttgctacgaacaaattcttcacgcaggtgcagtaaagatgagttaagcacaccgtattatagagatttccccgcaaaaaaaatatagagatttattaacataacagcctatccacgtgggtccaactgtcagtgtgtgtgtgtcacgcgttcttctgacttctgactgagtgctgcgcccaccgatccgcccaatttggccccacctcgcagtgaccaggggaagaaaagttcggtcagatcccacgtgtacgcttagcaaattcacaaatcccaacctccccgatacatacgggtctccttcccacgaggccaccagcaaccgaaatcccctcctgacctccttcctcctctctccccgattccccccacccacccaccaagcgcgtcggaagcgatggcgtcggcggcggagatgcagccgctggccccggcgggctaccgccgggcgccggagatgaaggagaaggtggacgcctccgcggtggacctggaggccggcaccggggagacgctgtacccggggatctcgcgcggggagagcgccctccggtgggggttcgtccgcaaggtgtacggcatcctcgccgcgcagctgctcctcaccaccgccgtctccgcgctcaccgtcctccaccccaccctcaacgccacgctctcctcctccccgaccctcgccctcgtgctcgccgtcctccccttcgtccgtacgtgtgccctcctccccatctgatgatgcttcggttgacctctatcttagatttcttgtgcttgatgagaaattgagaatggttttattctgtgatcggtcgtagattcatccgcgtcccgctgattagcagctggtttgatttgtaggctacatagttgaatctagatagatcggtgcgttactatatgccttgctgttggaatcaaaactttggcctctagatctaggatctaattagttcacgaattaatacttagaattagacgtagtaagttctgcatcatggatttgcccactcgcattctgaattgggatgtgaagtaaatgtttgtgttatattataaactaatgctgcaattgcttttcctataaattgtgaatagcatttctatagatcatgttcagcgacgagtttatgacaaactagttaatgcaaacgctgtcggaaaattttgttacaaatgttatgagaccttaaatgatatgattcatatgcattttggtttggccttatttgtttcccttgacatcatatgatgcgtttgtgttagtcaagtgcggagtgtgatgatatgggcatggtggggctgtctttagaagtgtagaactcttctgaacacttgtgtatccagattatttttttttctttcaattctgaaatttctgctttgtgtttgccatagacaagattgttttatcccctagttggatcaagtaggcagcacacataactgtgtaagagatagtcaatgtatttagtccggtatgagttatattttaatagtatatggaaaaatatcaaggaaagtctcaaatcttggatcagtggggctgtttttttttactccctgctttttgttcatgttagtgttgcgagtaactaaacttcttcatctgaattttgagaaaagcctgagtagatgacattgttaattgtttggtaggatggaatggttttggtgctctcagctaattttgtgttatttcttgcagtgatggtcccattgtatcattatcagcacaaacacccacacaactttgtttacctgggtctgttcacgttgtgcttgagtttcagtattggtgtggcatgtgctaacactcaaggttggttttctttcctttgcaagttttagttagtttcttcaactgccaactgtactttttacataacaatcatttgtgtgctgcagggaaaattgtgcttgaggcattaatattgacctcagctgtggttgcctctttgactgcgtatactttctgggcttcaaagaaggggaaagaatttggttatcttggaccaattctgttttctgctctt

SEQ ID NO: 22564 - DNA, 1334 bp, Oryza sativa
ggcagcgacagcacgtcggtgatgatgttgccgacggtgctgacgctcgtggcggtgttcttcgggaactcgctgcaggtgtcgttgaggcagcctgcggataccgcgtcgaggcaggtgatggcgcagccggcgttcttcagaaggcggcagggcttggcaccgcaccgcacgccggcgtacgacgaggacacgtacccggcgtcgcagtccacccagagcatggtgcccgcgaggtccagcacggccttcacgggcacctgcggcgtccgctgccggaacatcgtcacgtactgctgcgtcgcgtcgtccttgctcaccggcagcaccacggagctcggcccgccgcctgccgccgcgcggcacggcgagaccgagacgaacagcaggaggagagcgccggaagccacagcaagaggaggcaagcgtgccatgctgacaagagtcagaaaacgaagaactcgatggggatggagatgtgaacttgtgaagtaatgatgcggcaatcaacgacatttataggcgcaacacgagcgatttgggtctccccgtctcaagtctcaacctcttattacgagttacgataccgcggcgagggttgggcagtacgtagtggcgcgcaacctgcccaccgcggggcgagacaacgaagtggacagggaactctgctgttctggtactagctagctgtatttgacggtctggagatgtgcgatctttggacgcgtccatggcgggccacgcatgcatgcacgcacgcctagatcatctgtactacatgtacggagtacattttcttatggcctgtttagattaatttggtctgataattttttttaaaaaagttttggtggtaaaagatttggcattgaagttttgctagttggtgtttacatgcatggtaaagttttgccattttactagtaaaggcagagagagagagagcacggcttccaacacactttttaccaaaatttgttactctagacttccaaatgacaaatgccaaattacaaacttttgctactagtgttgagatctattttggcaaaaagtgccctaaaacagcaaaacttttgccattttggaggaaataagggttccttttaatcgcaggatcgagaaaacgtaggaatatgaaaaaacataggattttgataggaatatatgggccctttgattcaaaggaaatttacaggaattttagaggattttattcttataggaatttttcctatatggccctttgaatcaaaggaatggattctatggaatcctatgaaattcctatggaatgcctcttcccatgcaagtttttttaggaaattagggcc

SEQ ID NO: 22565 - DNA, 689 bp, Oryza sativa
gtgagggtcaactctaactaagcaactaagttatgttttgcaagcctagggtgatagtggctcaattatatctctaggaaaataaatcacactcctatgtcaatgtttagcaatcctagggtgatatgatctcaagtatgtctctagaaatataaattgcacaaatgtaaatgccacaatcaaatgagacaaggagacaagagatttttcaccgaggttcggaaactcgctggtttcctactccccattgaggcgagcccaactccaccgctcaaccacgaagccaccgcacacccccttcgtcaaggggtggacaaggcgggagccggcccacggagaggactacccaagcctcgatcactagggtagttcttccttcactccaaaggtggtgaactccaaaccactcaaaaatcggcaccaggcctcctccacaatcttctcggagaggtcaccgggcaactcctccacaagccgtctaggaggcggcaacctccaagagtaacaagcaatgacccggcatggagatgatcaatcaagtgccacactagctctacaatggaagcaaatgcacttgactcttggctagaacaacctcaaccactacaatggatgaacactaagctcaaaggtgtgtgagagaggtgcaagggatgtatgcaattgaattgggtgttaagagagtcccc

SEQ ID NO: 22566 - DNA, 1323 bp, Oryza sativa
aacgcccaaatatgataacttatagaataggtgggtgcatggttacttggtcagcaaccttcgtagacttgtgctcctgcatcctactagtagtacaaaattttcttttcttccctcagctaagtttcgtggacttgtattaacagaaagcaaagttccccagcactacgaccaaagctcggatgctcatctaacctggagccatggctgctgggtggatttctctctctcttctcgttgctcttcatccaacccaaactccctactgctagcaacatctctcagctgactgaaaggtacagcaagccagaatctgtttctgctctagccgcagcctgctgctgctgtgcttttctcatcttctgttcctttttgtttcagaaacttttaccttttcttcatagatgaccactcttgaaaaacgagttgctaacaattctcaaaaaaaaaaagaaaaaacgagttgctgacaatatcatttgactgcagtggatcagggcaggttcagagcagggggaaatatgagaaaattgagtcgtccatatacaagaatcaagatcaccacagagaaggggaaaaaaaggaaccaagatctataacaggaaaaaaaacgcgaatattagggaaggatctaatatcaaataattagaagtggtgaggcttcgaacccaggtcatctagcccaccaccttgtggagctagctggaagacccggggcgtttctctataacagggaacatgtaagagatcattgcccatgtttatggcctctgttttcttttgtgcaaagccttttgatatcgtgacttgttttttgtatctcaaaaataatactattattagtgactttcatttgaatttgctccaaatgattgcagacatcaggaagtttactcaacaatatagttgcagtatatgctgctaacagtaaataattcttaggcagtggagcaagtattggcagataccctatttcttggttctcagaaaaggtcgtttttctccctgggagaaggtgccttggtgaaattgggcacagaggtggtggaggcagcatcagttttgacatattctgagcacagcatgaagcaaatcgagagtgaatttacgatcatgagagcatttatcagtcaggttagtgcagagaaagttggtgacaaaacgtttgatgcctggttggatcaggttagagatgttgcccatgatgtcgaagacatcgtcgatgagtatgcttacctcgctgcacaggccattgatacaggtaccttcttcaagaggaagttccagcagaccaagaatgttgcagcctggcagaacatctcc

SEQ ID NO: 22567 - DNA, 586 bp, Oryza sativa
cctaggcagctttcagtatcagattctgcttatctaactgacgacactgaaattgtgggaaatgctagtgtaactagaagattgacacagtgggtactagaggagagacaagatcgatctgtcatgtccatcttcggcatgggtggggtaggcaaaacaactatagcaagcagtatatttaaaaaccaacaatttatgatggcctttgcttgcaatgcttggattactctatcccagagttatgaaattgaagacttgctaaggcaaatcagcaagcaattgatggaccaacaggtgtacttggctagtaatgtcgaggctatgaatcgaataaaattaattgaggaacttcagatctacctaaagcgcaggaaatatctaattgtcttggatgatgtatgggataaagatgtttgattattcttgaattatgcatttgtcagaaacaatcttggaggcagggtactgatcaccactcgcaaaaaggatgttgctttcttagcagatcacaattgtgtagttgagcttgaagctcttccccatactgaagcatggcatctattctgtaagaaggcgttccgtagat

SEQ ID NO: 22568 - DNA, 701 bp, Oryza sativa
ctaagattggcatgtaagaggcagtggaagtggtgcatggccatctccactgatggtgcatatcttcccacactgtaggctggtgattccaggccccgctgaactccttcgcaaagtgcaatgtcttccatctgcagatagagcgcacaatgttcagggaataaacttaaaatatcaacagcaactggcgaaattatcaccgtgcagtctctgctttgtttgtctggcttatgatattgcatgtctacaaaatatagtattgtagcatgcatctatgagatgtcaacatggctgatgtgtataaaagatgtagaagtcagcatataaacatcagacatagagagcaatcatgtttctgccttcagacatggctctaataagacaaaagcatgaagtgcatctgaaagcaacttaatcagggtaatgctgttagaagaccatggaatttacactgatgtagtgctgtgaacctgtagtcacaagtttaaagaatgtgtctgccttaatatgaacttggtcattactgccaacaatagattgaactaccttgcaaccaaacatcagttttatggtaatatacctgtacttgttcgctgtcttttaagctgctctcaataaaattctggtcgtcctgcatattcaatgtggattaagtcattgaccacaattacagcacacagcaacataccaaatcattactt

SEQ ID NO: 22569 - DNA, 11567 bp, Oryza sativa
  unsure (1)..(11567): unsure at all n locations
cattttgttctgcttggacactttcacacctttgaacactaactctttcatatgtctgcaaaaagataaatacgtgctaatcagcaatccacccaaaagagcaaaatagtcataagaaagtagatcagaacagtggtgggaattggtgtcagatgtgaagatcctaaaaagtaataaaaaaaattgaaactgattatttctacacaagaacaatccaacagaacatgatctagtaaaacccatctattcgacaccaagtcaccaatacttaaacaactattactaaaggaaaaagtgaaaaacagtagaaagaaagtgggtttacaaactatacatgtgtttcgtaggattgaagctgtagaccagatgctagggttccatgcgcatatggaacatgatagccaccatccagatagttgtcacaaaagacctgcaagagaaggatccgatgggtataagcatatactgaaaagaagcttattgcatttttcagtttttttgtatcgaaatatcatcatgacagtttatcgataatgcaccttccaattacattcaattatatattctcgcctgcaaatatgaggcaacgaggtgtcaatgccatttctactcagcagatccgaagcactacccagccattcatctccaactgtgttatcagcagtttcttgagagaaaccactatcaaatttggccaatacaaaaggcccccatgtagccactttaataggaatgagaccaaaatcctgtttccagaaagaagcataactgcatgagttctggcagtggaatcaggaagtatagaagatcctcaaaaaagttgggacttacatttttgttgaagttcttgattcctgatatttgtgtggcttttaggaggactccatccagtccatatgtccagccctacaaaatcgtaggactactgtctcaagagagggcagaactataagcaactatgcaagtaataatactattaccaagtcctgtgtctgctgaaataacaaagcagaagctttgtcacccccaataattcaaatagactagttaagtatgcatgcagtgatgcttcttttttattattcctagttcatacttttaagtatccaggtacttaaaaggtgtgagacgaactaccggagcacatgttagagttcaagatgttaatccccaagtcatgtgggcatatacatcattatcgagttagcatttttaagtagtatgtggcttctgtccttcaaaattcaacatttcaagataagttactggttacatttgtttcctcaacactcgatagtggaagcatccaatactgcacaggacaatgaggacataccacctattgaaatgtttcgtaaggaactcacatgataagggcactggaagcaagtcttctgaccacttccacatgcaaggagtgaggcgtgatggcgacacacgttgtgaaaagcatggagttctccatttgcatcccgacatatgacaaattctacatttccaagtctactacatcaacttgttagattatcacaatcatgaatatccaatgtaaatgattttattttacagaaatttgggggtaatgatgactaaagtgttttctgtgcggatggctatatagaaatgtcataagaccgacacctttatgcgtataaaaataaacttcatggtttgcattagccactacaagattctggctacagaaggatgaaatcaccttcctgtgaagtagtcatttgggttcttgacttgccatatgtggcctggaaaacaaccatgaaaggaagcacaaaacaagctttcagtaagaagataaaggtgactatcaacactctttctgaactggccacaaaagttagtgaattatacactgatgatgatgcaatgacagtgaagagaagttactacaaaagcataaacgacaaacggatcagaaagctaatcaaggtgtctccatgaagaactaaacctaggaagttggaactcaacataaaattgaaatgagcaaagctactaatggacaacaattgtacaaggagtctcaaatgcaagtccaccatccagataatccctcttttgaaacacctacacaagtcacaccactgtcaacattaaggatgttggtagcccttgatcctgtttagccatgggccctgaacccctgaactcaccccatttcaagcaagtgagaagcgagctctcaacttccacactcccactcgcagtctcactcacatcacacatattcccctctagacaagtcatccattgatggcatacagctcaagtaaaatccaccattagcgatggtttagaagcgatctccactgccagcgcttgtacaatcgtactaccacacaactagcaaccaaccaatcgtgcggaaactaagaacaaatggaggaggggggttgggagtgtgcgaaatcgggagtatataccaacagcctgccacccgcggaggaagacgcggtcgagctcgagccggagaaagtccgggtcggtgtaccacccgctcggcggcgtcacggcggaggccagcgggaccgccgggtcgaacgccgccacgaggcgccgcgcggcgggctccggcggcgccacggaggaggcggaggcggcgatgcggcgcggcgcggcgcgggtcggccttgggcgggaggctcttgcggcggatgataccgcggccgcggattgcgcgatcgccatcgccggcgccggcgcacgagtcgcgagaggcgtgggaatcggagagaggaggcgagtcacctgctagcgtggcaatgttgtcaaatttggtttatgaatttatgatgttgtcaaatttgatttttaaattcgagttttttttttttagagatggaaatttggtttggctctgttcgatgttcttgttttctcatgtctctccaatccaacctaaggctactaaccattattatgtgtcacttttcaaagataattaaaatatgcaaaatcgtatgttgtctattttatttcaagctttttcaaaaaaatatagagataactaaaatggatacatgcatctcatcgtctacctgttaatatatcagccttagctaaaatttattttttaaccttaaatttagagtatgtttgggggttttcattcatgcgagtgttcgtttggagaggatatggagaagaaatctctcgtttttttgcatgcacgatcccgaatggcttgatggtgtatttttttacaaatattctatagaaaagttgttttagaaaattattttaatttgtttttaaaatttaaaataattaataattaattaattatgtgctaatgactcatcttgttttatgtatgttttcaatcttcttatttccctttctcttaaatgcacaatatagtatatttctatatttttactcataagttattttgtattgctttgttttttttttgagaaatcaatgtctcttaaaattcttaaaatgtccaagtcctttggaacaatctaaattatcgctttagattttgagacttagtaacaatagaatccataaataaactactaagtatgcagaaactaggttcttcgaattctcaccagctaaatactcaatggctaatctttaccaccgaaaccaaaatctttatacggttattccctgtttaactgagcttagaattctaattctaagtggtgaaaagctaacgggcgagaatatgaaatataattttatagtttctggattctaatttagtttttaattacataagtataatttctcaaaatctatataaaagtctggacaaagggttggagatttctatagaaagtagttgataccccgcgctctgttgtgggatatgtgaatgaatttatgtgatatattatataaatgatagatgtatatgtttaaataatgtaaaaatgatgtggagatggttatttgatagtgcttacatgttgagttctaaaagaacagtaaaattataaataatatatcatatttgtatgagatttaagatactctatataataattactagtgggtgatgatgtggcatacttgcgtattaagttttagaagttagtgggtaccaatagtatatagaaagtataagctctctcttaaacatagccttaaactgtttacggtccaaggtgaagcctactcaatttgggaagtctcggttgctccttgggtactcctggtccaagatgcgtaccgtcggcccatcggcccagcaagccacctatttattggtcgggccagtctaagacaaacagaccaaatttacttaaaaaaggggtatgtacacatttacagagttcaaacttcgacaataagatgatgaagtgaatggatgttgccatatgagcaacttcctaaaatgaaaacaagatacaacaaggcgctactctcctaaatatttggaaaccccatattctttccagaccacgacctcctctttaatcaaggtaaagaggatgcccgctgcttgactctgactttggaaaacacgtatatttctcttcttccaaaccatccaatagacaagcagcacaagagtgtagaaagcatgcatccctgtaagctggtctgaaacccttgccgcgccgtgagccaccattctcccaattccattcgcgcttctgcccacagttggaagccgattcatgtccatcccttgatcatcctctagactggaagtgcaagggcaggaaataaagagatgcccagagtcttcgttgctgatcatgcatagcgcgtttgctcagattatcagccgttagacaacgtccaatttatgttgtgttgcttgataatttcactgttcgtcgtctactcttctggcaccaatctgaacatttaattggtgttactatcaaattacgaatctaccgatctgaacaaaaatcatatcacaagttccctccgaaggctgaatcagaaccagtgaatctaccaacagaaaacagtgctacgcgtttagagcagttacaatagcaggctataaaccagctgcaaacatattttaagaagataaataaggagagagaagagcagcgtttgtagcccgctatagcacggactccaagacgcagtgtgtgtataacaggtgggaccatgtattattagtgtagtatataactattgtatgaataagctattagattaattatagttattgaagctagtagttaactatactattaaacttggcccttaccatttcttcacaagttgccgtttctgctgtgccaagcaggtcgcactcctgcctgtgcctgaagggcgaaagaaaaggaagagaaaaacgtcctcaccacaacccgtgccgactgagacttaccgatcgctctcgcgaaccaagacagaataccgagacaattagcagcgttccaacccgtactaacacctccaattaaatcaaatcaatcgctcgcttaataattactaataaataatctgatgactcagcggctgcagcttgagctaaaccgacagtgaacgaaacggataagatcatgtactgctgctgcgctggtccaacgacgtgaccctggtttcgatctcactcattatctctccatctatctcctctccaaagcttatcctctctcgcctcacttttcacaaccctgtctttcccatccctttcgcaaccaaccacattttgaccctcctaattacaccaatttaattaggctgtgtttacacacaacttttcagtcacatcatctccaatttcaaccaaaattcaaactttgcgctgtactaaacacagccttagataattaattaccccctcactcagtcctaaaatataagcatttcatcctaaaatatacttcctcggtccgaaaaacgaatttagaattgaatataacatattctaacactataaggcaccctttgattcaaaggaaattcataggaattttagaggatttctttcctataggaatttttcctatatagccctttgaatcaaaggaatggatcttatggaatcctatgaaattcctatggattgcctaatgccatgcaaattttggaggaattctaacctgaggtaaaacctcttggaaactttcctttaagtctttatctctcctctaattcctgcgtttttcctgcggttcaatcaaacgactattcctgtgtttttcctgtgttttgcaatcacctattttacacttacattcctatcaaaaacctgcgtttttcctattcctatgttttctcattcctgtgattcaaaggggccctaaatctagatatctagtactactttgatttttttataagacagaggaagtaaacatctttggctataaaactagataaatgtatatccagtaataactaaaagttgttatattttaagatgaattagtaattcttttccaaaatcataagaaattctgagtgttttcgcgtcaaatccatgctaattattgagcaaaacctggtcgattagtactaagcgctatactagataagctctccgctgaacctggtcaccgatcacgatcagttgcggcgtccacgtcttgtaaaggcgttttggataagcctccctctgaacgtcctgtccccagtatggccgatgtgtaggtatagtagctagtgtgttcccctgatggccaagaaaagataagatgatgaaatggagattaaattactcctaataaggtacaatatgggcaccaaccagcaggaagaatcagtttggctttgcttctgatctttagcaaaacagaaaaaaaaaaaaagaagtcatcatgctgatgatagtattgttcattcatggatggatgcacacaaggtggttacaagtgtggttgttggtccctaactaggagtacttatatacatgaaacaattgcatatgcattatgcagatgagataagtgcaaagaacagattgggatgactaattgggtcttgattaattcatctctgcatgcctcctgcagctatattgacagaaggttattgctattgaacaaaattgaaggttagcccaatgagatcaaaggcactagctagttaggaattagtaggatacatacatggcatatatatgcaccaagaattaaacattgttcaataggagttctccataagtgtatttggtgcatgatatgatgctctcatctcttggtcaatgcaattatgcaactaattaacagtgagtttgttcataggtaggattggcatgcagctaatataagagaagaagaaatcaagaaacctaagcactaatataaggtatttttgatggttgatttgatgagatgagatcccaaactattacaaaagggatccatccatattatccatctctgcttaattaatttgtcctcactgaatttgattcttttcatcatttcatcctcctcctcctcctcctcgtcgttgtcctcagccattgccgccgccgccgccgccgtcgtcgggcggcggtggatggtggtgcggcggcaggaagggcgggagcgcggtgagggaggtggaggagacgcggcggatggaggagcagcggaggatgcggcggcgcttgttgaatgggttctccggcttggcgaggctcgccgtggttgcgccggcggcggccacgtcctgcaggttggcgaacgacctcgacttgccggagaagaagttggacagccccctcctgcacccatccaccattagcgcgagagatacagctagctaattgaccaattcgatcgaagaaacaatgcttgcttgattgggagcgcgtcgtcgagggcgtcgaggcaggcgagcgcgccaccgccgccgccgccgcacttcgtcttcgtcttcctccgacacgtctcggccgccaccgccgccgacgacgccttgctctccacctcctcctcaccatcatcctgttcatcctcggagtcggcgccaatggaggaccgctcctcctcctcctcctccgccttctcctcgaccgtctccagcacgaacagcccgtgcacgacgtcgccgccgccgccgccgccgccgccatcatcccccactaccccaccagccagatcctccagctgctgcaccacgtccttcctcttcctcgccccaccacccccaccaccaccgccgcacatcccgtacggcgacgacggcggcgccaccgccaccgccgccgccgcagccgccacaacggacatcgcgtcgcccggacgacgccgccgctctcatcaatggcccggccggcggctcacctctcaaacgagactcatggccaccaccaccaccaccaccgatcgatcgagacgtcgtcgacgacggacagatcgacagacagaaggaggcaaggtgatcgccgcggcggtgtatatagccaccacggcgaggggaggaggaagacgacggcgacgcgtggagagggggagacgtgtcgggggcagcgagggcgacgggggcaccagagacacacaggcgagctgcatgcacggcaacacgtacgtttcagctaaccttagctattactattagctttaagcttagcttagctttatctcatctttttgtcatgctatgcttgctagctgcatgcattattggcttattgcccatactctctcaccttacagtactaccttaggttagctgtagcggctgagtgaacagcacgctatagctcacgggctatcttttcgcttgtatttatgcttatagtaaaaattaaaattttcaacttcaaattaaaagttggtcacagggtattctcatcctgatttagttttaagtttacttttagatcgttacgagaaagtacatagaagttttttatttataaattatttattttgcaaatatgttatttttggtttatatttctctaataagctagacgatgggttgttagctgtttccataatcaagaagtatcatcttatctgcaagctaaaatttgctctgtttaatcaattattaaattgatttggcacacacatatgatgaaccagtttagcataactggggtcttatccacatccacaacaaaccatattgatggatactccaaatcaagatggttcgtcttatctgcaagctaaaatttgctctgtttaatcaattattaaattgatttgggacacaggcgatgaaccagttttgcataactggggtcttatccacatccacaacaaaccatattgatagatactccaatagcatatgctctgcctcgtgttaattccatgcttgtaattgtaattactactccccttaatggagtacaagccagtactacattatatcttccccttgatgatttcctaagcatgcagatttactcttgttcacagttacttttagttaacacagagatgcaattatcttcttcttaatttgcacactgccgtgtcattccttggtattaattaagttcttcttgattttgccttttaatttgctatatataaagtgagcccccatttgcaatgtgtgggaagttggcgtgaaatgctgggaacattgccatgcatgcatgcaaaatgatatcctatcttcctataaaattatcccctactaactccttaagcttaacatgtaaagatgccacatcatcatccactactacctccgtcccataaaaattatatttctagctaatttaggacaaaatagtaggattggaaaatgaccacaataaccttatttaataaacgcactgcatgcacacattccatatatacaaatgattaaaaggaagtttgagagaattaacccatataattagcatacttaataaaattacaagcattagcagcccaaattatgtgggatggaaggaaacttatatagatgaatcaattagttgggccccacatggctagaaatacaatttttgtgggacaaaaccttggagctagaaatgcaatttttatgggacggagggagtaacaagatgccacatcatcatccactaacaatcatcacatttaaacatcatacaaatatgctatatctttatagtttttataatttaagagctttttaaatacaaacatgttaaattatcatccaacataatttatataatgttttaatgtatatttttattatgttttatgatatgtcaacttctgttagatatggccggtgataagtaattagcaagcaaattcaccttgactaatggttataaattctgtcgctttcatgatcttcagagataaacgataacacttcgtattttttttgattaatttcattgcaaggcatacgtgtctccaggtaggattcgattcccgtcaattaatttttacccctctgaacatttcaaggcacatagtttcttttaacaagtgactgcattttcgacagagacttcttgtatgctcaattgtttgagttgcatgcttgattaagtgcaaaattagagatcgtgtgtgaattaaaaagttacaaaccgatgatgattaattctgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctaacgatcatatgtgctcatgccccctagagggcctcctgcccaccttatataggatggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacagtagcccctgagaccttcacagtcaaaaagataatcttctcccgaactagattattccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatataaatatgtagcatatgcggtgtaaatccctgaataacatgatccgagtgatataccgactgctttgtaaaacatgatgagtgtaacctaaagttggctacattattgaaaattcacatagcaaaacagctataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22570 - DNA, 2808 bp, Oryza sativa
atgaactgccactcattacaatgttttatgcaaatcggtcaccaggaacaactgcattggtcgggcaaaagattctcctaattaaaaaaaatcctgaccaataactaactaaatattatcttccttagcaacatggtctaccttctctaacatttcatgttcttcctaactaagacaccttaagcacacaataacactcaatgataaatgtaaatgtgacatacacataactagaggaaacaactgaataaacatttgctaattacatgcgttgccaccaaaagtattatcagcatagaataattgttatttcttaaaaacttgaagaagtcattacaaccatgtgatggttgatggggtataccaataacttctgcccatccatcagctgattccaattactatctttccgctattgtttttgtccaagaaaattctagaattccttcagatgacaactacgggaagcaaagataaggagaacgaatctaatttctcaatgccagcaaccaaatccaagaaaagaccctcaggtttattaatagcatcactaaaataaaaggctacaattcaacagaatacaaaattgattagcaagcccagtattatagagaattaacactaaaaacactaaattataattttctaatgaaaagcccaagcatcaactactcctaacaagcgtgatcatgcttcaatgatttcatgttacataggaagcaattcatccatttcgttcctctgaacaagtatcataaattgatgaacatatttcagcaactaaatagtggcaaaagaagatatacaagagaagaaaacaagaatccctcacctttttcctgttaacaatgttaacacaatctaacagtctaccatcaataggacaaaaatgcatagtgttaacatgataacatctacttatgcaaattagcattggaagtgttgtgttccatggagttatcaatgtatatttaagataacatggtatagaattaaaaaaaagaaagaaaaagaaatccactactagagattcaaataaagcctctgagcctttgtttgttgttaacagataaagaatattcccatcagattctccatttgattgtatccaaaagcatatgcttcttatgccttcaaggtgtagctgaatatctgggtggtatagcttacatataactgggaagagtccttttgtggtggcactaactgtaaattgagctggcttgctggtggctaataacagtaacaaggttccggagtatgtagtgctgcagtaaaggatttcaagctgatagcttaactacaggctcacagttctcaaagaatcagtcagatttcaaacatcaaatttggagaattttctgagaagattctctatctgttaacgatgccttacagcatctagcatagaaggcttaatttgcatttcccaatagtagtggcaattagctccagtattgtcgatcgctacatagttacagtacccaggagacaacatcaaagtgcctaacaatcagaaagagtaaacatggtaaaggaataagtacctttgggtaattccaggaccatcattggatgccccaaaccctgaatcggcccaatctgacattgaaatcgaattgtcagaacatattcacaagtatcaagaatctatgttctaaatgaggagtgtaagtgctagctaaagtaaaaaaaaacagccatgcatatactttgtcttcatcccgactagaatgattcgaagcaggaacaaattagaagatagtggtaaaattcttactacaactataacacaccaaacaaatcaaagagctaatagccctaacacccaacatctacagatctgaaatcctgaacctccctgccataaatatttaacatttaggacaagatttggtcaaaatttaaaattacaaccatcaattttgtagtagaaataagtttataaaatctaataactttttatattatgatagtacttttcaaggaaaatctatatacaacattttattttgttttaaaactaagcatttgggaaattacagtcggaattttgaaaattcaaccgaattttgttctaaacgtcaaatatttatgaccgcagggagtacattagcaagtgctaacaaagcaaggttgctaatgtttaccaagtagaacagccccatgctgttcacttgaattcagtaaactcatactgactatggagcaaaggatctgatagttttcactaaactatgttgtagatcatcaaaaccaatctaatttggtggggaactaactacaggcaaataatcaatttccctcataccatttggggttcgctcatgctgtgctactcaaacagcttacttctgagatcgaaacgaaactttgcccgaggagaagaatcctcacctgctgcgcgattttgatacctgccatggtatcggtcatcatcatacccacctctgcctccaccacgctcgtggtcatatccatacctacccaacacatcacccaagcacacgcgatgaaaccgcagagcctcgaagaactaaccaccaatccagtacagatttcgaccaaatgaccaagaagaaacccctcacctcctgtcgccgtacccgtaccgcggcggcgggctcccacggccgccacggcggtcgtacccgtcgtcccgccgcgacctcttgaacggcggcgaaggggatctcctcgacggggagtggcggcggccactccgatacggcggggggctggaactacccccaccccggccaccgcctcctccccggtggtggttgtcaaaatagcgctcggggcgcg

SEQ ID NO: 22571 - DNA, 9338 bp, Oryza sativa
ccataatgaccggaagcatgatttttcatggcttacaacatatgcagaacaacattcaaaccctaaatgatggtaaagaaatggcctaggtacctaacaggttctcatcaagttatagtacagacagttaaactacatggatataatgccggcatgatgttcgcgatcctccacaagacaaacatcgctatactcacgttgatgattcgtggccattgacagtggctggtgcaggaatttcttgctcggtggtaggtgctgcagcacttccattctgtggaggaaaagtagcagaagcttcaaaaattgatttgtttgaaatatcaaggcatattgaagaagctacagagaccggaaaagagaatttgttggttgtaacaggatacagaaacttttaggacattatacttgatgcctgaaatgggccataacttaggctgtttctttcgaggaatcaatcacatatcgagggatgaggtggttatggaccaacacattccattcctcgaaccgaacaaaaaagtgagacttgggagtatctgatggtccattggccatccaattcctcaaaacaaaacaacccctaaaattcttaaatggccacatcattataagccatactgccgtcagaaacaaatgtaaactacagtatattgatgctgaagctagcctcaggctgccagtgcaaataaaggaaaacaagttcatatttaaccggcagtaaacaaaagccacagttataggacagctttcatattttgaataccaaggagagaagaaaataacatgcaaagatgcccaaccgtcagcattaaatcttcccatagctaaaccaattatgtgtcatgattttaagtttacaactatggattgaaagtcaaccagtcacaccagtgaccagtataacaggaaacaatatcagtatatcacactatctaatatcctcaaatttagaatggaatagctagagccacagttttttaatcccctggcaatggaccataacttgatttaccttcataaaagttaagaaaatattgagaagccattgtggaccaatattttgattaatttctccaaaattttcagcaactgcttaaaaatggctacaatcatcagtaagctagataacgaaacaaggattcaactcatctgagccaaagagtcatttcactttcaacttattgtgaaaattagaatcctcaaaaagtatgtaaatagatgtgcagctaatgggggaaaatgacttacaccatcattaactgatgccacaacttgaataggtgtgggaggtgcttttgataggtccctcaacatcccctacaaaaaaaaaaaagagatttgtttttagtagaaaaacagagattccacatttatgaggtaaggtgtcaaaaatttaaagataagatctaagtactttgatcacttgatgtatggattactaaaaacaaacagaaagagaaagcaatgtgaagcatagtttaaaagacccatgctttcagtgtaagtgtataacagaccatttatggatttggattatggattaccaacaatttcctgtgtttgtcaacaaataaagtttaaaactcttattgccaattaacaaaatgctcagctatgaaactttccatgcaccaggaagcacatcagattgttaagactaatattaatgatagtgtgaaacttgttcaagaacagacagaactcactaaatagattacatattcaaacatcagcaccatgcatctaacttcattgcattggattgtatactagaaacttcaacaaaactcatcccaacaacctatactcaaataacaaactgcataccaagttggcatgacaccttgaacttggcattttaaccttcaattgcatatatagatatacatagaaataagtcaagacaagtgtgagtaactggtgctttaaatatgtcacgataatagcttataaagtgcaaattaataatgtaacttaaacaatttcaacaaaaatgatcctagcaaaaaattgctgatagaatcttaatattaagtcggtcttcagttcttagaagttataatattttgctacatctatgatctatcacaaagtttgacttataagttataactcttgagtttctatgctgacttaaatctagctatgcaatggtactactaaacatttataggtaccttgtttgcccacatgaggccacaggcattgcataatgttcttggcccatcaggtccacgacgcatcataggtgtagcctttgcatttataccacagtgatggcatctgaaaaaaaaatagcaatcaccaaaatttataaatgatgtttcatatgcttagagaaaccacaatgataaaaaggtagtaataacctggcatacaccatacaaaaaagaagcatatttgcatgtatgataagtataacaaagatatctatatcaaacttacatgcaaattgttcaactaaagttagccaagtaaaaaatgggattgatccacagttcatagcatctatacaatgcaatacactagagcacacgattccaagcatggattgattgtcaacaccttgctaataaatatgtaaaggatgtttcacacatcaagaaatattgctggaaaagtcataaaccaagaaccaaaaaaaatgggatttttctctacttactcagcagcagagggaggccgaccttccactgatccccagtttggggagccatctgaagctgtcaattccgatgttgcttcatcaccctttggttttgaagatgtaaactgacctctattgcgctgcatcctacacatacatagaaaatattttaaactatgaagatttcctgtacataatctaagcagaggtaatttagaaaacatgaataacagcaaaatataaatcctactatctgccacggtaatatcaaaactgaaagtaaccacaagaaagacactgatacttaaaaaggtactacctccgtttcatattataagtcgctttgacactgatactttgatctttaagtttgactaagtttatataaaaatatagcaatattttcaacacaaaacaaacttattatcaaaatattgtaaatgttagttctaacaaaactaatttggtgttgtacatgttgctaaatttgtctataaacttggttaaacttgaagaagtttgactacgaaaaaagtcagaacgacttacaatatgaaacagagggagaatagcttaataaaagcagccagacaactcaaaactaaaacacgcttttggtacaaatacaatgtataagttgccaagtttagattatattattcagttcacttccactatattaagtacattgttagcagagtgtattactcacagatcaaatacagcacgcttgactcttcctaattcaggtcaatcagcattcaaataggaacaaaattctatagcatttcagtacgtataaacatccacagccaatgctaagctagcaccaacctaagtgcaacttccttccgaacagaataccggatcttcttatcaaagttgcgctccttccgcttttctctgaaccgcatcaaagatgccacccggtgtggaaaattcaacctctgaaaccaagggaaaaaaaatacacaatgaactccagagtgcacaatcctgtcaaacataatgaactgatactacaaagaaagacagttcaccatcacccgtgccaaccttactgtatggcgcagatgacgatgctccagagcccaaacctgggttcagctcccttccaccgagtagcaagagcactgcttgaacctgcgagaagtaatcgaacactcagcctttttttttttgcaacatcaatcccagtctataccgaaacacacatgacaaacaaacaaggccaagcgcatgagaggcaaacgaccttgtcaggggagacagagtcgaagacgtagacctcgccctggaacgagagggtgagttggttggacgccatgggctggacagcgccggaggcggcgagcatcccgccgtgcgggtccagctgcgcggcggcctccgcgtccatcgggacagccacctcgccgcccaccccctcatgatgttgcgcgtcctcatcctcctccatctcctcctcctcctcctccaactcatcctcctcctcctcatactcctcctccgcccccagggcgcggtgctcctcctcgaagcgggccatcgcctcggcctcggcggccaccgcggcgaggtggtcgaccgtgggcgcgacgtgcgccgccgcatcgtccgccggggccggaggaggggggcgctcggggccccggcgtggctggtagggcttgctgccgtcgtggtgggacatggcggaggttgggggtttgggtgggatcggatcggacgatggggatgcggggtgggtagaggtggccaaacgggcggcccggcccggcacggcacgggcacgggtccggcacggcccgtttcggcacggcccgttaggcatggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgctgtgccggcacggcccgttactgtagcaggccgtgccgggccgtgccggctacaggttccgccgtgcctcgggccgcccgttttggcccggcccgtttggccacctctaggggtgggagagaaccctagcccctaggatttcgatctcctgctttccggtttggagggtggaaatggacacgaggagggagacgggtgacggcctgacgggtgaggggagagcgtaggactataggagggtgatgtggcagcatcacagccgtctgatctgctaccccctgtatatctatccctctgttttcaatctccttacactttcagaccaaaagcgaattatgatattgcttctcgtaaatcgttataaatatactaacgttttaagcttgtggtatgaagtagggtttaacttttcaatttcgaagtaaaaatcgattctcaccggtgtaccgaaatccaaccaaaatttggtaaaaaccgacgactttcggttagcgtcatacgaaaaccggctaatatcacccggttttcagcaatcttaaaaatttacaggattaagagtaaattgataaatataactgacaaaaataaaagaaaaaaaacaacagggtcagtaatttccataagacaatcatagcatccataacaacaagctgaacagattcgcaagaaaaaaaaacctaatgaaagaaccaactttttccgctgaaatgttcagccctatgaaagatttttcagtcaactttcagctcatgttgatgcaaaccatcttctcatgttgctgtaacaagaaaaattaaagatcaccgtgacggcatgacccacgaaaaactaaggggttgtttgactcatatactaacattgcatagggttgtcatagttttcttgccaagtttgtctaaggttaggccaacaaatttggcacgacacttcggctagtaatccacaaccttgctacattttcctgagacaatgacgcgtgggaccaaagtgctagaaaaaaaatctagccacaagtgtggcaatgaaccaaatgcatgactaacttattcaaaaagcttccttaagttgaggtgtggcaatatttggtcatgaaccaaacaacccctaaagacctatgaaagattttccgttcaacttttcacggttcaaacaactatgttgctgcgaagtgcaaaccatctcctttccatgcaaaaaagaggactttagagtcactgatacgttggtccatagcaaagaaaactcacatgtcagtgacttaggtgacttaatttgaacacgaaatgcatgctgcctccccagggccagagccgaacaagcatcatatagtagaaaacttaaaagaagaaaaaaataaatcatctgccataattacgaaaattaagtcattcaacgccaacaaattgtcgagacgaccattcagaagagttgaattgtccgcactttaaaattcagacgagaaaaggcaacatatatgtaaacaccgtactagaatttttttttcggttttgttctcccagttttgagtcagtcatttgaaattttagatctcaattgctgtacacaacgataaaagcaacacaagaatcatactagttgatcaggacttgaagatgaagatgaaggactgaggagtgaggactactctcgccgcatccaccgcgttgatctctctccagataagatgctctccggccggtgaggggacctccaccgcacatctcctcccagcctccaactcatccccgcgcaaactggatgtgggcactgggcagtgcctctagatctgcaagggcggctccaggaaggggatctggcggtggtcgttgggcacctcctcctggtctccaccacatccgtggcagcgtcttggggcgatgccttactacttcttcgtcagcgccgataccccttcccggcctcgtacgtgcaaccaggttggtggaggcagccgatggcactagggaagaaggtcaatagagggcatcatcgttgacacattgtagctcccatatcattgtggccttctgggtgggtgtcagcgggtggtgtggcgcgcgtggatgactggtgacagcggttgctgacgaaggaatggggttcggctgaacagggatttcgatcgaccgggagtgggggaacgctactagtgccaatgcgaatgaaaatgccgcctgggaataacattaaaaaaattacaaatatacctttttttgaatttataccgcaaaaatcaagtggaacatcaaatcaatatatattgttatatcgtttatactgctaatatatactagtacttgctatatggtgtatttctcgtaaaaagttatcgtcattcaaactttaaagaacgacgcacattgatgtcaactttcaccccatatcatggatgttccctggaaggaaaaattcaatagggattggatcgaccattcattcgacctggaaggctggaacacatgaagccattccagtagaaaaattaactctccaaatcttccatctgagcaaccagtactccactcagacacattgtgtgtgttcagtatgggtaagcccattctatcatgaggatacaacaaggcccaataaagggataggcatatactatagcaatgcacttcacagagtgcgcctcaaattgtttggtccgtcatgactagcagtggcagtaagcggcgacgtgatgtactagtggctgacggcgccggtaccagtgccagagaagatgagtaggggaatgcgagagaaggatgcgagagaagggaatgtgagagaaatgagttgtgcgctgtgttgctcagccaggagagaagggaatgcgagagaaaacgagttgtgcgctgtgttgctcagccaggagagaagggaatgcgagagaagatgagttgtgcactgtgttgctgtcacgctcagaaattcccgagtagaattccaagcagaatgtgcattaaaatccccgtccaggaccggccggggtacacaaacgacaatgttgacattcagatccatgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatactcgagctctggggttgggaaaaaatagagcaagactgagtactacccactgtactcagcaagtcataccggaataggggtatgatgcagggaattatcaaagaagagctggagtggttcatttgcataaagcgagcatttataaacagaagttgaaagatttaaacagttgtaataattaatcaatattaactatccactgtccaacgctatcccacgttgcaacaggcccaaccatccacctaaactatccaatttcaaaagattacactagggtaagattaatcacggtgaatctggttgaccgcccataaccgcgggcacgactattcgaatatttttactctgatcagaggtgtacaactgtacccacaagacacagccccacgacacgtttccgtgcgccgacatgccaccacgacataccggaaagaggccatgacaggacccttcgcataaccccctctaaccaagcacaccacacctcaggtttcacccccactcctcgcaaagcagcgggcagtcccctctcatgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcgaaaccatgcacccacagcccaccatgtgatttattttaattaactaacaccaaagcggtggcactaatccaacaaaaccattagaaccaacagtctaaacattaataggattttccccattgtgaactagttgaactaagcatggctaagcaatccctagcccaatctctagtcatgttatgaccccaagttgacaaagggacatggtacaacaatagcatggttatgacaataggtaaacaccccatagtaacattataaaacaatgcaatatttgaaggaaaacaatagagcatttgcaatataggatcaacatgttcaagtgacaagcatgacttgccttgctctgctgctggaggaacctcggcgactatttcgaagtacaccggagcgttttgaggaaacggaatctagcgacatacaaggcaaacaatgcaaacaggctataagactactgaaacagggaacaaaaccatttttaatggattctacatatttttcttgatttactgagacttgaatgggcttaaac

SEQ ID NO: 22572 - DNA, 4324 bp, Oryza sativa
cggcggcggcacgcgcgcgtcgcgttgccggcgacggcatccggcggtggaggcgacggcgcaaaagcgacgcgaaagcggcggcagcggacggcggcaacgaccgaaggcgacggcgagcgcgagcggcggcgacgcacggggaattggggaagaaaaggaaaggggagggagtcctcaccggaggggacggcggcgtccggcgacgaggagcgacggagggaggtcgacatgcggcggacggcgaccgggacgacctaaagaacgaaaagaaagaggttagagaggaagagaggggccataggagacgggaatgccggccgaaagcggcggacatggcgaccctcaccaacgcacgatgggaatggcgctccggcgacgaacctcgacgaaggaggggtggacggggtggatctcggccacgcgaacccgacggcggcgacggcgcggtgcggcggcgagcctagcggcggctaacggcggccggagtagcggagacggcggcggcgggtggttgcacggcgcgggagcgatggggagcacgagggagttcggcgaaatgggaaaaaagcgagagggagcgacggagaagcttaaataggggaggggagggccggacgtggccgggagaggcgggacttcgctggccaacgtgggaagtgggggaggagagagaggcgggattcgaaaatcgaatcccggccatctcgggcgcgggcgcgagcgggtgagagaggggagtgggcgcggggaacgcggcgcacgcgcgggcgtggtcgacgtggcccgaaggaggcggagacgtgggcgcggcggcggttgcgggcgcggcgggaggttggggaaggacccgacaggtgggccccacctgtcggcgaccccgggagaggagggcggcggggcggcctggctgggcctcggcctgcggccggcccagcagggaggagggggaggaaaggagagaatgggccggcggcccattcggaaaaggaagggaaaaagaaaaagaaaaaggagaaaagaattttccctggaattaaaatattgcttgctcaattttaattggttaaaattatttcgagcgctctgaaaattccactaaaaatcctgttagtgaatttcgacatgtagaactcaagaaaaattccacatgcccactccgattattatttgcattgatttaacagggtttactcttgctttgcaccggtattttcttagggtctcttataaattaaattttaggcttgggaggagaacttcggggtgtgacagttgctcagcctgagcttggggtttatatagcatgccagctcgtgaggtagatggacgaggtgtcaggtgtggggtagtggctgaggcgtggacccgatctcagccattgttccattggtgtactttgttgttaacggagagatgatgggtgtccagaagattattacagtagaagtataatagatttaatctaatcttccattcaaaacattgcaataaagcaaaggagaacgttaatcgttcttcattcatggtaagtcattcataaatcatacgtacattacaccaccacaactacattagtagaagtacataatccatacatcattcgtacattacaccaccgcaagtacattagtagaagtacaccacaagtacattagaccccacacgtcacatactccataccgctcccgaagtacacacacttctaatctctttacattcttcattcccgaagtacccacccctctaatttgagtagactacagtcctatacaaataataatatataaaaatacagaatgctccacagaaaacatatgaaacataaacagaaatcctaattcccacacccaaacacgcaaaaatagatgctttaatttctatcaagtaataaaaggtaaatgcagctaaaacagttgatgctaatgaagttgcgactgctacgaacattagcaccctaagcttcaccctcgtaagcagaggagagccgacagctctccatcagctttgagatgaaagcggacaaagcaaatcaataaaccacaaataaacattgtaagcaccaaaaagtgctcaagaaacggtattttttgaaaccgagagtttccacgcactggctttgctgccctcctacggaggtctgctgcagcggtacgacccctgtgccaagaaggaaaagaccgagctacaccaaaaggatctgaaacagctcggtaactacatgttcaaaggtggtcgccatgggagcaaagagtgaaagagagatggaacgagcaagaaacacgcaagaagatgaaatctgcaatgccaagagtgaaagagagatgaaacatgtgatgatgcttgtgagagagactggcttgcttgtgaggcagtggtaggcataaggacgggaagagatgtgatgaggcagcatttaaatagctacagcgacaggcataaggaggggaagagatgtgatgaggcagcaacaggcatgaggaggtaggtagggtttctcaaaccgtcgggccagggttaccgcaccccagtggtaagcacggttaccacgcggtaaccgtggcaagccgtaccaaaccatataaaatttataacaagtagagatggcggccacgggcgtagggcggaggccaaggacggacctagagtatactcaatggggggccttggcccctactcaattctagatagcacggggggcaaatgcccccctatcatatttttatttacttattctaactaggagtagactatcggccccactcattttgcttcctgcattcctccctggtggaggcgagagctcctcgtcggcgcgatgcactgcctttacgtgttgagctggggcggcctcggcctcgactacgaggggctagtgagggtgatccctacaatggaggtgacggtgattccgttctgtcgaacggcgtggacacggtggcatggtgcattcgtgtgacttaaaccattgtgttatattcggccataagtgaagtttacttaccatgacggtaagtggggatgtgtacatgcctgtgccaataaggatgatgatgatcccaattatcatggcacggattttgtgggtgtgggagagggagaggacgagcgcaacgagtacaccgacgaaggcaacaatgtcgacgaggaggaggatgaggcggcaacagacgtggcgagaaagagggagatgtaggcgagctgagttaccatgccaggggcgctaatgatgatgggcatgttgtgcggttgcacgccagcctgcacgatcatgtacataggttgaagtgaaatgaatcgaatatttatatacacacatgaattttgattcttacactggggacaagtaccgaacgagggccactacattacctgcaagatgagatcgatcgaggaaaaagatcaacacaaagttaatgaaacgcgggatttgaagaaagctaaaattaagatgccgatgaggcgatgacgcacctaggacgccgaggaccgtgttggcggtgttcggcgagatcatagtcgcgtggacggccggcggttgcctgtctatgccaggcaagaccgaggggaatgcgagagagaagactagtagaatgtacgctgtgttatttgatttgagtgctatttataacatagagctggtttgttttgtgacttaaattgaacttaccaatttttgtcaatatcaaattttgctaagttttggtatggttaatcttggcaaggtaaagttgtgttcggattgaagccaaaacaacccaatttcactattaaaatagcctatttctttagacatgtcaaaatttggcttcaaactaaatagacactaaacactattgaaattgttaaatattggcaaagccaattcaggccacaaaccaaaccagcccataataacacctctttgctcaaccaagggttgtcagcctaagagctacatgccacgtaacatatataacactgatcgagtttattaccatctacttctactgcacgcaacagcgaggggtgtatatatccagttcgcgattagagaaggatagggcggagtcagctgtagggccccactcgtcagttgcagcacatgaagcttcatgtgtcgtagatagaggtgactaccacatccaattttatgcatgacataaataattaaatgcacacaatccctaatatctctaacactctcacatgtatattgaagtttgtgtaggggttgcctcttgcataagaggtgactatttctctctcatctttcttctctcctccacctcattatttagtcctatgtttcatcttgtggcttgtgcttggatgccatattact

SEQ ID NO: 22573 - DNA, 8975 bp, Oryza sativa
gttggctatactattaaacttagctcttagcccttaggtgtcgtaaatctgaaattgtactatgattttttattaaaaaaaaggagcaaaaacgacttatagatattttgcttcctttttaatcggattctggaatcattgacaagcatacatttttctctggaccgcatcatagatgccacccagaccacccggtgtggaacagatcaagtcttttttttttcttttcttttacatcgtgagcacacacagccggggaactattctaatctctcgaggggatattccctcgtttgcttaaaaatcatctaaacggttatgaaaaattctaaaaaaatttgacaacattcatacaacacatatatacaactccataaaattttaagtcgaaactcaatttacacgttgagatataaaaaagacaaattcaacgtatgaatagtagcgtattgtttatatctaaatttgtccttttttttctcgatgtgtagattgaatttgaacatgaattttggtggactagtaggtatcattatactctccattgacatttttttcagatttttttcacaactatttgcatcgaatttggaagggaaaaaaaatataagaggataccctcgagggattagaatccactccccacgcagtcttgtctggtttgatagtggaggaaaccgatggagatggagtagaaactcagggaagaggcaacatgccctggccgtggccgcggccggcggcgacgcgagaggtaacataacatggccgtgggcattattccactcttatatctagtgaaataacccaacgttcccagcctagaagatgaaggacattgtggtatccaagtccgggccaccggtgctcgtcaccccgtcgtcggagccgacaccggcggcggcgaccatccgcctcacctccgccgacaagtcccgcctcggactgtcattcacggcgttcctcgtcttcgagcggcggcggcggcggagtcgtgtccaccgcccggccgagaccgtacgacgggcactgtcacgtgctctcgttcactactaccccttagccggccacgtcgtcgccgccggcgacgacgacaacgtcgtgttgtcgtgcaccggcgagggcgggggcctgccgttcgtcgcggcgacggcgagctgcacgctggaggacgtcgacgacggcgacggcgacttgccgttggccgaccttgctatctggtatggtggggagtcatgctggatgtccgatccgctgttgatgatgcaggtgaccgagtttgagtgcggcgggttcgtcgtcggggtgacatggaaccatggcgtggctgacacctacgggttggcgcagtttctgcgagccgtcggcgagctcgcctgtgggctcccgtcgccgtccgtcattccggtcaggtacagggttggaacattcccctccgatacgatattacttcagtcgatttttttatttttttataattttttgtcatatttatttaaattcaactaaatgttgttcaataaattttcgaaatttcgggatttcagtaacctccgacacgatcggcctaaccgataaagtgaaccctggcctggtcaggtacgatgagtccatgcctgaaatccccgaccagctggctcccgtcgcactgaaggcgccgcttgccgactagaagcacgtcgacttcgcctactgcgacattatgatcccatggagcttcgtcaaccgtgtcaaggccgagttcgtgagccggaacggtggcggcggcggccggcggcgctgctccgtgttcgacgtggtcaccgccgcgatatggcagtgccgcacccgcgcgatccacggccgccgctgccgcagtgacgctcccgcggtgctcttgttcgcggtcaacgcacggccgcacatcggagccaaggacgggtactacggcaactgcatcacgcggcaggtggtggcgtccacggcggacgcggtggcgtacggcgacatcgtcgacgtggtgaagctcgtcaacgacgccaaggagcggataccggaggaactcctccggaacaagctgagagggaagcagggcgtcgacggcggcggcggcgaggggctcttcgtcggcccgatgcaccgcctgtacgtgtcgagctgggcgggcctcggcctcgacggtatcgacttcggcggcgggaagccagccagggtgataccccgcatggaggtgacggtgatgccgtcctgcttgccatgcctaccgtgctcgaggtcgaacggcagcgacggcgtgaacgcggtggcgtggtgcgtgacggacgaacacgtcgacgtgttccgggctgagttggcaaagctgcagtgaacttggataccacaagccaggaacaattcgagattttctgagttggcaaggctgcctgttcttttctgatttcagaattttcatttgcacatttcacaagctcctaaacagtgtgtttcactttcatataaaaagttatgagaaaagtatgttagaatactttttttaatataatttttcaacattgtactagttaattcattcgttcatactcacaaatgactaactataaagctagtccatcaatcattatttcaactatctcaaaaatgacccaaagcgaatgtattcaaattcacgatgttgaaaataaatactatctactagtcataaatattgtacgcttaggataagaatttatcaaaatttaaaactatggccatcaatacgttttttctcaaatatgaccatcaattttgtattagagtgagtttataaaatctagtatatcatgacaacacttctctagacaaatctatgcaaaacattctttttccttctacttaactagtaaatatttaagaaagtattggtagtcaaatatttataacaagaggggtgtaggtatctgtgagctcactgaataaacgacgaaatatatacacattttcagggatgaatatagtaaaacacaaggtttattcatatacaacttcatgaaaatgggagaaaaaagtggccatttggtagaactcatgggccgatacgtcattagctttgtggtatacaacaaaaatcgaacatcatacaatatcaccaaatgtgaaacatgtgcatggcaaaatcagttgccaataatcaatctactcgcctacaagaatgaaggggttgtactacatgcagaatgttacaacatgttgtgttcacagatgcacatacattatacatagtggtcataatcatatgctgctgtgtctccaaagaacctgctcatcaattttagttagtttttcatcatctaacagcttccaggtgtggatcgactcgacttccaccaatgatttctgccctttcttgagttcagtatgaattacccgagctcttcttggccaatgaggtcttccataggcatgataaccaaagccaccaccataacagaaccatatcccattaaggtcgccacaaaaatcattaagatggtcatggccaagaaagacagctttcacatctcccatggaggttagggtgccaagaacaccggagtttacagttgagcaagccaccccttcctgatactggcccttgaaacctgtataccacagccctctgacttctggaattgggatgtgaaagaatgcaaatgcaggagcatgcaagttttgctgtcaaaagtaccgtgagtcagaactcagaagcatagattcaaaagtactgtatttgtaattcgaaaaaaaacactgatatatgaaaaccaataatctgagattaactaatgggtgtgtgttttgctcaggcaaatgataaaatatttgaccagagaatgcagctcaatgcagatttacatgtacatcataagtttgtaaaagaagaaacacagaagtaatgaacaaaggcattttccccctttcacaatgacggagatatattccaataaaatcttgggtgctgtgattatgctagtaattatcatcagcggtacctgaagctcctgtgaggtagcacgaagccaagcaagttgagattctttgatccatccataggtttttactccattgaccacttcacgatcaccactatccaggaagtaaaggttaagtaaactagtattgacaaactcagaaccaaacggcccatgtatgctgacatgatagttgccaaacccatgtaccaaagaaccaggagggtttacttgagataccgagtaatccatcagggacatgaacaccatcagttcctctctggtcatagtggactcctggtcatgatttcctaaaatggcagcccatggtactttatactcgattgcagggctaattgctttgagtagtgactcagctgcatcagatgcactgcccccaaatatattgtctcctgattaaaaacaacacaagcattcaatgcaaaccagattgaccccctttttgttggtgaaggaaatttaaaaaaacacgtaacgtagagattcaaaaaggtaacctctttacccccagaagaagagatgtagtcaaacttttttggaaactgcatgtgattctactctgccactaattcagtaacagcagaaaacccaaagcatggattcacagaactttgctagttgctaagtaatttcatttgggtcgtgaaaatacacgagtggattgccggagatacttctccacaattgcgaacataggcaaacaacaagtgatttggcgagatattccacccaacccctctgaatgtaaacacaattattcagacattctgccagctaactctactaagctactactacatggagcattaactaatttgtttttgttgtgagtaactgttatgttgcttgtaaattaacactcacatttagtactagttccatgactttgagagtgaaaaaaaaaatcaaccaatcacatatcaatagcactaagttttgcacatgattagcaaggaccgccactaatgggcagcgaccagatgagcaagcgcgaagcagatcgccaccaagagcggagcggggataggagggggaaaaacgcaccggtgaaggcgatgaggtcgggcctctcggcctcgatgacccgccgcaggaaccgcgtggtgttgaggtcggagcagcgcgcgccgcccacctccggcgccacgtcccggcaccgcgtggcggcgccgttgccgaagtgcatgtccgccacctatagcatagcaaacacacgcacagaacagaagccgcgcccggtgagcaaccagaggtaaatctcgaaggccatcaggcgaagctcgctgagctagctagctagcgagtggaggtgagcttgaagcgacggacggacctggaggatcttgaaggcgccgtcatggcggaagcggagggggaagggaggggtcctcttgaagcggggcgcggcggcggtcgggtcagggttgaggtgggtggagaggcggatgaggagcaaggagaggaggcaggggaggaggagggagacgagggaggtggaagacgaagaacccatcgatctcgccggtcgccgcctgccacctcccaccgcatcgcatcgcactactcaacaactcccctactgttgctcatagttttttttttttttcagaaactttcggctgtgtcctttcctccgcctttccaacttccacaaatttttgacaatttaacccttttcgaaaactaattttacaaataaatcgtgcccaaacttatttaaaaaatgacgcttttgttcagcgtcaaatcgtatggcgctgaaattagacacctcaacgccaaatagaacgacgctgaatgcacgttggcacgccgactcagtctctcgtccgcggtgacacgatattctgcgccaattgacgtagcactgaggtgtctaagtttagcgacatacgatttgacgctaaacaaaaagtgtcatttttaaaataagttttggccacgattcatttgtaaaattagtttttggaaagagtcaaattgtcaaaatttgtgttccaactcttgtgtccacatttttaaaacaaaattatagtaaagtttatttttaaaatacatattaatctattttttaaaattgctacagctgacatttaattaatcatatgttccttttagtccgcagagatttagttttcgacctgatttgccgtacactgccagaaatttcgtgagagagcttgatttcgaaaataatcattgctttccgaatagtcttgtcttaaaagaaagagctttttttttacttggttgaattagctacagccttatagttggtccattgggccctgcagagatggaaattgtgcctagttgatgtgggacttgggcccatcgtgcttagtgccaaaacgggccaggatttttataccgtgtgggccgacgtgacttgggccggcccgataaagtacagcccaagtcccaggtctacctagtgttctactagatgaataggaaatacagtagtgcagtgcaccaacctctgaggcctcactgagttggcgcgtaacctcgtcgcgccagctcagcttttggtctacgtggagcatgcgcctgggacctcacttggcgacttgtccctaagctaaggagcgcgaaacttcgtcgaagcgaggaagcgcgcggcgccgaaaaagcaaggcgcgtgcactgtgggcatcgttcctggccgagctctgccctcacatcgatttcgcctggtgaaatccccgaaccgccctcctgggggcggcgggcttggcgcgggaggctgggtcggggtgccgacgacgagccggtggctgccggggaggggcctagaacacttccagttgcttcaacacaaatacaaatcaaaatcaaaatcaaatcagaaccatgcaaacaaatcgaagaacacaaatagatcaaaaaacaaagagagagagagaatattatgttttttctgtgtacattcagctgtggcaaagcgtctctccgatggcgttgagtgtgacgcgggcggcggccgcgccatgacgccggtgccagtgccgctgtggtggtggcgatgaagaccatgacggcgcaagggagtgaatggatggatttgcaacgcaaccaaaccatggcccttcaccatcgccgcgacggagtgggaaagggagaggggaggggcggcagacagagagggaggggaaggaggcgcggcgagggagaagaagcagagcggcggccgtggatggagcagctgctcgagtccgcctccgccgagtcttcgccgcgcgctgccaagaaccgccagccgcccacacgatggtgagtcgttgccaagaatgccgcagaccgtgccgccaaagaccgcgccgcggaagccgccgccgccgaccgccgtagaccgccccatctcctgctgctgctgcttgggaggagaggagaaggaggcgcggcggtgtgggaggcgaggaggcgcgggagaagcagagcggcggcgcggcaggagaggtaggccacggtgatggagtggaggagaagacgagtcgctaggtggaagggtaggtggggaataaatttcgtcagtgggcttgaggtaacgtatttggggtaacaggcactgtgggcttcgtttccttcacctgtctccatccaattaagccacacatatatggatgcttacactgtggggtgagtgtcttggggtaaattttttaggctaggggtacgagccccgtagcttacactgtgagaggcctgaaaaagaaaaggggaagtagcagtggagtggtgcctgcggcctgcctgtagctgaaagcgaaccccatttctcgtgccttttttcttctgacgaggggagctgaaaagaaaacttttttgctgtggcaagtaggagtagtactaggctactagccaagtaagattattaaattttaagtacttttatagaattattgtaggaactgaatcattagattttttttttccattgtatgtattgttcgttttatagaaatggacactaccaatttcctgaggattgtagtcttgcaaatttatttcatagattcttaggataagatgagagctcttggaaaaatttctgaaggatggagtgtaggtgacatcttaatcctttacgttttctgttcctttgatttgagaatcataagccctatgaatatttgctgatgatttcaaagtttagattgaattttcggtagtactacggatcgaattaattaattaggccctgaaaaaactggccattcagagggtgtagtggctcggacatggagtcagcaagacgtcagctgtgtgcccattcactggcatgatactggcacatgtatggcgtgacagaaagagctgaaaaaatatgttctttttttgacatggaaagagctgggaagctagctgtggctgatgtggtgagtgccggctgacagagacaacaaccgcatttgcattaccgcaatctttaacacgactggggcctcgttttgggatctaaagaatactacatatattcagaggattttgtttttgcacaagccaacgaaaggaaaaaacaaaagagatctacggagacaacagcatcaatgcctttccatcttcattttcatacgatctactcactgtctcaaaataaatggacagtgtcatatttcacacctaagtttgtttattttgatcgttgtagcttcatgggcaatgacatcactagtatgtaggatccccattgaatgccctaataagtcgaagccaaagcaaaatttaaattgtaaatttaattttgatgtcgattttaaggtactttcagagtagtttatttcagcgttgccttttaaatcactaaaacacatatataaatgttttacttataaattattttttattccttgataaatttgttagatagatctctctccccttgagcccaacggctcaagggggccttgaccgcgccctgatcgggggcgcccagcccaatggctggtgggcccccgtcacactgcgccatataaaagaggggtg

SEQ ID NO: 22574 - DNA, 3124 bp, Oryza sativa
ccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgatgacaacgacgatgtccggcgcctcttcctccacgaactcctcaaccgatcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcagcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacggccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaaaaagtccatataaggtccctccggggccgaaaatgaataaaagagaacagtagcaatttttccattttattttgtcaatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataa

SEQ ID NO: 22575 - DNA, 2207 bp, Oryza sativa
ccgctccgtcgactcaggaacgtttttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatatctctccccttgagcccaacggctcaagggggccttgaccgcgccctgatcgggggcgcccagcccaatggctggtgggcccccgtcacactgcgccatataaaagaggggtggaggccgg

SEQ ID NO: 22576 - DNA, 13542 bp, Oryza sativa
tccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaaaattgttttggcttattaaggaataatgggcaaacaataagggcaatcccaaccctccacttaggatggtgtatatggcattaactatattgccatgtaggacttttagcttatgtgacactatattaattaagagagagtgtgaagagaggaagaaactaggtctcatgcaagacacagcttcaacacgagaacctatacactagacactatcaagttttgcattgggagagaatagtgtcttcataatagatgaagaataaatatgattggtagagaagagagatgatatatttattaatggcccactttaagaaaccatggattgtagagtgtagtttctattatgatgtcttattgacatggcaccatagacactacttatggacactatgggttgggactgccctaagtactccctccattccataatataaggcacaatcatttttttagatgttcaatagtactccctccgtacttgtaaaggaagttgtttaggacaacgacacggtctccaaaacacaactttgacttgttgtttctataaaaatatttattgaaaagtgatatatatatatatatatatatatatacttttgtgaaagtatttttcaagaaaattctattcatataatttttacattttcaaactcaataatttgagagttattcatgatttatattcccaatgtttgacttaaacattgtcctaaacgacttcctttacgagcacggagtgagtacaaggtatgcatgcatgtaggcaattaactatgaccaattttccattaaattattactttttaaaattctccactctcatgttctctaattctattggatgcatgcattgtatttattaggatgatccaaactacaagatgataataattattttcttgatctttaggttagggatggttatgtcttatattttggaatggagggttacctagcagtacagctaataaaacagtagtactactgaagctagtagctaagactgtctccaacaagtgacccataagggcacccaaacccaaaatgagtctccgatagtactatttcagcctccaacagagtacctatacagaagacccattttgcgtgttataagaggcataacctaaatctgagtatcctctctcctgaagacctatttgcagtaagggttctcttttaggtcttattgttggagaagacaaaaaaaaagtattaaactctttgactgtagtgctatacaaacgtgaaatgggtcttgtattttgggtttcatcgttggagatagcctaagaaggaatagcaacggcaaagctgtcatcggttcgaagctgcccaactctgcacgttcactccgatgtgatccagtgccaatttgccattaacagtactccgtacttagcttcgtcacatcacccatacgtacggtacggctgatgcaatgcatgcaccatgcagcactaagtggtgtgtttccttaatatacttgttggacattaactagatcatcgaaaaagcggcgtaaccgcctgccaaatcgagcaaaacgtcccttggatgcattgcatacatgcatggcatgcatactctctcgtctcgccgtcatcatcgccggtcgacgccgccgccatcaccacatatatactcttcgctcgatcgtcgtacgtttcgatatctgactagctccctaacaatgacgcaacgcaaattgaatcaggtgagccgtgaacgaaacgattaacatttacggtacgaattaggaattaggcatcgttcgtttaggggtgataggggagattggctctcgttttccgcgcgcacgcttttcaaactactaaacggtgcgttttttacaaaaaatttcaataggaaagttgctttaaaaaatcatattaattcatttttggaatttaaaatagttaatacttaattaatcatgagctaatggctcacctcgttttgcgtatcttcccaatctcctcaatccccttctcctcaaacactcccttagtatacatacattataaacctaacaacaaattaggtttatactaatttgttctataaagttgttggagaaaccgtgtttttcacgcatatatataagagcaggtacaataacagactattagccaggtacaaacatattttataataagataaaagatgagagaaaaatacagactttaagacacaatgtatgtatgacatgtggggccatatactaaaagtatagtaaacaattatcgtaagaattggctgttagattggctataaatgaattggagttagtagtgggctatactattaaatttaatttgctctaatcctcgcggcttaggaaaaaattaacgggaacggaacaggaggccggtagctcgccggaggaagaagccaagaggcgcgggcggcggctgcggcagaagaagacggagtcgctagctggaggcggagacgatgctaggcgacgtgtcgggattcggcgcacgggaaagtggacaattaaatcaagcgatgatgtggatgtggatatatataatcctactcctactccactattgctagtagtaggagagtacataggccgcggcgacggcgagagtggcaagtgggggagtccgtgcggtggtcgctccctcctctcgcgcggtgacatctaagtgccgcgtgttctcctcttcctcttcccctccacctccatttcccattccacccccttcccttctctcgtcctcctcctcctcctcctcctctctctctctctctctctctcttcaaaataggtgggcggtgctctcgcctcccctccccgccggcttccgcctccagatccgcgccgcccgccgccgccgcgctcgctcgagcgggagctatagctgccgccttcgattcgacgctgcatgtactggcgagaggcgtagcgcgtggcgtgctctccccgacgcgcgcctcgcctcctccccgttcatgtaagtgggataaattcctcgccgcctcacctcctcctccagtacttctgtcacgacgccgcgtcggcgaggtgggtgggtgtgcttttcgcggcgagccgattcgatccgtcggcgtcggcgtcgtagggggagggggagggggaggctctgtcccgtttctacgcttccccgggtgggatttgcgcgcgcaatcaatgcggatggggggagggggtggttattggaggccgttggggaggggttccatttccgtactaccgtactcgatctgaattttcgggctagctgtgcgtcagacgtgatctgcagcaggtgccgaattcaactcaatttcgccacgaattgacaccacccccctcacctgctgctctggaatttctttcctcggttggattggaattcaaggtagcagcatgcaacttgcttgaaatactccaattagtgaggcttggttatgtacacacttcataattgtcgtgttaattgggaaggattatgcaggattacgagcataccgctaacaatttaatacttctaaatcagctgatgtggctagaggattaactttgttttattacttcctctgttcttgggaatagaacaggagaacataagtatagttgggatgggatttgatatggaaacgaatcataggtgtcactgtctgaaagcattgaatattacagttattgtctgcaatatccaaagtagatttgatcatatccaatgtaaatgatgaattgttcctatttacaaactctgctcttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgcccttaggtgtttcagatgccatgagatcttgtcttgctctaggaagcaaggatagaagtatgtggctgtaaacagcaagcatagaaccatctcttttatgcggtttcgataagaatatatataatctgcattttctccccttcctgattttgacaaattatcttctactgagttatctaaatgtttattttccttagtacaagatggcgatgatggtggaccctcctaatggcatgggaaaccaagggaagcattactacacaatgtggcaaacgctatttgagattgacaccaagtatgtgccaatcaagcccatcggaagaggggcttatggaatagtttgctcctctataaaccgtgcaaccaacgaaaaagttgcaataaagaagatcaacaatgtctttgacaaccgtgtggatgcactgaggaccctaagggagctgaaactactgcgacacttgcgccatgaaaatgttattgccttgaaagatataatgatgccagtacacagaaggagtttcaaagatgtatacttggtttatgaactcatggacacagatctacaccagataattaaatcatctcaacctctttctaatgaccactgtcaatatttcctttttcaggtaaggctcataccattgtttccatttttattcttgtttacttcctgttcacataatatttcatttattaattgttccaaaagaaatgttataagcagcggttccaccatgacgtatgatattgatgaatgtgatgtacttcttgctcctgagaagtgaaaatgagcctgttttgatggttcaaatccatctattagtccagtaggttgtcattacctattgcagctgctggcatgttgctgttgctgcctagtttcatttcttctattatcagataaagatacaagtgagccatatcccttttttttagtacagctgttggtacactctggcttttaggtcgaatattcatgataatatttagtgcttgttatagtgttttggccataatctaatgctttccaatggattcattaactagctactagttttcatatctggggaaattcacagcatttgggacgagtcagcatttatctacatttgtttctgaaataattcacccctgaacttaggcctgaatcggataatgcagcatttgaagctattgttctactgtgccattagaaaaaaaggaagacaaggaacagcaattgatgcgatgcacttacggttttaggatagaactccactagtcagaatctgggaactagggactagatatcctcaggaaaccaatgctaacctggaccatagctttgaaatcagaaattatgagaggtcataatgacactaaattgtttgatattgattagaaactacctgacaagatgtattatgtagtataatgattgtgaagtgtgagcaaaatagtagtcagcttcaatatgcctgatagaagcttctggtactgcttctatatggtgcttttgcttaggaatactgaaataatattctgaaatcaattcaatgctctactatatgtgtgcaaggagatttgcatgaggttggcatttaaacttcttatgtgcactctttaaggcaagcttttgcgtgtgaagtgaagttagactttcttgtaggccaaaagcttcctagtcaatctgccttttaaattcttttaccttgctattatgagaatttttacattttctgcctattcacgttgcaatttctgacatactttttcctattaagtgttttacattttctgcctattcttttacatttacattttcttcctattcttttacatctattaagtttttcttttgggttgattgttgtagctactccgaggtctgaagtacctccattcagcagggatactccatcgagacctgaaaccagggaacctcctggttaatgcaaactgcgatctgaagatctgcgactttggtttggctcgcacaaacaacactaaaggccagtttatgactgaatatgtcgtgacccggtggtatagggctcctgagctgctgctctgctgcgacaattacggaacctccatagatgtctggtctgttggctgcatctttgctgagcttcttggccgcaagccaatatttccaggaactgagtgcctcaatcagctcaagctcatagtcaacgttctcggcaccatgagtgaagctgacattgagttcattgacaacccaaaggcccgcaagtatatcaagacccttccatacactcctggcatccccctcaccagtatgtacccgcaagcacatcctcttgccattgatctgttgcagaagatgctcgtctttgatccctccaaaaggattagtgtcactgaagctctggagcacccttacatgtctccactgtatgatccaagcgcaaaccctcctgctcaagtgcccatcgatctcgacatcgatgaaaatcttggcgtggatatgatccgggagatgatgtggcaggagatgctccactatcacccagaggttgttgcaggagtgaatatgtgacaggcaagaacgaacatgtgaaggcaacgtgctacactaagatcttcacatgttggttttttgtataaatcttattcgcgattgtcgcgcctatcaagcttaagctatggcgatgtcgcccaggtgacctcttatgtaaatatgtgcgaataagacagcattctggagttgttcttcctgtggacctctacttgtagtatatggactaatgtgttgtatgagtacgtgaagcagaattcggtattatcaaggcttgtaatgttagatgctcttatattacactatgaagtgtcaactttcaagtggccacgtttacacatatatttgctatgctgacttgctgagacatgcttggttttagggcggtttgcagcttaacatgtgttcctttcaaagagcagtagatctgcagtttgcatggtattcctgtccaaactgtctagtatactctatactgatactctggtataaagctccctgcagtttgcaactgatgtattctggaaactgctaagacacctcagctacctttgtttgttttaaagactatctcaactacctggaactctgcattttgtttagtacggcaattaaggactgagttttcagcaaacagacttcgatgctatttttgattgaaataaagcaggcaaagttcggtctctcacataaacgaaacacattcatggatgatgtcgaaagtgcaacggaatgatacacatgacatgtaacatttagccttagaattttattgattcgacgcagcaatccaacttttgacggacttggcctcagaatgtcgacccattgaaccccaaattgaatccctgtaagaacaaaaatgaagttaaaatgcagtggagcaaaatgttgttcagaccacagcagcaagcagtcgcaacgggattaaggaaaaattgactagaagcagtgtcatcagtcatcactgtgtcagtattagaacttaagctcgagtggaaggagaagttagaagaggaaaaatggggaaacaagaagtgagctgaagaaagattgcaaccttgacatcgtcaaatttgacgtagaacctagacctgctgacggagagcttggtctcgaggatctcggcgagagcggcgctcagctttccgttgacgccggggccgatgccgccaatggacatgagctcgccgtaggccgccggctcctcgctggcggcgaacgacatgggcaccgacccgctgatcgacaccatgacgtactgcggggccatacaaggaaaaagccacggaggccgcggcatcagcagaaggaaggcaggaggagcagagcagagaacggccgcggcattccgccgagcaggtggggggcgcgtacggattcgggcttgccgatgatcctggcgagcgccttggagcagtccttgatgatgtcggcggcgacgacggcgtcgacgggcacgttggtggtcaggctcagctgcggcatcgtcgctgggatggtggcgcgcgcgtcgccggccggctcccctcctccgccttggctgcttgggtggtggtgggagaggtggagaggatagcgaggcaaccggaagatggaggagagagaatggaataattggggaaagaattgtcggagagcggccgggccaaataatccaaacggtccactttggtgagaatgtcggcccaagaattggcccaggagtattcttgtacactcctggcccgcttagtatattcttatatactagaggatgctccgcgcattgctgcggacttagttaacatcaatttattagataggagttaccatctcatgaaaaaacaaatagttttttttggagaaattctttttagcagccctatccaaaatttgtagatatttaagtagcacatgtcaactgaaggggcgttcagccataaagctcttttatacggattgacaggctggatacatgtagatgtgtatagaaatgagccaatgtgttcatgtgagctatatttggcactgatgaggcgaagagactcacccggtgactaatgggttgggctctatgctgcattccatccaacgtctaagaagtgatctaatgtattcatcaaacgattcacaatttgatgatgatgtggaagcacgaggtttgagcttttggccactttatagaaagaagggattgggaaaactaaatttcacaaacggaattttgctatattactgtcgacggttttaccttacgcccttagttcattgaggaagtgtgctaccaccacgccaattttttttttatgatagttgtattctagtcacatataagttacatatgagttacagtgtagttacaatatagttatattttaaaagttttataaagaaaaaacttgcgacatttttttagataatccctttcacaaaactatatgtactttgaccaaactatcataaaattgcaaatttagcatcttttttttttcataagacgatagatttaatatcaagtattataaaactatagatttaatattgatattatcacaaaactacattatattagagtttaaactcctagcattaatgttatttttaatatataaatgctatagttttatgataattttgttactaaatatgtagttttataccactttatcttaaatctatagtttcgtgataaattatgtattaaatatgtagcttgtgatataccaatttaaatttatagttttacaatagtctggttaaattaactgtagctttatgaaatttacttttggaaatctgcaatgcccccactcgcttcggcgtgagcggtccgcacatcccctctgcttcggtcacgcaattagtcgaacaccatggcagttcacatctctaactcatacccaactccacatctctaatttatttttgtgagagcacttcacctagctccactctcattctctgatgttcactgtgccaattctaaaataaaaaaagttttgccaccgttacaatcatcaagggaaaacttccctgaattgggtcattgctttctagttatcatggaattccttttcatcataggacattacgaattgccttgtaataagcctatgaagagaaaataatcaataaactttattagtggatgataagctagctgttagccattggtggcaggttagtgctgatacagtctagcctaataaatgctcctttatagtataaattttcttgtttaggattcctagagggccttgaagagacctggctattttaaggctagatttagcgtgtggtaagaacatgattgaagttaattaagaaataataccacttagtcaatcggcctcaaatctgcttccctggagattatatagtaaataatggatttggcatctgtcatcggggtaaggaatctgccagcaaatcatgaaaaataaacgagatttgagtgagaaacgtccctccaaatattttttttaaaaaaattatgagcgtgttagagattaaacacgaaacctcgaattaaaaccgcataccccttgtcactgcaatatcaagtgcatcttaaactgacctaagctgacctatcaagaaaaggaaatactacctgctaatacaaactgacctaagctgaaatcaatgatattcatacttctggaaaaggtttaatgggtgtcaaatgtacagatacctgggtcaatggagtaccattggaataacaattatgaatgctgtacaatttggtggtattcagaaaaaaagttgtgcaatttgacttccactagaaactgtactaactgtgaatctgtacatcatgttttcacaaaaggcttgaccgcttgacttgtttataaggtttaggaggttgctgtgggggtgatatttgggactaactgctttctatgtgctgctaaccctgtggtatactgttatgatgatttggcaaggaagtcattaggacatgggttgcagaagaccaaaggcctaattatggcagaaaaaatattctcaggattgatggtatctgaaaaatattgagcgccatggtggctacgcgattgtgacaaaaaacgtcacctccaaagtatgtggactgatggatcattcagattcgttggttcctcctgcctgaatttgttaatctcggcagcagccggcgtgctatctcagccgctggctggtggaaagaatattcaatggaagaaacgagtaccttctgttctgttgtgttgttgtgttgtgttcatgattgtttccatgatcatttgcccagtacttgtggttaattgaatggtgacaccatgagcccatcaggggaggagaagaagaccccaggcaactagccaactaccataacatgattaatcagtaaacctatcagtgtcagtaggagtagtgctactaatctaatctaaatggagcgtcctagtcatgctacaatgcaattctgcaaaccacagtttacaactctgtttttcagaatacaaatagtctatcatttaaaatttatattaaaatataaaaaattatggagtactggagtactgtactattgaccacccctcgtttgatttctctctccattatcctcgatcgaccacattttcctacttatttaagaagttatagaagaactacaatcttttctacttaattttaatctaaactaaaatcttttaaatatgtccatattattgaacgaaggtaatcttcacctttccactctgcgatgagacattcattctatctttccgcttatatttatacttataagctaaattttaaattttgaagttttttttatcataatttatttttcagcttttaccttttagattgttataaaaatatatatataaaaattttatttatatattatttttcgtttacaactatgcgtttggatagagccgattgcttgagctaactactacttcattcgtctcataaaaacgaatttataattagatgtgacgtactatagtacgataaatctagacatatatatgttaaatttatagtactagaatatgtcatatttaatataaggttagttttttatgggacggaaggagggagtacgtgcctttccatcctcccctgttagcagcagtacgggcaaagcaagtgagagccgcattggccgtgggatggtgtactaggtcagtcacacgtactacgtgtgaccgtgagagccagccagactcgcagacgcagtgtgcaaagtctcacacgtgtatctcatagctttggaccagaagaacacatgtatgtaggggtgatgctaactacactacgcatgaggtgtgagggtagaatagggctgtgggtgtgtttagttctaaattttttctaaacttttaactttctatcacatcaaacatttcatacacacaactttttagttacatcgactctaaatttaatcaaattttaaattttgcgttgaactaaacacagtcagtctagaatggtagagggaagaagaagaggagaaatgtcgtgagaggaggtggggtccacagggaggtaaggtgtgtgatagtgacaactgaaagagaagtttgtcccttcctatggcactaatggtgttaatgtcttcagagacattggctgcctcttctttctctgatggactctaaaccctctcgattctactccactccttaaacctctccagtttttgtgtaattctgttgtcatacggtttattgtgtggttgctgaatcttgaaaatttaggatccaatggttaggagatttttatcggccctgctgtctccagagttttttcggttgaggatcccagttgtaaatttgtaaccagtttttttgccctgctttctccgccggccgatcgatcgattatcgacctgtatgcctggtggtgtccgtgagctgctcttgatttcttccaagaatacaaaaaaaaaaaggattacagctttgccagtggagtttcctttttgtgctcctcgtgtttgttcttgggcagaaagcctgacgaaactgaatcctccaacaaaagcaaatggcgaagcgtgggctttgttgttaattatactttttgagtttgcccattcctcgaggttggtagtggtgaactggttggtgttggtgttgttgttgatgcttctttgatgagcgcactgttgcttgcagggctccttaattaatcgctttttcccaagatttcgtttttaatttatatttatatactcttctttttttctccggcttctaggtagaagcagggggagacagagcggccagtgtctttctctacaagaaattcctcggtttccacgcgcgctttggcatttcttttcttttgtttttcttttttttacctttcctttcatctcttccgctggttttgtgggatatttgtggggggttttgggggtttagaatctctttgatttcttgtgctttttcttgctttttctcgtgatgttggagtggtgtgttttctgatttgatccgcccaagtagcgattttcttttttcttttcttgttgtttgtttggaggggggaaaaggttgcgatcttggtggcgcgccgatggcgtcgtcgtgcatccccaccggcctccggctggacctggagatggtaaaggcggcggcgccgcccggtggctcgtcggcggcggcgcactcgtcggcgtcgtcgacgctgtcggaggcgtcgaactcgtcgtcgtcgtcggtggcg

SEQ ID NO: 22577 - DNA, 8513 bp, Oryza sativa
cgcccccatcaagagctgttcgtcgccggcgcccgtaagcagcgtgttcagggagttccgcgacgcggcgccgtcgcccggaacgcccgacgccgacgccgacgtcaccgacgacgactacctcggggagcttgatttcgaagacgaagacggattcgacgccgactctttcctcgccgtcgatgacggcgtggccgagggcatcgatagaatcatgggcaaactcagcatggagaagaactccgcagccgcgtcccgcgccgacgccgtcctgtccagcgccgccatacatccatacattagaagcctcatggtgctcggtctcgggttccggcaaggccggctcaacgccggccaagcactgaagcggcatgacgatgagagtgattggtggatgtgccctgccataccagtgaaggaaatcgcggcgcctcctgcgccatcggtggctatgccggtgccagtgccgatgccattgcaggcttcagataagaagaagaagaagagtaagaagaagtcactgaaggaaatagaaagggataatgccattgctgttggtgaatgtaagtttggtgatgagggaactctgggctttgatcatggtgatgctggaatttcggcgctgaaggacccaaagataggattgggcctgaatctgaacactgaagaggtgctgaaggcttggtgtaacagtggttctgttttcgctggctgcgatgcacttgaatcaccaagatcctcctctgatttgcatgtaagtatttctagctcatttgacttaaatctcttttaagatgataagaagaaattttgaagtgttgtatacttgtattataccttagttcagaattatgtttcatactgcttggcatataaaaactttaggcttttgtgtggcatatgttgtacaagtgcttgaaaaaccatttatgatttggttagtattactctcttcttctgggactattattttcttttgaatcaagccagcagttctattatgttatcctcatgtgtaccataattttgtgtcaatacacttctttaggagaaggggaccatacgtagattttgttcgttcaaatttctgctatataaatgtaaaaggaaaacatattatccacaattccaatcatcctatttttatgtgaaaatataaacttatccttgataattgtaatgatgtggaaattctcaagatggtatatgaaaagcacaacatgaaacttgataatggtctcatttatagagggaattttcaaagcctataagaagaactataagaagaacagaaaacttcagcacgataagtgttatatggctcctttgtttgtctatgtctgaagtaaatccttcttcaactaatgggttattacaattagtactaaccactctgaaaatatttagaacaaggagatgccagaacagaaaatcaagttttttttattctatcatgggggagtgattatgtgaaatcaacttttggtctgactgctaattactattacctccgtttcaggttataagactttctagtattgcccatattcatatagatgtttaatgaatctaagcatgcatatacgtctagattcattaacatatatatgaatgtgcgcaatgctagaaagtcttataatatgaaacggaggaagtaccaattttgatgaacatgcactgtcacgttaaagaaaactgctgtttcaccctttacaaaaaaaaaaaaaaaaaatctgctgttactgacaaactttaacattcttcatcgcaggctaaacttgcagacattgatctatttttagataataatacaagcggtgttatccgggaaggaagcatgctgaaattgcggcacaagcagaagcagtgcactcccctcctctccaataagacccggtatcaatcgcggaaggtgaatgctgaatgtcggcctcgggtcaaggcaagttctaagaactcattcctatgcaaacaacttatgcaaaggcaaaattgataactgttccaaatcaatttccacaagttttattccccatctctctaaagtttcttatgtatttgtctatgtttttggttctttgcaggggaagtatgttagccaggcttctcttcttcaacaagcctcagagaaagagaggtagaaaatgataaaagtcctcccatggacatttttggggcctcactctccccctcctaaagagaagcaaatgtgcttctctctttttcatttctgcactttaatcatgtaaagggtagagatgcctgtagagtggcatgttgctatggggatcagataatctttgtccagttctccagctataaaaatgatgaggttatcacccccagttaatggagtagtagtattttctgttctgttctttcatcttaatcctctgaaaggcaaaagaagagaaaaaaaccaaacagggagaaatgattatgagatgaaatttgttagccatcatgtccatatgacgcctgcaaagccgtcagagaatagaagctgctaaaacacctctgatgctctaaaattgtcaaatggagtaaagtttatccactgcgcctgaatctggaaggtttcctgtctacgttcagagattcccctaatcaagatttccttatgtcttactccaatcgaaatggcttgtccaagttgcaggctttcagcttggaagggaccaaaatgctgtagggttggtgaagattgggtatttgggttggtggagattgaaatcctgtgctttggccatttctatggtctcataaatatttgatgcttattagatttgttttgagaagtacaattatagtatcatagtaataaacttagatagttagagttctacaaaatacagttctgaatgtcaaatactcaaatatttacaaccagatcgagtacaaaaaatagtttgattgaatggaaaatgaattaaaaattcatactgaaaaaaaaatgatgacctaagatccccttttgttctaattaagatatagattttaccttgattttcattagcacacatttcaaactgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaaataaatggtactccctacgtcctaaaatataagcaatttttagtacagtagcaagtcaaatatttttaactttgaccattaataaaaaaataaaaagatcaatcatataaaattaatgttactatgtttatcattaaacaaattattataatatatataactttttttcatttaaaacatcttacttttatagatattgacatattattggtcaaagtagcatctagtagaccgtgtcaggtctaaaaagaattatattttgaaacggatggagtagaaaataaaacaattctaaatgaacttgagggaggaggaagtagcatctttggggagcgagctcctctaacgtaaagttagtgtggattccttagagcaagtttaatggtatagccaactactagcttcaattcatttatagccaatctaatagctcgtccatacaataattacacagtaatacactattaatatctggtcccacctgtcatatatacactgcgtcttgtagtctgtgctacagctagctacaaatctgtagcacgctgctcttctctcttcttatttatcttcttaaaatatatttgcaactggcttatagtctgctattgtagatttgtagccagctgtagcacggattccaagacgcactgtgtgtatgataagtgggaccgggtattaatagtgcagtatgtaactattatatgaatgagctattagattgactataaatgaattagaactattaattggctatactattgcccttgctcttataggtgagtcccaccttcatagcccatatgtcagtggcaacgctgtcgttctctctggagagggagacggcgacggcagtgatggcacagccgccaagacgataggaggtgcggtcgccaaaaaagcgcaaacccagattctcacccttttataaccattcccccccaccaaaccaaccaccgccccaaaaaatacccgccgccttttctcccctccccgccctgatccaccgcacggccgcgcgcgcgccacgccggtgtggagaacgatggccgccctccgcctccccaccccgccgccgccccgcgcccccgcgccgtggctccattcttcccaccgccgtcgggttgcggcgccgcggggcgcgggcgggggcgggggcgggggcggggcggtcccgccgccgccggtgaggacgctcctgatcgacaactacgacagctacacctacaacatcttccaggagctctccgtcgtcaacggcggtgagcctccgcctcgccttccctctcgtgaaaccatggcttgtgattgtcactgcttttgctcaacgtttccatggccggtgttttttttcccagtgccgccggtggtggtgcgcaacgacgagtggacgtggagggacgtgtacaggtgggtgtacaaggagagggccttcgacaacatcgtcatctcgcctggcccgggatctccggcctgccctagcgacataggtgagcatctccacttcagttcaatcgtgtggaatcagaattagaaattgctgcttgtgcttgttcaccatttctacgtttgtatctatgcaggtataggcctgcggatactttgcgagtgtggagatatacccatcctgggtgtctgccttggccaccaggtcgattccttttttgtgttaatccttgtgaactcatgatcagtcctgtaaaatggaaaattcatggacaatttggtggtaggttgaactgaaatggccgttttgttttaccactgcaggccctgggatttgtccatggtgctaaaatcgtccatgctcctgaagctatacatggccggcttaggtaaggccttgaactctattacatgcttaatactttcagctttctgacctgtacagcatttattttttatcttgtgcaattgctatggattagtgtgtgtcatgcataatcttctaagttctaggtgttctttcagttaagtagttaacacatgtcttgattttgataccccttttttttatgtcagtgaacttgaacacaatggatgctacctctttaatcacatcccatcaggtataaactctggattcaaggttagtgtaccactcatgttgctagccatattattggggtttcagcctctatatgcaccgcaaagaacactctacttacagttgttatttttcaggtagtgcgctatcactcacttgtaatagaaccagactctctatctgaggatcttatatcaatagcatggactgcttctccaaaaatgctctcattccttgaaagcgataagcctgatataactagcagtaccttgtggggatcattggataacttattcgtaacaaaccagtcagagtgcagtaccactgatggaaaaatgcccagcataaacgatgcaagtgagttagatggctacagggttctcatgggcgttaggcactctaccaggcctcactatggagtgcaggtatactgtctatatctctgcaatgttttttatttctttttttcactattcttatatttgattaccgtcaaattcagtttcaccccgagagtgttgctactcattatggaagacagatatttcaaaacttcaagaagataacaactgactttggattacagacaccattgcttcaggaaagaaaggttcacagtattggtaaactggaaagatcccaagtactaaattttttgaagactacaagtactatatgtgaacaagtattttccacgcatctcctttagactccaccttattgactttcttattgtactgcagatcagttctccagatctcaagaactttgttgcaaatgacttgttacattctgcaaggttgaaactttgggattctgttgggccttgtgctcttccaaagcgaagcagtggggacaaatgcttacggttgcaatggaaaaagattgataacttcctcaatcgcataggtggctctgaaaacattttttcagtgctttttggccatcatagcgctgaagatacattttggctggatagctcatcagttgaccaggtgctaattcagctagctcttaatatcgtttagttctgtcctgtatagattttatctgatgttaaacgaagattgaagggttttgagtctattaacaaaaatgactagatgatcatggacatgtggaacttcactgcatgaagaaacaaaaaaagtattcccctgattcaatatacttaatttcttcattctgacattctggcagatatagtctgcagaaattaaatgagataaagttattgataatgatagttttttatgtacatgaattgagttggttcaaaccagtgcctatttgacagagagtagtagatgtgtcaaaacttatcactgttatcctgtcattttctccccctcatgaaggcaatgcatccacttttatgagttgagaggttttttcttcaaagttgtgatgtggtgctacttgcagaatagggcacgattttcattcatgggcggcaagggcgggcccctttggaagcaaatgacatttcaccttgccagtcaacggtaggaaggcactttcctgaaacagaagaaaaacattctctatgtatttatataaaccttcatgttatttctgattcctcctatttcgttctagagccaattgtggaggaaaccttactattcgagatgcttatggttgtactgtcagaaactttctcaaggatggtttcttggatttccttgacaaggtataggttgaaatctatgtatcctaggacctagatatagaacttcacattttaatctaaccttgtattctggtactatattcaattatgtagtcagtttcatactttcattttgctagtgcataaatatgaagtttgttttatgtcatttgtagataggagaccactttttttttataagagctatattcaattatgtagtcagattgattttgctagttcataaataagaacttttatgctacttagaagtaggagaccaactgctgtgctataagaaagtgggttatggaagtccgagtgcaaatttctcaccagcacgtatgagtcatctcggtccattcacatatgccagcacaatgatgtgtttgactattatcggaaatgttgggggaaaacatgttgttttgttctgggcatctcagtataattgtattctgcacattatcctatccttgagcttatcagctaagcagactctatctagctatatgtgtttgtgttgtttaaagctttataattccaactaatttacaccacaggagatgcaatccattcaatacattgaaaaggattatgaaggacttccatttgacttccatggtggatttgttggatacatagggtatgcagatttgtttttgcaattcatatgctcttttgtaacttgtattggatatatatgcatagttaattggttattatatgttgtactgtcttgttttatccacagctagcttattttttaaaattaacatgtccactgttttttcctggatatgcgtagtttgttactccttccgtccacttttatagggcttgttttgatttggcatagtcttcagaattaaatttgaccattgagttatcacaaaatttattgttaatagctacaaaacggtgcaatacacgaatctattgttataggttttgtacactaagtttatgtgtaatctgattattgttgttcaaaacataattagcttgatttttgtaagtacacatatgctttattttttgtggatgaaggagtattcaactttttttctcaatctgtgctctttcacgtgtttgacttacatggttgcttcacttttttcttacatggttcattacatttccacttgtaccagatatggtcttaaagttgaatgcgatgcatcatctaatagtgcaaaatcaagtacccctgatgcatgcttcttctttgctgataacctagttgtggttgatcacaacaatggggatgtgtacattttatcattacatgatgaatattcttctggtaatggagatggagattaccaaaactcaatacatagtttatggttagcaaatactgagaagaagcttctcaggatggatgccatggccccaagattatcgatcaatggaaactcgtcgatcaatgggaactcatttaccatatcatccagtgtgaataagcaaagatttgtcatcgagaaatcaaaagatgaatatatcagagatgtgcagagttgcctggattacataagaga

SEQ ID NO: 22578 - DNA, 1988 bp, Oryza sativa
ttgcagttgaaatacaggcaagtatctgatagatacttttttcactgttcaaacattatgattttggttttaccagtcctcacaatactgatattttcttatgtgtttcaacagtgaaaaagatcaagctgagaacttgatgattgttgacctcctaagaaacgatcttggtaaggtttgtgaacctgggagtgtgcatgttcctcgcctcatggatgtggaatcatataaaactgtacataccatggtaagtaccattcgtggaaccaaaatgtcggacctaagccctgtcgattgtgtaaaggctgcctttccaggaggttcaatgaccggggccccgaaagttagatccatggagattcttgattcacttgaaactagtccgagaggaatatactcaggatcagttggattcttttcatataacaagacttttgacttgaatatcgtgatcagaacagttgtcctgcacaatggagaagcttcgattggggcaggcggggctattgtagcattgtcagatccagaagcagagtacaatgagatgctgcttaaagcaaaagctccaacaaaggtggttgaagagtgcagtcaacaaatatacaacccagatcgttcggattcaatgcagacaaccgtaagttagaatggagggtgaaaacgagtcttcttatgaaaacacaaccagcattacaaggtttggtatacaatgaccatcagtttggatctgaaaaattcgatctccgctgttggtgcacatattaatggctaaactacaaggaagtcgcagcacacctattctataattgggaattctaaaagcaacaaaaggacattttgctgaaagaaaggtgcctatgccaaggtggtgaaaagcacattggagcaaaattcatggtgtactacaatgtagagttagactagattacagctgacatgccttctccacaaaacaacagtgcacatgattttattgattgattgattcccctattgtggtgattgcactgtgtaataataataaactgataaaagaaagaaacccatactgaaatgcatttcatagcagattcatatatatatatattggcatgtatttgcaagattgcacatgtctcacctgagttcaaatatctgaaatttaccatgtactgtttctcaattcatgctagtattgatcctactggtgattgccccatcttgaaatttgagatttgagggcgagatggctgtttgctaatggcagcacttggttgagcatggctggcatgagcactgaacaccagatgtaagcaagggttgtactgcaaccagatcagatttgtgagctgaagaaatcgtctaagattgcatcttttcaactgattccaattccaaattacaatgggcggccggcctggcacgccattattccaatagtgtttatgaatcaattgcgcacgtcgcattatcggattgtgtcgtgccatcatcccagaatgtttctcatacgcaaatacacccctgtgagtttcacaacttttcgtagcctttttatctctgctcatgaatatttgactttaggacaagatttgatcaaatttttaaatgttgataataatgactcatatgtttacttttaaaaaaaacaaaaaaacgtgtggaatttctttgaaaaatgtaaaatttgctagattttacaaatttattttagtataacatcaacggcaaaatcttcaaaagtttcaatctttacttaaacgtcgattatttttggactgatagaacacttgcaattttggatggcttatggttctaagtttgggaataatgaaaaggtgagggagtttagtgtgattttgggaggatgagaaatatatatatggaggcgaaaatttaaaaaatggagccactcgcgagccacgactcgacctcgccgcggcggcgacgacgacgacgaccagcacgcactcgcaccggcggatcgccggcggcggcggaggaggaga

SEQ ID NO: 22579 - DNA, 4055 bp, Oryza sativa
ctaactcgattgccgtcgccgtcgccgcagagatcatcgccgccgcgtccggcgcccgcccgctcgccgacgtgtcctactgcgtccacgccctcgcccgccgtctctccaagacgcacaactgggtggtacgccgccatcgccaatgttttcctcatcgctcgccgccgcgtgatctgctgacgacgggggtggatggatggtgatgcaggtggcgctcaagacgctggtggtgatacaccgcgcgctgcgggaaggcgacgccgcgttccgggaggagcttctcagctaccggcgcggccgcggcggccattgcctgcagatgtccagcttcaaggacgactccaccccgctgggtcagctcccaatccaatctgaattcctgcataaactgaactggattaacatgaactcaatcggttcaaaaaattttgtcaccgatcgttctcatttctttgtgattgcaaatttgaaatctccaattgctttgctcagcgtgggattgctcggcgtgggtgcgcacgtacgcgctgttcttggaggagaggctcgagtgcttcagagttctgagatacgacattgaagcagagcgtctgaggacagcagagggagctccaaaggtttgtgaaattgtgattatggcttctaaatttcagggaatgattcggtggtgatagttcggcatgagtgatcttgttgcttgtgatgttttgtttgttccatttggtgagaaatatgtaccaattgaaatatgatgttcagggtcagagtagaactagaagcttaggtaaggatgagctcttggagcaacttcctgcactgcagcagctgctctatcggctagtcggctgccaggtaatgtacacacctaactttgtggtatgttatctgcttgatctagattagtttctgactcatttttaccaatgctgtaactgtgtgtgaagcctgaaggagccgcatttggaaactatcttatacagtatgcattagctctggtattgtggctgaccttaattctgatatctgaacttcagatactactagttagaacaatttatccgaattgctcttgctcatgatgaatgaaaatgttactcaggtgctgaaggaaagtttcaagatttattgtgcagtcaatgatggaatcattaatcttgtcgaaatggtaccttttattatttaccagctttctctgcatttgaatcatcgatggatctaatggatatgatcctgatcaaattaaatttctgaactgttgtagttcttcgacatgacaaaaattgatgctatcaaagctttcgacatctacagaagaacaggacatctggtacgcgtaatcacagtgtgctttcattattctgtagagttgcatgcattttgattctctagaaatgtatatggagagctaatgagctttagaatatcaggcaaaaagcctgtccgacttctacgatctctgcaggggtttggaactcgccaggaatttccaatttccagtcctaagagaggcaattacctttatcttagcctatcattgttttgttttcactgagaattctaatgccaaatggacttctctgtactttcttcagccgccgtcatcatttcttggaacaatggaagagtacatcagagaagcccctagaactgctcctgttgcaaataagaccgtagtgagtcattaagctaatgtatttaatcccgaaacaaatcgaacagaagattgagtggcttgatgaaactgtacaggaatatcgacaacttgaattcattccaaacaaggaagaagaacctcctcaaccgttacctgaggtgttagaagaacctgttaaggaggagattttacctgaacctccagaagaaccccatcatcctgcagctgaggttgatgatgaacctgaacctaccacaaccgctgatttattggtaactcctggcaatatgacactgtattcatatcagctatttactgcaataaatggtagcagttgatccaatttatggtggactgcagggtttaaatgaagtgaaccctgctgccgcccagcttgaagagaacaatgcactggctctggccattgtatcaccaggtgattagcatgcatctgcctatactatctcccgattagataattcaagaatcactagtaattctcccaaatccatgcataatcacatccttttggattataacaggtagcaacacatctgctggtgcaggcagtggcttcggtggcatgcttggatcgtcaggttgggagctagcgttggtcactgaacccaccaacagcagcagcaaccaactactgacagagagcaagctggtaagtcaacaactctctattgcttatttcaagaactctctattgctcaatgccattcttttgatcatactgtgactgagagtcatttccaatttttgcactcaatgactcttgtaggctggagggttcgacaagctgctgcttgatagcttatacgatgatgcatcaaggaggcagcaaggagcccagatggatcatcctcgggatccgttcgccatgtcgacaagtgtcgcgccaccgaccaacgtgcagatgtcgatgatggcacagcagcagcaatatttccagcaggagcagcagcagcaaatggtgttagggatgccacagcaattctcagggtggcctcagtatgctggtgtttctcaggcgaatcctttcggtgatacgtattcaggtggtactctccatggaagcagcagcttgatctgaacatttttttttctgattaaaagtagagtagctttgatgtgataatctgagaactgccattaattcagcttgctcttgttagcaaaacgttgtatcttcttcagtcttcacagatctcacttgtgcacagtgcactggcaatttacaagactggaaaacagaaattcatttgttcatttctcaggacatgcttgtatattaccagttaacgatgacattagataaacgagtacagttcaaaggtaaatttgtattttgggtattacacgccgtggaggatgtccaaacatatatggacaagcattgcgcagctttgatagcatagtgccatcatgtagtagctggcgtatacccatcaggatatccccagctgtatcctgtattcagtgcaaacatcacatgaagtacatcgtttctgctagacactgtaacaaaggatccaaacaaaaaacgatcaatccaaagaaaaaaaaaaggaggggaacatcagacaagcgagtagtcgtacatatgtacatggacgtggcaacaaactctcgggtcattttcattctggtataacgagtcaaaaacattttcggccatgccattacacccaacgattctattcctagttcttataaagttctcctgtcatattggccccattatacctgaactcctgttaacccagccctcaccgtatctagtatgcatcgtcttcatcgtgctatttgttcgtcgctttgtgtgacaattagatattgatccaagcctcttcatagtactccaggccttaatcttcatggtattctgggttcttccttaggatcacaaaaccctcaagaactggtgtcagtggaagatatctgcacatagaaagagcataagcataagcataagcaaagatcaactgacaaattagaatattgtactccagatgttatagtttacttttcagttgccagctctgctcgctcccctgcagcaagtaatacaggcgttgaatgtgtctggaatccagtgattgtcttgggtctacctgcctgaccgacgacatcaactgcttggccaacacgtaccggaacagagaggggcttgagatcctcatccacagtcaatagcatcctaggctgttacagtagagagaactgagaatccatgtgactggtttagctatatgcccactaccaagatctttgaacgagatatatacctgcatagctagggtaaggatataaagcatgtaatggtacttccccagaatgatggatttcatgtcaagacaggcatgcagaaccgtcacaagaccagcaagtg

SEQ ID NO: 22580 - DNA, 692 bp, Oryza sativa
atgtcctgcttctttgtaataataacttgagaggttccgaagcatcccagctatacgggcattgtttgtaccagcccctatcaagcccagggagatgattgcagcctgcatgtaccagtttgatcaaattaaaatcaatgctcatagaaattaatatggtaggttttgctggtgaggttactaaccatagaaacttccgcatctgcatcatggctcagtctactcattgtgtccataacatttacctaattgacaggcaagtggtagaaatgtagacatcagaaaactagataagatatttatctagccaaatgatacaatctactaattttcctcgaataaccaggatcaaataatagtcatctgacaaagcacattctcaagagtattgaattgaaatagatgatgcagcagagtacaaaactaactgtcacggcatgctattaaatagttctttctcaacaattcaattgaatgattgtgtgcaacggcatgaagatagcacacatttaatgctactagtatacaaaaagaactgttacctttggattggatatgcaaagcaaacccagagctagaggaaccgcccttctaatattctgctcgccatactgtaaaagacgctcaagggaacgtacagccatttccgcccctaattcttcagccatggcaattagggagattccaagaac

SEQ ID NO: 22581 - DNA, 759 bp, Oryza sativa
ggaagattcatcaaaaacaaataggcgctaaaaaaatgtaatcctacaacctatgcacaattcttctgttaattgggaatcaccttaagcacgttccctgtcccagcatatgccagtgacatcaatgtcacgtcacaataattccttatcttctcatcaaaggttttagaaacctctgcagtcgcctccacactttcctgagaacagtagtcaagaatgagtataatagtatattaacataaaactggctaaaaacagacggtgtaggttcatgaagaggttgcatgttacatatgcaagacaattgacagtgcttaatccagagaaaaaagcaattaccaaaagaataaaattgtacttgggatgaatgaactaaaaatacatttgagccagttcaactacttgcatggtgcacgcgaaccaaggccaaaatagtccacgttagcgaatctgagcgttatgctgctgaatgcatgcataaatcttgtgatccagaaaagatagggatagttctcctatgccttttggaaattatcttgctaggggaatttgcagaagattgatagaagtgcctgatgttcctgataatgatgagcagaatgagtcaccatacataccaaattccagtttcctttatcctgattgatctccctcctcactgcgcaaatccctcatctcacaactcagtggcctggttgcactattggtgccgcactgcatgagtgggccccacgtgtcgcatgaaataattcaaagaga

SEQ ID NO: 22582 - DNA, 2718 bp, Oryza sativa
aagctctggttcactacgctccattaagacgcatatgattgtctgtgcaacctcttcattacaggaaccaacgaacaccaaacctaaggagatggcagagaagaccaagacctccagaggtacttgggagtcagtcagaaaagctgtgagattctctctaacctgaaatttttggaaaccatgttaatacaaaataacacatggttaatattttttaaccagtgggatagcaagaccaagaccaaggatttgacctcctctttctgggagccagcataagcaataccaagaccaaggattgctccaattcgtataattgactcatccctgctgaaatactcagaaatgagagcaaatgcctggagaagatgtcacaacatcagtacagagacttgtgcattagaagttttagaagatgtggagagaggtaaaagatggacataccggatcacagtcactcttcacaccacaagaaacaattccaatccctagcaaagccccagcaacaacatgaatatcattgctgtgcaggtacttgtcaagttgggcaagtcctgaatcagaatcccacagaagaatcattccctgaaaatgattgttttatcagcaccatgatcacataataacctaaatgccatgtatatggaaataaaccaagctgttgcagttgcactaccaggctagcggctgcactagctttcccatgttccttgttcttgaataaccagtttccagaagaaccactgcttgaagaatctgatggtgtggtcatgagtttatcctgcaacaagaatgttgagaaccttgcttgccctggaaacctttgatgaaattcgcataactaacctggccaaatccagcattcacgaatgcattgacaaatgttgccgccagattctgtcttgcggaatcaagactggagcttgtagcccctcggccatcaatcaaatgaacctaatgaattagcatgcattttttaatcattaatagcaggtccataaacaaagaaataagtagaaacatgaaatcagcagataacatttgggtaaaaaaaagttaaccttatatatgtcttctggagattttggctccatgacctcaatatctcgtgcaagtgtaaggtacccctcactcaatttaatattagaaattatgtcctgcaaagcctccttctcattttcatcagcagctatgtcatcatcaatctcgatgcttaaacccttcagcaaagagaaaaaaaaccattgaccacataagcaaagaggaaatgtgaacaatgcaggctaccaataatactgaattgtagacaagaacacaaacagaaattttgcttctgttgaatatttgtgtgcatgggatgaggctcacatggcgtgctatgataaacgcgaattgcttcttcagttgaaaatcatcagttgctgtaaaaatcggcttcaactccagggactacaaatcaatgaaatatttgtcagtgccctaatgtactggacagcaaataggacatgacaatattcattcacccaccttgtcataaagcagaagtgcaatacgcaaagcatttgcaaaatctccaaatttcatgtaaatctcaaaagctattttaagtgccgacatgtcatcaggagcaggaagatatctgcaagtttgcatcccaacacaaaagagtaaatgaagttcaattaagtaaaactagataatactaagctttaatcaagtgagaccaaattcagtggcatacttagaagaactagtgaggtacaagcaggtccttttgtagttcgtggagtcaacgtgcttaactagcaaatcaagcttttcgacctatgaagcaatttgatatcacacatcagttgtgaaccaatgaacaaataatgaaaactcttaatacaaagaacgaacaatttttcatatgtttaaaaatagaagtttcacttacctccattagaagatccacagcttcaggttcagcattatgctgcaatataaataataatcaatatcatcagtccatccattgatactagttgtttattggctactacctccatcccgcaatagttgtcgctttgacttttttctttcaatgtttgcccattcgttttatttgaaaaatttgtgtaaatatgaaaaaggataagtaatacttaaagtacttttgataataaagaaagtcacaaataaaataaatgataattttaaaaaattttgaataagacgaatgatcaaattttacaaacaaaaactcaaagcgacaagtaatatgggacggaggtagtaatatttaatgcattacacagagtgtaacaagacatctgtgatgaaataagaaaaacaaatgacacccatggactagactcagaattgaccttcatgtggaatgaaacgatttgctccaccagttccttcagggaatcagttggcatgccatcatcctgcaaagtggaaaaaaaaagttaggattataaaaatgaggtccacacacctaaactttgtgttgtcttagtccatgcacgtgtgataacataattgacagaagaaatcatgtgtgtggcttctaacagaacaaaaaaaaaattatatagcaatcatgctatctcaattcttgccaaataacaatcagtacggtatagatgtgggatacaaaagtcaaaagggtctcagggaagatcacttaaaacacttgttattgaaatcaacagcagctagacaagacat

SEQ ID NO: 22583 - DNA, 7294 bp, Oryza sativa
aatacttctttcattggggtgaagaaatacattatgcaattcatatgatgatatggattagggtccaacctggcgcttctggaattcctgtgcaatttcaccagccaagtttctagcaagcgagacattgacattgttagaaaatccaattcaaattcaaaagacaaacatatgtattccaacagaagacctgaaaagaataactttttatcaataatttcttgagtacaattcaatatttttttaatacactgagaacagttaaatatttgaccacaccataaattctaaataagctgatatgaaggtaattgtttggtaattcatcataaactacctcaggaataaatctttacaattaagattcacaagcagcaactgtctcattaataaaattgcaagctaaacaatttaggaggcctggaaattggtgtcacctcacatattcatgaccccatgaaccaatgtcaccttcagagcctatcattcggtagttgaggctctcctgaaacgataaaagaaggcatattagccaattcttgaaggattgatactgtacagttaatggtgagaaaaagttgaactctatctgtctatcatttaaaacccacgaaaaaatgtatgactatttatagaagtaaatcattctcagaagttagcatgcaagcaaattaaaaaagcactgggaaattgacacaaggaaaagacatcagaatggtatttttcacatactctttctccttcagcggacattgtcagggccaatactgacaaaatatcagccatatacttctgcagaataattgaagaatatcatataagcatcaagtagtatttgaaccgtgactcaaccgagagatcaaggattgattgataccttcagatcagattctggcattgtctcaaagtaagccttgagagttccatagtgcgggcgaaggaatttgagaggctttgggacagaggtcattgaacttgtcgcagaacggatctcctgcctgttaagcataaatcaccattaacaagagaccaataagagaaatgtgaaaactgtctatgcactaactggttgaacaatgcaaagtgatgccaccaatagcagcagtagccactcagatgcgacattccagctgagcagatcaaacaatctcactatgacgcggtagagattagagaaattgaacagttaaagcatgacctcatagtaattgtgattaagtagtattatacccaagatttaagggcaaaaggataaacaagcctccaacaatgtgccgaagatctacattcttgcaacaccagcaattaagcagccaaaccaataactcgggcagaatttatgtggattttcaattctcaggactgtaagtttgcagaacaacaaactcttgcacaggacaagtaagcagtgcaaccaaaatacctagcagttaataatagtctactagatgacatgatcatccgtccaaaccatactatgaataatgtatggaacttgtaataaactaataggtagtgtgataaatgcatccacccaaacgaggtaccagatgacacaaaacagaaatccctgaactacgcatcacgcacaatcagaattatacagttccacaccatcagaacaatcctcgttacctcatgctctcgagggcgagcttctggacgccgggatcggtgtcctgcgcccgcaccacgtagagctcgagctgctccttgagcgcctggtcctcctccgactgcaaccacgcaaagcaatccgtaagagagagatggggggagggaaggagatggcgaatcgggggtgggcgggtgggtagctcaccaggtcgtcgtccttcttctcatccttcttcttccccttgcccttggccggctgcggctgcggctgctgcggcggaggcgggacggggtccgagggggaggcggaggaggcgtccccgttggggtcctcgcgcggcggcatggcggagggcgagggcgatctccccggcgcgcggcggcgcggcgaggtagggtttaggaatcgagctccgcgcggaggcgagagcgcgagatgaggggaagggaagagaagaggagttggagactgctgctactggaacacgccgcaactcttggggagcgatgaatttcgctccaagaaagaaaaagataacgagagagaaagagagattcggtttaataaaggttttggtaataaactttcagtttgatgaaattgcattcttacattgttttcttattattattgtgatgatgattagtcgacggtttggctgattacatgttgggaatgaaaacataacatgggtacaaataaaataaaaacataacataggtaagtaggaaaatgagcattgaaatatactcctccgtttcatattgcaagttattttgactttatactagtaaaaatttcttaagtttgattaaatttatagaaacaattaataaaataaacatcaaattatattcattaaaattaacatttaatatatttttataatatgtttattttatgtcacaaatgttgttatgtttttttataaactttgtcaaacttaaatattaagaaaaatatcaaagcgacttatagtatgaaacgataatttttttattattttttgaaacttttgattttttttattttaaaatcaaacaattctaaaacttattttcaaaatctaaacattttagcacgtcaaccctcgtggtgtggcaaaatagtactgtcacgtcacccacaacgggcacgacaattttgtcatgccacgccagacaagatgacgtggtaagacaaacgttgtcacaccaattagaccgcgtagaaaaaaaaattgctagcatggcgaaacaacactggtactcatccattccatgttttttttaaccttttgaactttttaattttaaaattaaacatttttaaaactttgattttaagacctgaatcttttttagcgtggcaaaacaataccgccatgacaatttcagagaaaacgttatgccacatgcataaagaaataattacccgtaaacacggacacatatataagtcgttccattcgtaaggaatctaaccaaataaattatgctcaaattgtaaatgtttttcattgttttatgagattattggacaaattctctaggagaaaggttcgaggtataggtagcaaattgtactaaatccaaaagtagttcaagcaagctataacagtttgcacgccctgggcacttagtgacccttacataatttctcaggtgaagacaagactactttgagttttttagtgatttttaaatctatgatatgttaatctcgtgaactagcaaataattagtgaaattagggtaaaaatatcactggctgtctccatggatgcaataaaatgcaaacatttaattgatagaaaggatttataacagtagaatttcaatatagtagacactacatatattgtggcctatcatcgtctacgaccaaaatttatttatggtaaaacttttatactctattcatatagagttagcgatttaaaaagtcaaaaataagctagataagaaaaattcaaaatcaacttaaaatgaagttttaaattcaaaatttgccggtgaaagataagccaaccagcgaatgacggagctgctaacattctcatgccccatcgggtgccctaatcagccaaagataaaaccaaaaatagctaatcatgtccccatcgaatgccctcaaccttaatttcgagattgatttcaaaatattttcaatatagttcctttctcagtattggcttttaaatcaccaagaaacacgtatataaaatttttacctataaattatttttttctctaataaaccaaaacggttttgtagtgaatatggcaacccatgggctttcaaacattctacattctgtcagcctagtttggtttcaacctaaaaaagaaagcctgatctgatcggtgacagtcggagccacatgaaaacaacctcgccaccaccaccggcgcagcgcgcagtgtcgttcacgtgctgttgcttcttcaatgccgttgctgaataatcttgcgcctgccgcgaggtcactgacatgtcggtggtgatcagctcatcagtgccctctgcccatcactgaaagtctgaaaaaactcatccataaaagcagagccacttcaccagaattcaaagctaaatttatatattaatttagagtattaaatatagactacttacaaaactaattatataaatgaaagctaatttatgagataaattttttaagcctaattaatacataattagagaatgtttactgtagcatcacataggctaattatggattaattagactcaatagattcgtctcacgaattactccaaaattatggatgggttttattaatagtcaacgtttaatatttataattagtgtccaaacatctgatgtgatagagacttgtccaatctaaacagtgtctaagtaccctgacattaccaacgttcatctccacggcactgcgcccccaggccccagccaccgccggccgccgccggagatgtcgccgacgaccacgtccgcggcggcgttggcccccatcgccggagcaatggagcatccagttctacggtccccgacacttgttcctcgtcaatggcaagagtccaaaacctaccgcacctctagactccagggggcccaccacccgctactgccatctgggacccacatccgcggatgtgggcccacgtaagcagtttccatttgcgacggacacggtccatggaccgggagacactggcatgtggggcccactagggctggtccacgtgagccgcatgcgccacgtatcacgcgaaaaaaaacaaaaaaaaaggaaaaaaagaagagggaatttgaggttccttgcttggttgcctcctccattaaagacaacaaaagcaacgccattagcacacacctccactccactccactctcccaccactctcgcttcccgaggcgcgcaaaccctagcctcgtcgcgccgcgccgcatcctcctcctccccccgcctgagtagcgccgccgcatgcggctgcgcgaggcgcggcgaagcgactgacggggggtgatccgccgctttcgggggctgatcgaggcgggaggaggagcggcggcgccggggaatgcccgacctctcaggcgatctccttcgtggtttttggtaataataaacaggtttgttcatctctcgttttacatttttctttctctccgtgacgcgcgtttttttttttgctgttcctcttttggtggtttacctggtaatagagctaagctacagtaggataaaggaccatactgtttagagattccttttgccaatttttaaattttttcatcggtattttgtttgaaggaaaacctttttttttttccttcttttagttttggctgtattttttaccagatgatgatattattcatattgatctttgattttgttgtttcacccttttttagcagcttgcagtattggttacagtgagataatatttgttcagcctgttctagtagatcttaactcatgcttgatcctttagcaaagtggtataaatttttagtttcatttcaaaatcaatctgttctaaagaaaatgcagctattaaaatgcatacggagtacacacagactagccgtttacagtacgctatattgtagtgtagactgtagagtataatcgttctgaagagccatttaatgtcatcggccgccctaatttaataaggttccgtaaatgcgtgctccatgagaggcttgtgaggtgggcaactccagtatcacaaagaaattgtgggcactgccgggaccagtagtggatgactagggtagtgagtgattttactcagtcagtagtgcagtcctgtactcctgtagttgttgtactcttgactctcccaaaccatcaaattgatgtctagtgtcatgcatacttgtaacttgtaagtgcacttccctgacagttccattctttggaagattctgtggtgtggcaattcggatattgctgaagatgaaggcgcttgagctcgcgtgtttgcttcttatcattgtaccacaagtggttcttggaacacatgatgtgtacattgttacaatggaaggcgaacctgttgtcagctacagaggtggagttgaaggattccctgcaaccgccatagatttggatgaagatatggaaattaccaggtagtttactattgatgatgttttttcaccatgccttcgaacatttattttgtgttggctgactcttggtgaatttgtggagtctatgttgggttgcatggcatattggacttgttagttcttattgttgaattgcatttcacatgtcttgttgcacttggagcttgctactgaggaagtgcacctcctaaatgtttcttgaaatggattccattttcttcccattatgatatatcatatatgtagtgtgtgaggtttgagctgttaagagtcttccaacatgttaagaatatctgctcgaaagccttcattagaaaaaaaaaaggtcaccactgttactgtctttcagctctctgatattgaaattgattatccccccattaagtttttaatcacagcttgcttgtatttgtggagttgtggtggaaacatgacaattttgtatatgttccaatttactgatttcagtgaggctgtgacttcatactcactccacctacgaaggtaccatgacaagcttctagactcacttttggtagaaggaacttatgagaagctttatagctaccatcatcttattaatggttttgcagtacacatgtcacccttacaggtatttagcatttttatatcttttcttctttcctggtttaagattattatcttggctgaacacagcaatctttcactgtgttaggctgaattcctaaggaaagccccaggagtaaagcatgtggagagagatatgaagatacagaaattgacgacacacactccacaatttcttggattgccaacaggggtatggccaacgggtggtggcttcgatagagctggtgaagatgttgtgattggctttgtggattcaggaatttacccccaacatccaagcttctctgcccacaaaactgatccttatgggcctgttcctcattacaaggggaaatgtgagatggatccagtaacaagaagaagcttttgtaatgggaagatagttggtgcccagcattttgcaaaagctgcaattgctgctggagcgtttaatcctgatgtcgattttgcat

SEQ ID NO: 22584 - DNA, 1396 bp, Oryza sativa
tgaacaactaagaataatgcacaaaatcacctcaatgaatgtgagcccttgtgctagtgaaattcacttccttctatcttgccgttattgttaatcaatatctattattcccctttgcttttgctctccttccggattgtgattttcctgagtttgtgattgacaggatagccgtgtacaaagtcctttacaggctttttggtggttatgtatctgatgttgttgcagccattgatcaggtataacatatgagttacttatctgaatttctttccactgtaatgcaggtgctgccatgttagtacttagtacctgacaatagtgactcaaaacaattatttctggaatctgccatagtagttgttttcttcatagactattgcagaaatgagtgaaacaacatctgccagttatgtaatgcatgtcactatcacaagccttcaatatgtaggaactaatgcatggatggcaatctgcattttgcaggctgtgcaggatggtgttgacattctcaacctttctgttggcccaaatagcccgccaactgctacgcggactacatttttgaatccttttgatgctgcacttctttccgctgtgaaagctggggtgtttgttgcccaagcagcaggaaatggaggaccatttccgaaaacactggtatcattcagcccatggataaccactgttgctgctggagttgatgaccgcagatacaaaaatcatttggtgctaggaaatgggaaacttcttcctggacttggtgtatcacgtaagttctgtttattcatgtattttagctcaaattttggttttctattactacatgtatggtatatgcattcatgggcaacaaaaattgtacaaaatgaattaaaatgacctaagctaagtggcctaccttttaacttcgcccccccccaaaataaataaataaataaaaatcactcaatgttgttgtctgcgcttagggtgtgttcggaacccctggttcccaacactaagtgcccgcacggaaacggagcagcgattagcgggtgattaattaagtatttactattttttttttcaaaaatggattaatttgttttttttaagcaactttcgtatagaaacttttgcaaaaaagcccgtttagcagtttgaaaagcgtgcacgcggaaaacgagggagatgggttgggaagaggggctgccgaacacagccttagagaagtatgaatgatagggcagcatcagctgcacttgatttttttttgttatgtagggtgtaggactgtaggtagatctttatacgaaattgtgtttttttatctcattgtgaaaatactttgtgtgaaagagacaatcctctgtttttcttcctttgtaattccactgtcatatgttactgcatc

SEQ ID NO: 22585 - DNA, 955 bp, Oryza sativa
aaccaatcacaaccattctttttcacctactttctcttttcaaccaatcacacaccttcttcaatcattctcacatactttcttaatacccgtgccaacctaaaaaatgcttacattttgggacggaggaagtattgcatccccaaaagtgtcagtgtgtagatatcatggatgccatctgtaggcagaacaccatgagtggagtattgaaaagctgcagattctaatgttttttcttttatctggaatgtttttcttttatctggctacgtcttatgtaaacatgaactagaaaaaactatttatgtagcgtagtggattgtatagctcttgtgtaaccatccatctagttttggtgtctgttcagtgcccacaaactattctcgtatagttgtcttcttttttagtcgagctactctcagaaagtcagtcccctagaatgtacatgcttcaagagcagtgacatgaattgtatatgcctgctattgtaggatgacatgataattgaatagtagggaaaacctatgcatgttagttagataatacgttttttttttgatatagtcaggtgacattagttttggttctgtaggatcttatagactactacaactcttctacaataagagattgggcaggaagggccacgaccttccaagcaacagcagctattgcagatggtttggcaccaactctatacaactctgccccccaggttgccttgttctcttctcgaggaccggatgtaaaagattttagctttcaagatgctgatgttctaaagcctgatatactcgctcctggcaatcttatatgggcagcatgggcgcctaatggaactgatgaagccaattatgctggtaagctttgctgtacttttatatcccttgaagcatacaaagctttttaagcatgttatggttgcattgaaattttccttgcatgtttgattgtt

SEQ ID NO: 22586 - DNA, 628 bp, Oryza sativa
ctggatgtgggcactgggcagtgcctctagatctgcaagggcggctccaggaaggggatctggcggtggtcgttgggcacctcctcctggtctccaccacatccgtggcagcgtcttggggcgatgccttactacttcttcgtcagcgccgataccccttcccggcctcgtacgtgcaaccaggttggtggaggcagccgatggcactagggaagaaggtcaatagagggcatcatcgttgacacattgtagctcccatatcattgtggccttctgggtgggtgtcagcgggtggtgtggcgcgcgtggatgactggtgacagcggttgctgacgaaggaatggggttcggctgaacagggatttcgatcgaccgggagtgggggaacgctactagtgccaatgcgaatgaaaatgccgcctgggaataacattaaaaaaattacaaatatacctttttttgaatttataccgcaaaaatcaagtggaacatcaaatcaatatatattgttatatcgtttatactgctaatatatactagtacttgctatatggtgtatttctcgtaaaaagttatcgtcattcaaactttaaagaacgacgcacattgatgtcaactttcaccccat

SEQ ID NO: 22587 - DNA, 1177 bp, Oryza sativa
aaatctgaactgttgtcacatttaaacttgttttcaaatattgttccctccattcattttgacgagctaaccgttctaacatattgagcagaggattgggatatagtttcatgagtttctcttagtgtatttctgttatcttatatgattatgcatcttttcagggaaggactgatgacttacaaacagttcatccaagttcttgaggatgatatttcacctgctgaagctgagaaacggtaaatgcacaacacttactgattatatctttgtgctacctttttagtattgatgggctatgtctgtttaaaaaggtatcaagaatacaggacagagtacatcactactcaaaaacgtgcttattttgaccttaacaagaatgatgatcggtaagtcaaaatgatttagctgtacacaactaggaacaaaaatggtccacttgctttaactgacatttcatttgctttcacttgcaggttgaaagacaagtaccatccgaccaacttgtcatctgttattgacaggtggagttgaattcctttttattgagcctgttcccttatgcattcataaacattattatgttgtggaaaaaattttcttgcagaacaataccctttatactgctcatcttaactccttttacatttttgttaagtaaatttcagaaaactacaggtgctttgaccaaattatcacaaaagtatagatttaaggcgctgtatcacaaaactacatatttgatttcgaagttatcacaaaactgcagatattacaatttaaatccctagtactactgttatgttagagttataaatgttgtagtttcgtctaactgcaacttttccatataatgcaggaggaatgatagttgtaaggcaacagcaaaggatttctttcatgatttgcaaaatggaactctggacctgtgagttatatctgcacagcttgtgttatgatgatcttctggacttcttgtttataccttgattttttactgagcagtggccctggaataactgcggctgcagcaagtggcagtgatggaaattctgatgatgatggagacagtgacaagagaagaaagcatggcaggggttcctcaaaagaaacagaccctctttctggtgctcccgtggctcatccagttagctctgaatctcgacgggttcaagtt

SEQ ID NO: 22588 - DNA, 2250 bp, Oryza sativa
tctaatacaaccaatattaatgccgctgactgggaaaagaaggtggatactttctggcaagaaaggctgagaggtcaggaccccatggtaatattagcagccaaggacaaaatcgatgcagcagctgtggaagttctggaaccttatgtcaggaagataagggatgaaaaatatggttggaaatatggctgtggagctaagggttgtacgaaacttttccatgctcctgagttcgttcacaagcatttgaggctgaagcatccagagcttgtgttagagttgacttccaaagtccgagaggatctctatttccaaaattacatgaagtatgtacatatgattttctgcctgtgctacttttttttaaggaggtgttactgatctggatgtttctttatgaacagtgatcctaatgcacctggtggaactccagttatgcaacagtctgcaccagtaagaacctcatactctattacttgcttaaataaaacagaacaattctacaagtgaattccatgcataattacataccagtatatcacatatgtgctatacacatgttacattataacttcgaataaaagttccctgcaaaaaagaacttcaaataaaatttgcttttgcttttatcccagctgcttcctgtaggttgtttctttttcatttgtcagtaaaccccagctcccttttaagaataatttgtatgcctgtgccttttggttactagtttgtgtacacatggaccatataccattccacccctttgttccttctacagatttttccttttaggtgctaagcctacattagatgaactatacggtatcagtcagacagtcacttatgtggcctaaccggtgacgtgagagttaaaggagggttggcttatttgagggaatgatcaggcctggacagaatcagtggaaggaatctgactaaagcttttagtgatgggtcaataccctactgaagaatttagctgacacttctctaagtatcattaatggataaatacattgagtgcaggtggaaactgcagttacatggattcattgaaatccttgacaaatatttatacttctgatttgcaggacaaatcaagacagagacctggtatggataatcgtctgagatatgaccgtgccaatcgtagagaatatgatagggcagagagagatggaagcagatatggtagaggtgatcgttctccaagtcttgatggcgctgatgatcagatgtttgatgctttccgtgggcgaggtccaaatgctccttttgttcctgaacttcccgctccgccaattttgatgcctattcctggtgctgggtaggtgctgtgagaagatatgatttcaatttttgttctgatagtataaaagactgctaatgagcgtggctggttttattttcagtcctttgggtccatttgttcctgcacctccagaaatagccatgcatatgctgagagagcaagggccgccacctccatttgaaccaaacggacctcctcatgccaacccaggagtgcttggaccaatgatgggtggtcctgcgccaattataaccatgcctccatcttttcgtcaagatcctcgccgtttgcgaaggttagtaattattcattcataccattgaattccatgatgtctattctcctattttgcttggattggcttgattatgccacattctgaccaacaatttggccacctagggcttgccaccaagccttacaccttgctttagtttgtatatgattacttctactcgagggcttaaccatactgtctttattatcatagaggcaaaaatagtatgttgatttactgtgccattgtactatattttacaaccggcaacttaacccatccatgatgacgattcttctgcagttacaatgaccttgatgctccggacgaggaagttaccgttcttgactacagaagtttgtagagcttgccctggtgtaattgtaatttgccaatcacaactctagcatctccggtctagtctaggttggtgatgtattctttttcagacataggggatgtcatgaacaatagagcattttttgaggtgtaatgcgtcagaaactactgttgtaatttcaaatggcaacatctgttattgaactgtgcaccacgtgcacttgtagtcccaagaagtgttgaacgcagtttgataaaatgtaatttttgagactttatatgacaacgttttagctgacaacattttacttctccattggaa

SEQ ID NO: 22589 - DNA, 808 bp, Oryza sativa
  unsure (1)..(808): unsure at all n locations
gcagtggtgcggttaacccaaaagccgccctggatcctggccttgttctggatgcaagtaagttaaatttttcgtatgcaattttttaataaattcaaactgctccatgttattcagacaataatctgaagaccattctaagtttgaatttttttttgttggtagctcatcaagattacatcacatttttgtgttcgatccccgacgtggaacacagtgaagtatcaaacataactggttcaacttgcagctccagctccaaggtgcagcagcgcccctatgatctcaacatcccctcaatcaccatctcccagcttagaggcacgcagacggtgaagcggacagttacaagcgtggccgccgaggccgaaacctacaccatcatgacaagaatgtcgccggagatcgcgctggaggtctcacctccagcgctgacagtgctccccggcgcatcgagagagataacggcgaccctcacggccaggtcagtgactggcacctacagttttggagagatcaccatgaaaggggaccgaggtcaccttgtgagaatcccagtggtagctatgggatttaagtagactaatgtaagtggctccaggtgagctagagctatgtctgcctctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22590 - DNA, 550 bp, Oryza sativa
  unsure (1)..(550): unsure at all n locations
caataaaaggcatccaaataccatattggatcttctaattatttaaataccaccaaaaaaattcatatattattagcctcgttgaaagctcgagctcggctcgacaaagctcgcgagcttaggaaaaggcttaggctcggctcgtctggagctcgagccgagcttcgaatcgagcagctcgcgagcctcgagtttttttgacagccctatagtgaagagagcaaccgggtggcaagtggtagtcgacgatgaaaacatggaggggtgtagcgacgtggtatagagatgggttcgacgttgcgcagtagcaaccatccatcatctagcaagcatgaaaaaaatgaaaaaaaaacattctcgttcatgtcataaggacgacgagcaaaaaaaaaaaagcaaacaacctccatcaccagcggactataccctatcctctgcggctagcaatatggagcacgatgtgcaaatgtagggcctgtgcagcccatcaattcannnnnnnnnnnnnnnnnnnnnnnnnnnnnnnnnnnnnnnnnnnnnnnnnnnnnnn

SEQ ID NO: 22591 - DNA, 1040 bp, Oryza sativa
  unsure (1)..(1040): unsure at all n locations
ccggctgccctagcaagaaagctggtcaattggaagtaggctaaatgaatgaatgttgctggggacgttgggccagccgcaagtggattggacaatttggacaagataacccttctctctctctctctgccttgtctcctctctactcctcagcatctatataagggccttgcaggcagtggctctcacaccaacgaaacaaggagagactcagagaggaggcgtgttggttagctcattggcagcagcacacacaaaccacatctcctatatatagctcatttttagcttttggaatttgagagaggttttgagagaaatggctagccaaggtgtagcctccatgttcgctctcgcattgctcctcggtgcctttgcctccattcctcaaagtgattacctttccctctctttccttttctttttctctctctatctctcttttgtgtttttttttttcgatttgttgcatgtttggaaaatcattaggtatatataagttttagtttagttcatgcactcgctcacgatgcagagtctggggtttaattttattctattaccaaaaaaaggttttgtttacgcacgtcatgcatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctcccctgcagtttcggtgcctgtcgctctcactgcgagtttaattattctcttccgctgcttaattgctgctgctgctgctgctgctgaaagaaggttaattaagctcgtctcgtgccgtctcattttgcccatcactcacacgcatcgtcgtcttcgtctatnnnnnnnnnnnnnnnnnnnnnnnnnnnnnnnnnnnnnnnnnnnnnnnnnnnnnnn

SEQ ID NO: 22592 - DNA, 376 bp, Oryza sativa
  unsure (1)..(376): unsure at all n locations
ggcgaattcgagctcggtaccctggttgaccgcccataaccgcgggcacagctattcgaatagttttactctgatcagaggtgtacaattgtacccacaagacacagccccacgacacgtttccgtgtgccgacatgccaccacgacataccggaaagaggccgtgacaggacccttcgcataaccccctctaaccaaacacaccacacctcaggtttcacccccactcctcgcaaggcagcgggcagtcccctctcgtgccttggtgaatccggaagccgcataggccgtcgcagggcccattcaaactccatcannnnnnnnnnnnnnnnnnnnnnnnnnnnnnnnnnnnnnnnnnnnnnnnnnnnnnnnnnnn

SEQ ID NO: 22593 - DNA, 760 bp, Oryza sativa
cgtgttgtttttggtctcaacggcatttgcagcaatcagcaccggtagttagttgcatgaaaacccatatcgtaactgctgttggagagtaacaagccccaccacacgtgggccgtagcgtgtcgatcatttcactggaggaataagtttattataggtccctcaaccacgagcccctcgacatggctccgggtcgatcggacggtcgctgctccggcgcacggctccggcgacggcgggagggtgccgttgatgatggagctgcaggagtacgtaggcggaacgacagtggacgacggcgcggcggccggggacgcgcgccagcctgaggcgcggccgtggaggaccatgaggtcgaatagcatcggagaaggagcgcacggacaagggttgcaacgacgtcccttggcgccggcgaggtgtccgccgcggaggccgaggccgaagacgcggagcggaggaagggagcaccgcgcccgcggcggcgatgggagaggatgtgagaaaagaggaaagagatagagggagagggacgctgacatgtgggaccccacgatgactcagcagtgcggactaaatgaacgtgccatgtcagccaaaaccacttagggagttattttgcgccggttttaaaagttaaaagttttaggggttaaaatacctggtattagagttaaggatacaaattagattattactagccacctagtcatgcttcgcgtgacggtaagcattcgcataacctgcgtatagaagttga

SEQ ID NO: 22594 - DNA, 856 bp, Oryza sativa
ctaagttagcttaagccccaggggaagaagagtgagagttctccctagagtttaggaacctttgtaacactcaaccctaaatcccacgcacaggagtagggtattacgctccctagcggcccgaacctgtataatcccagctctcacatgcggtctcgaaagactctaggcggatatacgttcttgatcagcgcgccctttcccccggccgaactcacaaagggggtccctcgatcacccgctagagaggatcattcctcggcactaatcacggtgaatctggtcgaccgcccataaccgcgggaacggctattcaaatagttttactctggccagaggtgcacaactgtacccacaagacacagccccacgatacgtttccgtacgccgacatgccaccacgacataccggaaagaggccgtgataggacccttcgcataactccctctaaccaatcgtaccacacctcaggtttcgcccccgtccccagcaggcaacgggcggccccctctcgtgccacggtgaatccagaaaccgatcaacctgttgacgcaaaaaacacacactggcctaggagatctgcttagctctagtgcatgtccaaatcttggtgaggtgcgggtgtgccagtcagtttgatcctacagctgacaagatatgtaaacaacagatcaaacagccgatcggttgtcaagccgatggagtaattccagccgataggaatagggttttgaactatcgataatatgtccaatgtagataatgatataaaggcagtcggctgatgatgatgcaatataacagtaatataatccagtagaaaccaatcaactaacaatatgatatgatagaaca

SEQ ID NO: 22595 - DNA, 990 bp, Oryza sativa
catgtcaaccaagattggttgatgtcccactcccaaacaatgcattgtctgctgttcaagctacaacatccgaagtgtcaaaactgatcatcccaaccaaccaatccttgcagctccatgatccaccctctccaaacgaaaggaccaagaagacgctgctggacagtcaaaaaagctgtcgcatgcggcacatcccttgtgtaatgaggatggccaagttagcgcaccaggacttcaggggcagcacctagcactccagagagaacaaatggtgggcaccatggtgcaaggaggccttcaccagtaatcatcatcgtatccagaccaccgtgagcgggatccacttgatctatttgactgccacggacgagggttaaaacccctatcatactgtttggtgtaccgctgttcaggggacccgtgcatcctccctcccttggagactctttttgtagcattcttaaattctcttcgatatcatattcttggcgctgcaaaaggaaatcaggtgaactttgttttgcaggaaatttaaattaaaaaaacaatggtcattttataacaaaatgaaacttcatatttctgccatcaataagcactgtagcattgtagcaagcacatccaaattttccaaaatatggtaggtataggcttctccattactagtatgtacccagagtctgctcatagtggcattgcccattattattattatttagagagaatgtgcaggagcagtaaagattacagcatccacgcatctagatggtggatcaaccaaaaagaaaagggaagatatagagtaacagagctatattctcacaaagtatctggcgacctaaaagcatccttgcagaatgtttagttgaggcttaaattttgcaaatatgttaccaatgctatcttggaaacttccaggtatgaaaataatgaattggtcgagatttgatccattgaaaaaatctacgatgagtgggggatcctctagag

SEQ ID NO: 22596 - DNA, 26740 bp, Oryza sativa
  unsure (1)..(26740): unsure at all n locations
tcagttgaaagcacatgttcctgatcatacaccggtctttacttctcttcctcaccctgtggttttggatgccgctgacgtttgacctgaagaaatactcgatcgtcggcttgtgaaaaagggcaatgcagcacatgttcaggtgttgattaagtggtcttctttaccggcgcatcaggctacctgggaggattatgaagtgctcaagacccgctttccatcagcaccagcttggggacaagctgtttctccggcgggcggtactgtcacgtctgtaccacacgcgtgacgagctacaacgccaggatgacgtttacagtaacgtgtcggatgggtgtgtgagcatgtgtgttgtgtgattcggccaagcggccaggctggcatatatgacctttataagtaaggaaccctgtaatgagataagtgtgaaatgaagaaaggaaaaacgaatctctcctctcaacaactctgctctgcccctttcttcctcgactctgtctcctcctcctctgttcttcacctctcctgctctagttctttctctgctatgatctagtagtgttacatataatgacatttatctgaatagatatatttgcaatggcacatatcaaattaaccctagatttttttttttgagataaccacttatgtacattgcatgtgaggttggactaaacctcttccgcccatctgctgcattgcgtgtcttgcacgcatgatccttaactcgcatggattattagttatgtgtacaaattattttcaaaaaagaaaaagttgtgtacaaatttgttctgagttagacctactgcctactggcatctcaaaccttaacatttcctgctttaatgtggtacaaatttttgttttgcgcttttgtttttcacttattccacattttttctatcgaattttgtatggctgctagcttgtataaccctgagtgacggtgtctgaacaaccattttcctaactcgtacaaagcacttcctccgtttcacaatgtaagtcattctaacatttcccacattcatatttatgttagattcattaacatcaatatgaatatgagaaatgctagaaacatttcccacattcatatttatgttctatctatctaattcattaacatcaatataaatatgagaaatgctagaatgacttacgttgtgaaacggagggagtatatacacacaagccattcggaaggtcctgctgaatcctaaaccatccgcaagtacggaggagggtgtcaaggctgaaggtcatactccgacattagaaaaaaatcgagtactaacagaaaaggttccaataagcacgctggatattgcccttcaaagttcaaaccaacacttcagcatggttcttctttccttgaccagaacaagtgtagcgaagaacaaaaacgcattcaacaacaggcaatctgcataaacttatacatcatgttttctttgttgcccattgagaggcactcagcatatggtacatcatccaaattgccggtcaacaagaaaacaaaaccctcaacctcggcacacgcgacagtgtctttcgtcctactatcttcaaagaatatatcttgcaccggacaaaactatatccttccacgtatagggagcctgacatttatatccttcatgttagcatttgatgttggtgttagtgttcaggcaggctcgagaccatatcatgtcaaccaagattggttgatgtcccactcccaaacaatgcattgtctgctgttcaagctacaacatccgaagtgtcaaaactgatcatcccaaccaaccaatccttgcagctccatgatccaccctctccaaacgaaaggaccaagaagacgctgctggacagtcaaaaaagctgtcgcatgcggcacatcccttgtgtaatgaggatggccaagttagcgcaccaggacttcaggggcagcacctagcactccagagagaacaaatggtgggcaccatggtgcaaggaggccttcaccagtaatcatcatcgtatccagaccaccgtgagcgggatccacttgatctatttgactgccacggacgagggttaaaacccctatcatactgtttggtgtaccgctgttcaggggacctgtgcatcctccctcccttggagactctttttgtagcatttcttaaattctcttcgatatcatattcttggcgctgcaaaaggaaatcaggtgaactttgttttgcaggaaatttaaattaaaaaaacaatggtcattttataacaaaatgaaacttcatatttctgccatcaataagcactgtagcattgtagcaagcacatccaaattttccaaaatatggtaggtataggcttctccattactagtatgtacccagagtctgctcatagtggcattgcccattattattattatttagagagaatgtgcaggagcagtaaagattacagcatccacgcatctagatggtggatcaaccaaaaagaaaagggaagatatagagtaacagagctatattctcacaaagtatctggcgacctaaaagcatccttgcagaatgtttagttgaggcttaaattttgcaaatatgttaccaatgctatcttggaaacttccaggtatgaaaataatgaattggtcgagatttgatccattgaaaaaatctacgatgagtggcgcatgaaaatattactcggttaccacttttcataagcatatttaattgtttttttgctttaccttgtcagagtctgaaagaacattataagcctccccaattgctttaaatagatggtcagcatctgcatgaacctccttggcgacatccctccaaaacccatcatcaggcttttcattccttactagcaattgtgcagcctgcaggtcaaaatagtgttacagatgctttctgtgtgaatccaacaagaaattctctgaaacaatgtaaaccttatctgggtgatgcctcagtgcagccttccggtatgccttcttaatatctgctggagatgaagatggttcaattcccctgcaaaagagggggcaggagagaagagaaacaactaattaagctatctccacataataagagattattaatttgcttcgtctcattaaaatatagatgattcgccaatagttagaaagggtgacacccaattaaaataagatcatacaagtatgcaacataatatgacatgagcagctgtactcatcacaatggagttgatgtcctaaatcatgtgtgtgactgtggctagatgaagtagcaaagtattgattctcctataaaacagctgtcttgtgctatcgagaaaatctaatccaacacatgcagcagtgctcttggcaaggggaaaaaggaatcactacattatagattctagattaatttgttccactagatcaatgagaacagtaggtaaaaaatcaaatgtcagagatatgcattgaaagcaaatattaaggttggttaaaaacctgggggcaaaaacaacactttaataaacaaaaagaaggtaaggttaatttagaaaaaacttacaagattaaatacaaattcaagggagtatctctttttgcttcatcctctacagataaaagtcgggtgcgcgcctgcttcagatcgctatgcttgttcaaaacttttggtgacaatccagagttattagcttgcttttcaataagtgatatgagcttccgtaaatcattagcagcttgtccataatccctgatcatttcgtataaggtggctcttcttgaaattgcctgaaattaagaagccattaatgaaatccatgcacaaccacataaggctaaaacagtccatatataataaatgtatcacatattatgcatatgtaaatgtgtgcaaaatgataactgtgtatcataaaacaagagctactgcactttaccttcagataagttgcatcaagaaccatggctagtgaacaatctgctatagcatcagtaacttgaccgagtgcttggtatgaagcagcacgattgcaaaaacagacagctgaaaaggggcgtgaatcactattacgtgccaatgctgctgaatattgttctacagcctctgagtatcgacgagcttgaaatgcttcattcccagcagcctaaaaagcaacatgagcacaaaaaatattaagttatcattaacaaaaatgaaaggctatctaatcggtttcttgctcattctgtgatgttgcgtcaaacataggaaatagagatgcactcatagttactaattatcctgggagtcaataagttgtttatttcttgcacatcctactcagtaaaacagtagaagttgctaaagttgaataaaaaatgcagttctgactgcaagaaagaaatcatgtatcgatatgatagacagcaaagtactgtcacttcaaaaattatgcaacatttcctgctgagaaatatcatattccttaaaaccagaagggaaaagcaattatagttctggacagagcaaatttaaatattagaacagactcaataaagaacataggtagatatgacaggacaaatatcatcaaagttcatttcccgcaaaatatgttaaacaaatggagcataccttatgggaaagaagttccctaatggtagtagacaaagatgagaaacattcctgagatgttctcccttcactgcaagagtagccccattcaggagttaaatataacaagaaaaacttacaaaggaaaaaaaagaaagaaatgcaactcataggacatgagaaatttacctctctttgacatttgtcacttgctggtgcttatttagcaactcgagagcatcttcaagtttgcctgaaaggaagtaagtcttgcaaatgagatatgtccgccagagcctccctgaccattccgtagtttcagatgcactggaattcttttcagctaacacaactgtttcctggcatagttgaatgacttcttcatatttccgtagctgtacagtgcaacaaccatattagtaagcaggaagcactaagacatacaatagtgtaatagttcacaaaaaaaacatggatataaaacagcgaacgagaagaaattacagaccgtcagtagcgcctctgctttcatctccattagtttatctgagtgtgaacttatgtgcaatgcattggagataaattgtaaagcagttgttgcttcggacactgttcttttcttaagaagttcctccgatagcgatatccaatccaccacactctgaagtatagattaaatgatgtcattgtatcaacaaggtatgatgctataacaagcagaaaaagaatacttgttttttctcgaaaacgcaggagagctgcatttcatttcattaaggggaagaaaaaacaatacaaaaacacaacacaaagaaaaaaccaaagtaggagtgctcgagccctcctaccaagacccacacacactagacaacccggggagcttagttgcctagattagccgtcccactaaggagcttttgaaggtgagaagctccagcgacaccccaaagatggccctcattttctatcacttgcaagaccgtcgctactctaggattggcgttattgaaaacgcagtcgttgcggtgcttccaaatctcccaagctactaaggttaccaaggagttaatcccttttcagcacctccttcggccggttctttgttgcttggctccaccacctcagaaagcggtcggtagagggttgaggcgcagcctcggctaaccctagtctcaaaaagattgccgtccaaacttggcgagaaaaaacacaagagatcaaaatgtgttggatggattcttccctttgatcacaaagggggcagatcactgtgtgctgcagcccacgcttagctagacgatcggctgtccaacacctattattgatggccagccaaatgaagaatttgcaccggaggggagcccaacacttccaaatacgtttccagggagcaaaatgaatcgaacccaagaaataggcttcataagttgatttgcaagtgtaaacgccatctgcagtaagcttccaaacatgctgatcctggacatcttgtagcagcaccacctcttctactagatcccaaatggccaggtactcagcaagaagctggaccaaaagccccccttggatgtcagcaacccaacttctatttgtcaaagcttgtgccacagaacgttgctttcttgctcttttagggattaaggcgaaaagattaggggctagctcagcaatcgtctttccttgcagccatctgtcactccaaaacttggtatgttctccatttccaaggatagttttgacagccacagcaaaaagagagtggacatttttgggcacattgatggataaaccggcccaaggcctagatgagtctgttttatgcagccaaagccatctcatgcgcaaagcccaccccatcttttcgagattaagaataccaagtccccctaaagacaggggtcgacacactcgatcccaagagaccaagcagtttcctccatttgcattgtcactccctttccataaaaaaccacggcgcctcttgtcaatggctttaagcacccatttaggaagatccagtgccatcattgcataaatagggatggctgaaagaaccgccctaacagctgtgagccggccagctttattcatcaaggaagctttccaacccgggagattgtccgctactttgtccactaaaggcagcaggtcagccttggttggtttccgaattgtaagaggaagcccaagataattgcaactcaagtatatcttaacaaaccgaggtaatatcaggtgcaaacagataattttggcagaataagcatttactaccaattccttccattctaacaatgacaatggtttgcttacggacttttggtgtctggtacagaggataacgactggcatcccttggatatcaatacaaggcaatgactagtactccgtgaaagcacagtcatcattcgtcaataaaataacttccactaccagaatagaattcctttatattatcatgtgtatttagtccctatgatatcctcttttattggacataatggtgcatgtgaaaatgattaaacagaaactggccaccattaagatgttagatgtgcaaacgggaaagagaacccaatagtgcgagcatcagattgatcaacagattaccagtgttccgcggtgatgtaaaaggctagataatagagcctgctaatacagtgatatgaacagaatgatattggaaatatagtaattgcaacaaagatcagaatgttcatgaaagctgtatactgaatttctatagtaagacatgatgggccgtagttgacagctcttcctaggatagtaaagacaaagataaatcttcgtagaccattactatgtaaaagtctacgaaggttgatcatctgaaatcagtataattagatttgtcgtgaaaaaacttcatatatcagtgggggtggcccatgtataaaatgtcatacacttcatcaagggtaccttttacaatcctaattcagaatttttttttcctaattttcatttccggcaaactgtttgctaagttgtccaactaactgccattaatcgctcggtcggtccctgagggcaattttaggccatgactcaacatgaacacttagttggtcaacttaagattctttgattaatcatcacgtccggaagaaacaccaggaacagatcagctggaagggacaggaaggcagaggaaaggaagggggagacagaagaggttttgctgtcatggcgtcatgactcatgaaacaacaggtaaaggtggtactagtgattgatgcaaacaaaaaaatgaagagaaaggaaggaaatgatgagataggccaatccagctcagatttcagccctcaagctatgaagttcaccacgtctatacccatgacactgacctctctcttgttggctttctcctcccaacatcactggacagtggacactccttaatatccatatcagctttgtcctgttagtcggccagatctggtgaccatgcaaatcggggtaggagtcctgttagcaaactgtaggactgtataagatccgaaaccaatcttacggtccaaacagccactggcaagctttggagggtgacagaggtgtagttgtgtagagcggactgcgggagaaggcaagaagcagaaacagaagcagcagcataacaaagaagtcaactgcaactgtgcaacagtggatggtagcacatcgcttcacgtcctacttaggctacctttctctctgctactctacttactcaccatcagcagtatagtatacttatcaggagctgaaagccaagccattaccagtacctagtcaacaagttgacctattaatgactatttggcaaattgcctcctagggactcaaaatttactacttactcccaagtaacgactatggctgtagatggttatatgaaccacaccactactccctgtaaaactattctttgcatgtgttccactaaaagtcaatttttgtgaggtgttgattaaagtaactaagaatagttagggcttattcggttcataggatttccaaatcataggaataggaaaagtaaaggattaggacgacacatgcactccaatcgttaggaatttttccaagagctctcacctcatgcttagaatcctatggaataaggttgtaagactacaatccttaggaatttggtactccctccatccctaaatataagggattttggttagatgtgacacatcctagtatgatgaatctggacataaagcctgtccaaattcattgtactaggatacatcacatccaaccaaaatcccttatatttagggacggagggagtaggatctatttctatgaaaagaatgatgcacatagaaaaaaattaggttcaattcctacaataatcctttggaaatcttttaaaccgaatgagcccttatagttctaaaaaacttaataaataacaaattagtaattatatattctttgaaatttccataaacgaaaagtagatagcaaaaggaacaaaacacatggatagtaattaacacaaaataaagaacttaaagtgatccctgagcagaaatatagcacacctgaactctttcaagaccatcagaagcctcagcgagcatttttctgtcagaaccagaagtcttactggacgttaaacaggcagtgtaactccttaatgcatcttcaagatccccgagtgcaagttgacagctgcatccatatacggtaccaagttagataactaaatcaatgagtcccatcacagaaacggctcaattcctacaggaatccagaaaaatcccatggcccagacaaagttctaatgggcctgacagagtgatagtcaaaacagcatgggttatacacatgcataataaaattagcctacaaattccttagaattccttagaaggtatgaaggtggtatcttcaatcaaagtaacaagagtgaataacctctccagagtaatccagtacaacataaaggcacatgtttcaagggaaaaacatcagtggactacagttcagtttctccaaagcatacattagttatatagtgaatatttgaatattctaattaagacagtactaatacacctggaacatgcagctctggttttacaagtatgcgcattacaaaagtatttagatatctattgcatcatcttccatgataaaagcagtacattccactatgcagggtgcttaccagaaaaagaacatataagtgcaccttgttcaaatgaagttctcaatcatactaattgatttgttatcactgaataagatatactatttcgtttaaacattaaaagaattagttgggttgctgtagcaacttcttactttgcagctctaactttagccttgagaaaggtaggatcaattgatgtagcaatcaaacaatcctgaagagcttctctcattctcccgagagacatcctggtagctgcacggttgctgtagcaaagcatcagtgcacgggaacagtatccagaagaatcatgaccggaaacagaatttattccacgggtataatactcctccgctgtagcaaagtgaccatttgtgtaggcttgatttccactggccaaaataaaatgaaaagatatggtatatcaaaatcaaatttgaatgatcacataatgccatgtaaaaagatatatatgacatgaaaaagacaacaacagacaaacagaattaaactgtgttcatacaaaccttgtacgccaggtttcacaagtctccaaggctgcagaagttgatgcacctcttgttgactgctcatctgctgaatcccctgctttatttttttcaggggaaaactgcatggtctttttgtcttgtgatgattttggctgtacataagcctgagtaactgaaggcttaggcagttgaccagacttagttcttaccttccttctagtgttacgtctttgtgttgacacggagctttggggagatgtagaagcaccgaaggtaaagttcagcccactaaaatcttctgagctttcttggaaagtggcatgttcaccaatctcgtgcgctgttctgtagccattctcttcataggcttgcccttgattgttgagcctataagcatcatcccaaacttcagctggggctgatttaggtttaccattagcagtgtcatgcatattggaggaagaaggttgtggtgcgataggtatagttacttcttcatcaaaactagaaaagctgctagcaaagctgttcgcagatgtgtctacattgggaattctaccttcatcttcgcatgttggaagatctgcatcaataaccaagtgctcagttgcagaaactagatcttcagcacaactggagctctggtttgagacaccataatcatgtatatgaacggactgatcagacatcactgatgcttcttttgctacctgttcaactgtagctgaataaggagaacaatccattggtgagtagtcacctgctaaatccatgtctggcccagtggtgcatgtttcttgagaagcaaagtgatggggttgagcatgctgctttaacttggtgggccttttatttttccttgcgtttttatgcgcttcctttttatctctatatgctgattttatatagtcaataccaaataagctctctcttgaacaccaggctggctcttgtctgactgcacaagattcaccaggaatagtatcacttgctgtatttgtagttttgaaactgaaagatggcatatcatttccagaagtagagaagctagatgaatgatttgaatgtgaaaatgcgcgtgactccggaacattgggctggggaatagcaccaaatactggaatggcttctgctttacttctgaacacaaattgggaagatccattcactttagtagatccgactgaagccccttccctattgatgtttaatttcttgatgtcctcttgtaatgcatgttctgcatatccttcggaaggagggacggcattgctaccactactgaaaacaaaactactaggcccataaccttgatcattatctgatctagaatgtgtaatgtttccaatatcctcattagccaagttccctccattaccctttagttcaaaggatacattagtttgaatgcttgtgaatggcatgcttgctgcctgggcagaagaaaaggttgtggctgcattagttccaaaaccagatacttctggtggctggtgagcagtttcatctttattgttgttggatggggctccatggcctaagttcagttttgtcatcctggctggaagtgtgctctccatgttaccatgaactgaggtaaatgcctttgaatttgcaccagtgacaaaattgccacgatcgtccattaccttttttgaagagtgtgagctcaaggaagcatcacttccaaatacaaatgcctctgatggataaccagaattatcactttgtttgcactgtgtaactccacctcctatattcaaacatgatggcaactctggaggcaaattattaacactactaggtggaacaaaagcatcactgttggcagcagaggaaaaaacactgccctcattagaagtactcccagagacaaacgcttcggcttgacgactactacctccacttcccttctgctgaaagggaacatcacttatcttctcaggacacagacctgtgccatcagtaacattgaatgtatcagatggattggtattagcaccagaagaaacatcattagtcctatccgcatggtcactggatacgttccctccaaacacaaaaactggtggtgcatcattggtagattcagtgcccatccttcccaaaggcgcttgattgcctataccatattgtgtcagcttctctgcaacaccatttgcattggcagaagcatatgaacctgcacggtggacatcagaactagtaccatcagaagaaggcccgcttccattgcctccaaacacgaatgtttttggcacgtcattatcaccctgcaacggcactctggtgcctaaattcaactgcgtcaatttctccgggagcacattcacttcactgttgagaaccaaaccaggtatatcaactccaaaaatggagctcctatccttcttgttggcattgacgctactctcaccacgagtctgaagattcatcctccccattttctcgggcagctttgccgaaagccgcccatccctcgtcgaaccgaggcaagctgtccctgacgctcccgaacacgaagggggcttctccattggatgacgccactggaggctgctgactcgtggcagaagccgcaccgccaaacacgaatccgccgtcctgaccctccccggcgccaacaccaacgccacccggcgcgatccccccgatcccatcctgccccgatgcgtccgtaccgccgccgccccctccgccgaacggattccacggcgccgcagcgggtgacgccggtggcggctggcgggagcgggaggaggccgccgcgtggcgccgcttggccagacgcggggcgcggcgggaaggaggaggcggtcccgcggcgtgatcggaggaggaggcgaggccgagccccaggttggggttgcccatggcggcggcggggagcggggtgccgctagggttctggcccgtggtggggtagggggctggcgctgctaccgccggcgtcatcggccggcggcggcggcggcggctgcggcggcgtgggattggaggggaggggagggtgttatgggtgggtccgatttgggggggagaagcggaggagggaggaggaatggggttgcgtggggaacgcggcgaaggcgatgcggtgcgggagagaggagaggggtggcggtgcgtgtcgcgcagttgggttgggcctattctgttctgtgtgttggggattttgaccgtttgggacgtgtccgtaaagctgtggacgacgacgatttttttgaatttgggtgcggtggggtggggttgcctggttttttttgtttgtttgttttgtttttttttcttggaggatgaacaacaatgaacccgtttgttgattcgtttttaaggctgtgttctttttgatagagttctcaacccaccgctcttattttcgatgtgcatgttttctaaaatattaaacatgtgttttaaaaaaattctatacgaaatttgttttaaaaattcatattaatttatattttaaaaattagtaaatacttaattaactatacactggtgattcgctctattttacgtgtataggaatcgtgcctcagataagatgtttggtttggtgagattttcttatgcggatgtgcacttcttttatatataataaacaagtatgcacaagaataagtttggcgagaaagaatgcaaattcagaaacagaattatcttgagagttctatatactaatcatgagagaattttatatttgtccccagatgttaactgattctcttatttgccctcgcaaacttgcctctccctctatttgtccccaattcaaaaaaatgtacatggcttgcttgctgttagaaggcacatgaaaggataattttgcccttgtgatttttttatatgacttactaaaccttgttgaataataatttgatttttttaatgtagggattaggacgcatattagtattagagggtctgtttagatcccaccttaaaattttacaccatatcatatcaaacgtttgaacacatgcatgaagtattaaatataggctaaaaataactaattgcacagattgtgactactttatgagacgaatattttaagcctaactgctccatgatttaacaatatggtgttataggaaacacgtgctaagacgtattaattaggcttaataaattcatctcgcggtttactgacggattctgtaattagtttttttatcagtgctcgaacaccccatgcgacaccctatataataccggatgtgacacgccaaaacttttgacccctgtatctaaagaccccatagtaatctgacattgcctttttttttcggggcatccatgtcggataggatgaattgaaaaataaaaacagccacctggtcggaaagtggaaaaaagtgacacatatgtgagagaaattagtggagatcaggtggcaaatgggaaaaaaaattttaggagggtggcatttgagaactagttttctgaaaggatgtcaaatagtaaattctccttgatgatttcaagtaaggcaataatgaatgtaaagtactaaaatatttatatttcttaatgattaagtttgaaggaataatgaatgtaaagtactaaaatatttatatttctaaatgattaagtttgtaatagttagtagttagttaatcacttgctaataagttttacatgaagcagaatagcgcaactaaacctctagttcaaatggactctaaggctaagttcgaatgtaagggttcgaaactccccctccctcacacacgcaaaaccgtaatgacttactagcacgtgattaattaagtatttactaaaaatttgaaaaataaactattattattttttacaccaactttgctatagaaattcttttgtaaaacacacattgtttagcaatttaagggtgcgcatgaaaaatgaggcaacatatcctatgcacacaggccctcacgtgtacaccaactaaaaaatgtcaccaaaaaaatctagaaaaaatcatacacatactttcaattgtattacacctagggttaaaatcataacgtcaaattcattatattttagccgtaacaaaaaaaacaaaaaaatcagacagttttaaggttgcaattttgtcagaattttatcttttttgttattctctatgtagaataaatttgaagatgcgactttgcacgtagatgtaatactattgaaagtacatgtatgaatttttctagaattttttgtgataatttttagttagtgtacacggtgtgtacacgcgagggcctgtgtgcataggatacgctcccgaaaaatgaaggggcaaaagttgggacctaaggcacccaaatgaacgcacctaaagcatctgttgagggttgttaaataccaaattaatgacgtcaatacctacataaaaccataaatataaaacatacaacatagcggtaggatttatttctaacaattttcacgagtgttggtgtacatttgtatgcaggaggcaaacaccaaagttgatataaaatatacattaaggaggaggagaatcaaactcaaatccaaacttatggagttttggaccaaaaacccaactgaacacctccaaataggccaaacatccatactagtagaatgaggggcccaaaatgagtatccatgccgaaatccggggccaacggagctggccaggggttcgcccgaaccctgacacaggccgctggcccaagcccaagttcggttcggtagcaaaccgcttcccaatgacggttatggtcgttttcaccggtagaaaccgttatcagctggacacttgccaagaggagaagggagatgctttttggatgcttaagcatctccacattcccaaggcacctctaggcctataaatacccctcctctctctcatttacaacacacatggagctgaattacatgagcctctattatatcttttgtacattataaaataggtagagagtgaggggaagctctggaggagtacccgaaagtttggcactctctccaacttctaccttttctaggaggaattctggaggagtaccagagctgtcggtacactctgctccgggttcggagaaacttcttctattaagtaagcattcaggatctttttttatgttatttaatttcttagtctaagtgagatagattttcatctttacgggttcattgtttagtatccgtactaagtgctctagtactaggactttggataaaaaaggaagttcctgcgcaagtattagagtagtaattaataacttagacgtggtgtctaggttagagattacctttatttgttgtgtatcccactgatttgttagaggtagacggcaggtagtgacagccctgaattccgtcctagtaatcctccacatttggatatatcatagagttatagccggaaccatggtggcagaccaacaagggtcgatgcccgaagtaacagatagaaaattacctttacttagtgtagataattaaaacacatagaaagtccactctagcctagctagcctaccattagttgttgttcttggatagtcttagccttaggtagattacacgcgttccctgagttcggtatccttttggggtcacccgaaagtgaagtgctacagtggtatttcgtgtgtttgcaaatttatctgtggtcgtaagaaataccaatagcatccaaagtagccaatgtcgagcgaattcagatggctccacataggaacacatttatcaaaccaaaggcttgtttagaatcctagacatttataagaaactttattacaaatgccacatgaaatagtttgatgtgttcaattgccaagctataaaaccaaaagcctttttcatcaaaatccacaagaaaaaaagaaagaaaagcaaagcaaaggaaaggagcatctttatattcgaggaattttaaagttggtgcgcatgctaggccatcaattcagaactcgatgaataagtttgtttttggtccctcattttgacgtagtttaaaattcatccctgaactgcaataccatatataacacgtttcttaatttgcaaaaccatgtcaactttcgtcccaaggcagtacagctctcagtttcggctgatgtggcgctttaactccggttagctgtgttgagtcagcatgggacccaccacgagcctcacatgccagtgtccaactttttttcctccctttccaatctcttccccatcctctctaggccaatgccaagcggccaaaggcggcccgactgcgccgcttgcaccccaccacccatcgtctctctccgtcgtcgcgtcgtcgctgtatgagcgtctcaacggtggtcacatacttcttgcccccgcgccatagccaccaccatcaccatcagcttctaaattcacgcaaacggtggggatggggtcaagattttgagaaatggcacatcaatgctgaggaggaccgggaaggaggaggagggccctggtggcggcgacgatggctgacgaggtgggtaaggcaagtgtgcgagtgagcacgagtaaaagaggtgggtaaggcgtgcatacgagcgagcaagtgagacacggctagaaccgtcgtttgtctctcccctttcttctctacgtgcggcctgtcgcggctgacccaccagggcaccacgccccatggcttttccctctcctccgcagcgcgccacaggctacaagaggtgagcacgaggcgactagcgcgagatggctcctccctggccgccaccgctctttctttccgccttatcggctcaagtggccgtggtgctcctgagacgaggaggcgtctagccgactgcctgtcgggcgagttactccttgagaggtggctctcccggatccccgccgacggttggggcatgcatctcgtcagcctctaacggcgatgacctcaacgagatccccatcccttctcttcctcctcctccaccattgcccatctccacgctgcagtgcttgctcccgtgctgacaacctgatgtcgccaatgccaacgcccaagcgaagaggttggctagagagggagaaaaggatgtgtcactgacatgtagggcccatcattttttttatttaaaccaaattccctgacatgtgagtcctcgatgacacgcccgccatgtcagccaaacactgctctgggatctcgggtacactgagtttataaattgagagacacgttatacttgaatattgtggttttgggatgactttcaaactccaatgaacttattccgaactcgaccgatctgagcccaattaacatctgacccaggagcggcccataacggcagagagcccaagccgaaggcctcctcctcctcctcctcccccgtcgccgacggtatcggcgtcaccatgcggcgtctcacctccgctccgctcccctcccctctccatttcgaaatgggcgcggcgcgagagaggccggctcgccgccgcgccgctccccgcggcggcgtccagccgagttagcaccatgtgagtatcccccccccccaccaccaccaccagtccccacgtctcctccctccacagcgccgcaccaccgtcacgcggtgatcgcggtgggggccatcgctgattgctggaggcgccgcggtcccggtatgtccggctttcagcatcatcgtatgccttagggtcgcatggcgcgctttgtctggatagcagggaccggacagattcgctttccgcgtgcttcgcgataaggggataataggtagtcgaactgtagaaggttcattgtactctgcacacgttggttgaaattgtgggggtacagattgcacgtgaaactatcatatgcggggaggaattgagctctggctagccgaaatcccgttacgtctagcaaacgagaagttttactgtccttgcgaaagtaactcgaggtactaaattttacactaaaaaatatggtgccttacggtatcttttgcaaggatggtaaaattacccctagcaaatactagttgattttggttagttaccagttgatccttgattttagtgcagtatgcctttatcttaatttgactacctgcacgcttgcagcctaccatgtgcttcgttaggcaactatcattcaaaccgacaagccccacagcatttgtgccgcaaaggatttagtactgctggttcatgagttcgaggttgatatgtcaaatatgctaagtggatacaattattgtttatctggagttccgcgaccacatactgcaaggtgcagtgctgatgtgacaaactactttttccgtgacctcatctgttgataacccaagatcaaacgcatttcaaagccttcatgatgcttgcctataggcatgcttgatgagaggactcctttggatgtctggcgtcaccttttagctgctgctagaatggataagatggattagacattccattgactagttgaaatgaggtccattaccaatagtagttctggccccgggcctctcctttggtttcatgcaatggactgccttttgttcaacaggtgacacttttcatggttattgaataattcaaatgagtatgatacattgttggagcgtgttgaaaacatatcggcgtgctacttatattactatttttagtttctgatttttgtctgtatggtgcggaatctttcaatctaccaactacaacttatctagaaagttaagatttaatacataactaaggttaaatactttacactacccttgctggttgctgaaatatacaacacataaaccaaaaggtaagaatttatagaatataaaatttcatcactaatatgttattcttttttttgtatacattttgatgttttacactatccaattgaaaaggcatggcagtatttctgctcagaatgttgacataagttacactctgatacgagtttatgcttcataataaaactaagcatgaaacttgaagcagctttctttagatgatttgtcgttactagttttatgaacgaggctatggatttaaaggtccttttgggttatctaactataagctttagtgtttacgctacattattgtgaaaagtgcaaattatagtactacacaataatatcttctgaaaaatgtcagttcagttccatggcaaagaagttggaaaattcaaaataaattgcatgccactaaaccttcacttctactacctccgtacctaaaaaagtgtgtttttagctatgatcctggacagtatttgtcccggttcattgctaaaaatatcactgtttcaaggatggagggagtagtaccgtatgattgaggaattggctcattaaaatgaaataaaacaatctgaatacttgaaggaacatattaataaattattatttaaggacaattagacaaatatggatatcttcttgatttttgagatgtctgcttttggcatgtatttcttcttattgttactttcatcaagttctgtgccactgaaatgaaagtatttcctgtagttatagatggaatttgcaatctaaatgcagtatcaataagaacttgcaaggaaaatcacccaataaacatgtatagttgtacactaaacaatagctatattaaactcatatttggtatggatggttgaacggagtggatcaattcgacatcctcctatcatcaatgatattggccagtaattaatatttggatacttctgcaattataccttttgttctttgaagaagccactcaccatgaattttcttattgtttcacttgatggggatgttagttcagtcaggtttttttttttaaagaaactctttactttcataaagttacttgtactttgaatttcagcaaagttatcttctccagttgatcttgctaacttccataggtgtgtgcttaggtggcaagtgtgacatgctaatgctgatgatgatatctagttgggtgaaacatttaagttgatttggatgacctttgagccactctgtatcacaattagggatgataaaagcagactaaagctagctttcacaaaatattattgccaattttgttaattacttgttaaattaaatgtgtatcttgaacacttcctgtaagataatgactctgcagtcatcacggtgataggcacttattatgctatagtttcctgcttaacacaaaaacatgtgatcttttgcccattggaaattgaaaataggcacaagttctctacattcttgatctacctggtactgtttggctgattattttctgttttctgctgcttctcttcctcatcaaaggtgtctggaccattgattactccttaaacccctattcatagaggtttaaactttagagatattaatgatataatgtgctgattgtgttaatgtcttatctgtgacgcatatgcctttttctactgtagacgcatatgcttttgcaaatgctttatgggcatgttttattatttggtcaactaatgtatctcttttcataagttgtttgtctcttgacacttgacaatcatatctaatcaaatgaattcatatccttgttgatcatatatttgtgcatcaaacttttatcctcaaccttttaacaaaagggggaccatgttcattggggaacttatatttttcaagaatacctcaaatcttttttattgttagggcaagttatacttcagagaaaacaacaaatatttgtactttgaatcagtttcttacctctgcatatattatgtgcaatctcaccatacctctcattttttatgcacccttacaaagtttgattctgtttagctcaagaaaatatggtgtgttattatattgcttgccatttagcgtcagaacctcattcactagttctggtttctggggactttggatcatccaaattatatattataagtttcatattaaattgtgtatttctgcatgaaaacgtgatatgttattcctcatggaacatgcatcatgctaaatgtgtatacaggcacctttgatggtcaaatttatttgccaatcatcgccccacccatagctgctttttgctactgtcgtcaattcccacagcactcagcatgagttcctcttgttagtggttcagttcatcattgcacagcttatctttctgctgtaagtactgctggaattctcattttgcttggattggtacaatgctcaaattattgcttccaaagagcttcatagaaaattggaagtaaggcaatgctgctctcctttaatcttcttgatgagaatgttcatgagtgcaccactagttcactgctgatattcagtagttagtaaactgtgttgcccatgctacagttaattgccttttgtaaaagaaattttacctacagttctgtacaaactacaaacgtttgctcccaggaaataaatatttacattagatactgtcatgagggcaagggtagtgacgctgatgccttttgaaatattctttgtcctggagctaagatggccaaggggtcataggcttttttcctctgttgaaatgtgtcccaccttgcaccaaaatgggactgccactcctgttctgtggtatagtttgggagatactgcttcactccaatacctgccttgtcagagaactctattatcctgtagttcaggtccaatgtatgtttgatgttatgggggccaagtgctgaggataggaatgccaccaggtagaaaacttcctcatctggtatgactactgatgttctgttgtcccatctgcatgaaatgattaacaagaatggttattcacttaatgatgcatctccatggtatctgtgattcagagacaaagcttgttacctggatttgttcactggatagagtaatatgggaccattgttactgtctttcaggattttcccaaagacctccttcgcaaatttatggatcatgcttcttggaatgatgatattaagccatgggtgtgggacttcccacatgcccttagctctcaacttcatctcagaagagtgtaccctatccaagaactctatgtatgttacatccgtgtggaataaggaggaaggcatatatctaagttgagacagcagtgtgttgacctcctgtaaacatatatacatacagaattcaaccactcaaacttgacctcattttacttggtttataaacatctttagtgacataagggtaatggttggctcacctgttccatgacatcagcctcgtcagggttgaagttctttgtcatctcaaggcagaagagcacttttccatctgattcaaactggctagaacgcactgggtcctgcggattgaaggacgacctccagttgttcaggatgcctgtcctatttatgatgacaaagccctcgatgtagtcaaatgtcttctctgctgaaatgagcatttcctggtcttcggtgaagcttgtgaaatccaagtagagaactcgtagccaccttacctgtcatccatctgattaactcatgagtatgctattgaaatgctaatatcatcaagctgacatgacttaattgtttcgcttaccatttttggagcaggttcaagaggaatcctggctcttgtgatgacgccaaactgacctaggccaccaagggcagcatggaagagatcagagttttgttcaggtgagcatgtgataacatcacctcttcctgcatttgccagtcattatagagagttagttacattaaattgttcaaatcgtcatgctatataggtctctctcataccagtcacaatttccagctcgttgacattgctgatctgtgggccatgccggaaggtctgcccactgactcctgcattcgacagtgtgcctccaaccgtgagatggagatagtccgtccacgactttggtgctaaaccatacttcagagtctcatgcaaaacatttatccagagttctcctcctgaagcatcgacatagggtgatacgccagggttcaccctcattgtgttactctggagggattccatactgatgatgattccctcagcagcctgggactgcccatacagcgagtgcccatgtccacgggctgccactgtgagcgtggagtgctcacccatcaagaacacatgcctgatggttgtggcaatgtcagccactgagccaggatgaagcaccgcaaccggcgggaagctggacaggttgccaaagtcctgtgcagcagcagacacatcgtggaagctgaaatggccatcaagggtgagttcctccagggatgatggcacatcttgtttaggcacatgcatggtggtgacaccaccaagggcaagtaacaggagcagcttcagatactgcaagagtgatggcctcatggctcttctacgtgtcaagaatgaacaatattctgtggcaatgttttgagaggaagacaaaatgtgcaggaggacagttgttcactgccaagagcagagggatgggagtggagatggagggagagaaggagatttaaaggaaaaccttgaagggtatgtatgtggactggtgcaggaagtggcgtggtcaaaccggtattgggcactgtttggtagactagaaacccatgtgaggatgtgctgcttacaaaatttggaagaatacatgtttcttttggaggaagctatgttgcggtggttgatggctctatttgagatgctaatgttctttcttccttggcttctgtttcaagcatggtgcagcatctgtcagtaagtgattggatgcagggaaaaaatgatgcattcgtttagtaaactcagtctatcacagtacatatctttcactacagcttgttcagaggaacagtgacatagaagagatcaagcaggtgcagtgaacagagatgggttttgagcgtgtatctggtgtggatctcagaaggattgagattctgatgaagtcatatgtagggaaaaagaagtgatatcaggtattcaagtggcaaacctggttgctcctgagcaggcctgcttgatccctcaaattcgatttctcatgcaaaaattcatgttggtctttgcgaggatgagccaaagtgctatctctgtgctttcatatttacaagtggcaagcctcctctcaagcatatctgattaagtttcttcccatatttctttttcggatgttggggcctgttttccaactgcatgaagatcaatttcttgcagaacatataaacaggtaacaaagcttctgtctggccatttttagacaagttgatacatcaatgatataattctttctcaatattttgtggttcaggaatttgatattttgtgctagctcaattgtatggacatggatcacttaaatgtttgtccctttttagtgaccagaaacttttgcttgataatgtagaattcctttgcccacatgcatgctgttgccatcctaaggtttatccaaaacaacactgccatgttctcggggtaatttttttccaagttgctgcctgttagagtctaccatgggaatcaacggatcattgtgttctcgtatctgatcatatctgtctgaaggcaatgtgaacagatatgtgaaacaaactgaatgctctggcatgtctgctttttacacttaggagcttagacaacagtttatgctgcagttctgaagatatctggtaaatccacaagcataggaaacctaggttggacagactttgtaaagcaaagtggaaatgaggggaccgggaaaactaagtatttaccttttttagggataagtttatgcctaacttttgtcacagattgtccttgtgtgaataatttgatacatgcgccagtgaacttatgttatatcagctgtttacttcgattattagcaatcgggattcaggcatggtgtttatttgagttttataggtatcatgtgcaaaattcaaaaacatgtataattcttccatttttgattacgatgccggctctggtatccttttataatgcacaatattcagactttttttcgttctacatagtggttacttgaattggggggaggaaattagcaaagctagatcccctaaggtctgaacaacaaattggtagactctttgcattactatccattcagaattgatgcattgtacattttaaagggtacatttgaataaaccaaaatgttgaacactgcaacaaataataccatgtctacccgacctgtccaccaaccagaaatttacaggaacatcacactctgtcaattatatttacgtagttcttggcaaaataacatcctgttctgacctttgactgcagaaatgtagctgatgccatgcctgcataccacccatgagtggcatacctaatatcaatatcaaggaatgacttcctgtagtgctcttcttccttgagagcacacgcaataagctatcaaaagagtatacatcttttccaagaaaacgaaaggtagagatttttttatcaaacatatcaacacatgacctatttgttgacttgaaagnnnnnnnnnnnnnnnnnnnnnnnnnnnnnnnnnnnnnnnnnnnnnnnnnnnnnnnnnnnnnnnnnnnnnnnnnn

SEQ ID NO: 22597 - DNA, 4748 bp, Oryza sativa
atacttaatatcaatatcaaggaatgacttcctgtagtgctcttcttccttgagagcacacgcaataagctatcaaaagagtatacatcttttccaagaaaacgaaaggtagagatttttttatcaaacatatcaacacatgaccctatttgttgacttgaaaaggaggattggttatactttgggtttcttggtccttaagtgggaactgggatatgcaaactgacagctccttttctgtttgtggtgcagggaatgacagagaattgccactctctaacccaagaaatatcacacaagcctcaatagaaccacaggtatcgtgaagcaaatcactctcaaacattattgtttttttttattctgttctaattttatctggttaggaagtgggaactgtcgggtgctggaatattgctgcttcttttaagctcctttttttttctctgtcacaaaaactatttcgttgaagtaaatggatggttaaatcgaaatgtgcccatcttgacaaaaggagcctagcactaccctcacatggccatggtaggctgagtccagaatagagattagattccccaatccatgacatgcaattcgcaaaggtgacattgatccgcatctgactgcatgctttcagctgctcctttgctgtttccttccgtgctgtcgattatcagtaggctctgcccgcagtccccagcaggagtcccccacacggcatgttagcccaccattggcctagcctgcctctctatctgctgtgaccaggcccctctggacgttggaacaacactttcgggccagatttcccaaccaaagtcacagcagagggtttgcaaaaccaattggccaccgaaaaccgcccccgagtggttttgtcaatagctgactagctatctatgaaaattggtgagtttcaaataatcatagtttgcatgtgtgtgtgttttaacttaggtgatttatctagcggttttgaaatgcaaaccggctcgataaggctgataaccacaccaagataaccgagcgattatcgtcatgttttgaaaccctgcaagtctgcaactaaggccttcattcacaactcaaaaaattaacctgacaagggagtatggtctttatccttaaggccttgtttggctaataggttagggaaataatttcccacacaccaaaaggcatctttaaatcctaaccattcattcttcctatttcatttaattctaacccttcatttatttcccaatcccaatcttacacctcatttcccattatccaaacatagcctaagttgtaatcttccaaaatcaattttgagtcatattcttctaaaaccaatatccagtgcgaaaataagcctagcatgaccacatccacatacaccacatatgtgagtacgtgacacatacaattgcccaagcccactttccaccaatatccagatcagtgggcaggagagctagtggacagtaggttggttggagccaacaatgcccacttctggtatatgccaccttggacgcccaattgcccaaggctcaggctgctattcagccgtgatgccgcggtcaccagagacgtctacactacacttgcacttctgcttttgcttggaatgattctggagatcgagatagatcgagatagcttctgccaaagccgtgcaggatgacagggccatttcttttctttctttctgagttctggaatcatgcggtgcgtgcagcggttgtttgtcgggctatgttttgacagaatttttatagaaaaactctcgattccttaatgaacaagattgactttgaaatgctgtcactggcctaaatacgtctgcctgtctctattggccgctagcttgttgttggcctataagctgcagtccgaatttgaattctataactttaccttttagagttgattttggttttttttttcgttatttagcttgccttttggacctcaatcaaagaacagaagtataaaaaccttaccctaaagttatttttgatttgcttcatttatttttcttagcttataagccgtagctcagacttcaaaagtgtttaggaatttggactccagcttctattggagcaattgtggtcgcccctcgggctgtagcatgccacacggagccactgcctaggagcaacattacgcaagcaatggtcttatcgtggttgggtattggtaaaaaaaaactatcgcaagttttttgaaatgtaaaatctttgccattaagatgcgattgggttaacctcaaaccatcccaaaaaagtcctgaagtcatgcaaggaggggaaaaaatagaccttaaatcccaaacaagtccttaagctgagttcgggagtgagggttaggaactgtcatctcagcacgcaaaataaagtgatggttatcgcatgattaattaagtatgaactgttttttaaaaaatagattaatatgatttttgaaaacaacttttgtatatatatattttttaaaaaacacaccgtttagcagtttaaaaagtgcgtgcgtatggaaagtgagggagagtgagggaggtgcattgaaaaggaaagaaatggactcagccttaggtcacagcaacaagaggaagtccccaagtggaaagaaagttctagaagtgataaaccacccttatccttccaatttccaacgtgtagctactagctagtagtagcatttaaggctgcgttcgataggatgggttggggacctatctcctccgcacggaaaacggaatagtccattagtgcgtgattaattaagtgttagctaattttttttataaaaaatagattaatttgattttttaagtaactttcgtataaaaacttttttaaaaaaacacaccgttagtagtttgaattagtttgaaggttgggatccttcgtgttcgaacgcagcctttagcatattgtttatgtacatcttcctcagtgccaagggagttcatggtccctcagtcccagccatgcactgcaccaggggcatcgcatcggcgaccgaaaaggggaaggaatgctgccatgggcgcgatggtcgcctgtggcccggccttagaattgcagttaagtggacacggatgggcccacactttttcacgtggcccacttgacacatccttcggcttttttgggggcgtgggccttttggcttccgtgtcggttcctggaaatggaggcaggagccccaaactttgggggtttgcacagcatagatgcttttcaagtccttttagaacaggagacccggtcagtgaaccaaccctgtccactgctacgcactcccttcgtcttaaaatatactcccttcattttttaatatatgacgctgttgattttttaataaatttttagtatttaaaatttatcttaaaatataatatcttcatatgctctcttttatcaactaatcataataatattgtattaaattttagtttgcacctactctaaaccaatcataactatttcctatttaattctactaactttttaatctccgtgtaaaacctatttatattttgggacgaaaagaataccgcttccactttgcaacagtaaagcaaacaacggaaaaggcagcactgcttcggctacaagacttaaacctcgatgtcacgtgcaccctttgtgtctcgattggctagttcatccactgtgtcccctacttgatcagtaacatatgtctatcgtgtagggagtatcttcttgcacgcttcttttgtaaaaacaaatgttgtgctttttgtggtctatgcgtgctgtgggctacaggccattgcaggaatgaattggataaagataaaatttgccatcctaaaaaacaggctatatttaaatattgtgatctttgctagtggacaccatcaaaacgtagctttacttggagacatctaaaatatgagacatctaaaatatggtaatttgctagaggacgctgtagttattaaaatacaatatccactcaacttgaagagcggagagactaggtgggggtataatccggttcaaactagatgtattgcctcgttcacacggatgagaagggcattctagttattttaaaatatttctcttccatacaatttgaaaatgatgaaataaccgacacggtgtcatctattaaattaccatgtttttattgtgaactcaggtaaagccatgttttgcgcgtgtccaacaggaaagacaataatttttttatgtgccttggataaatacggcgaaattgaattgaatgagtacttttgcaagtcagatggtgttgagagaatacttaaaccatttagaaaatagatggaaatggtacctgttgcagcggtaaattcagttgtatgactagtatatttgctttgaagctggctggttcgatttcatgtgccttgtacaattcacatcttttggagataacccaaagaataaaattaataattgagattacgcaattccaaggtaaagttgcaagctctccgcatggaaaatatggtggtttattaatgcataattaattaagtattaaaaaacttaaaaaatagaataatatgatcttttaaagcaacttttgtatagaattttttttttaaaaaaaacatcgtttagtagtttgggaagcgtgcgtgtgaaaaatgaggatggtgaggtgggaaaagagggggaaggacataacctaagatgatttagcataaatgctaggaataattgagaatacctgagatgatgtggataactttatga

SEQ ID NO: 22598 - DNA, 1486 bp, Oryza sativa
attctaaaatgcttatattttgggatggatggagtactccatatggtattatggttgatgaattcatggtgatagaagtatgtccggtttaactcctgctcccttaacaggaacgttctcaaaattatcatgtcaatgatgaactctcacgttcctagaccgaaaaaacaatgatccaaaattcccaaatggacagataggcaaatctttatttgacaggagcgcacatacgctctccgttatctgtcgaatttgcatcaaattaaggtccacacacagcaacggtgcagcttttgatcagtagggatcatttgcactgtagccactagtcagtgggattatttggtcggcctgcagataccatatctctccatccgttggccggcttatccgtgatctggttgtcgtgtaaagctgtgtgcgtgcgaagaataatttgttgcttcaaattcgacagagtaatttgcactgaaaaatagaaaccagtagtacggtggtaaaaccgtggcgcatgacttttcattttgggagaatagtcaatgtatccttaaagtttcgctcgtttaccgaaatcgtcatatgaatataccatatcatcattcatatataaaatatatggtgaattgtctaatttacccttatacatataacaaaaaaaagaaaaaataaaaaaaagtaaggatgaattagatatatataccataggaaaaaagtacaacgcagaatattgtttcgagcgccgcacaacgctccctcccagtttttcccttttttaccaccccatctttatttcgcatcctacatctccttagttcgtttttttaccacccagttcgttttttttaccaccccaccattcgtgtttcttttttctcttttttatcttatccgtgctttattaaaggatccggtaaaaatattaaccatccaggattttcctttttagttccttctctctagtttttctgttttcatgttttagtaaaatatttactatctagtttttcttttcgagttttctgtttttccagtgtctccccacttttcaaaagtaacgccttttcaaaattaacgaatttactccgtggagtttttcatttactcccagcctcccatatctgcttcttaaaagtaacaaatttatctcgcatgaatgccccttcaaaagtaataaatttacatgcataaataccccacatcatacgacaccattcctagatggtcgtaaaagaattactaccggcttacaacgtagtaattcttttaccattgttataaatattggagtaaattgcattggtggtacacaaacttattaggtgggtgcaatttagtacataaatttataaaatactcgtttcagtacacgaacttgtctagttcgtgtgaacaaggaccaaaataacttggcaatgttaattttacaaaactgatgttgattagggatgtgacatgcatacgtgtagtgagtatgtataagacatgc

SEQ ID NO: 22599 - DNA, 2160 bp, Oryza sativa
ccacatcatacgacaccattcctagatggtagtaaaagaattactaccggcttacaacgtagtaattcttttaccattgttataaatattgaagtaaattgcatgggtggtacacaaacttattaggtgggtgcaatttagtacataaatttataaaatactcgtttcagtacacgaacttgtctagttcgtgtgaacaaggaccaaaataacttggcaatgttaattttacaaaactgatgttgattaggatgtgacatgcatacgtgtagtgagtatgtataagacatgcaatatttataattttggtcccaactgtcctttatcatggaaatgatgactttcgtatatttctaacccttatatcattgctcagttttttttaaaacttttttctactatcactatatcctattctatttttcattgaagaggtgtatgtctaatatcaaccttctcatatatatgtttacgtagtatcctaacagcccttaaatcaataagattagccatgtagtatccttttcgccttcttccgcacgcaccagacaagttcatataccaaaacgagcattttacaagtttcgtgcactgaattgcacccacctgacaagtttgtgtaccgtggtctgcgagtaaaacaattaccacattcctctcgatatagcccatgatctcgtagccactgtgtagtaatatgtttactaatgtgttcagtacacggtataagagtaaaaacttagacttcatggtctgcgagtaaaacaattaccatattcctctctatatagcccatgatttcgtagcaaccatgtagtaatatgtttactgatgtgttcaatagagtaaaaaactgatactaagaatattgttaatatgtatcacaaaatggtcgtacgaataaaaaaaaattacaggctcaatcacacacaagtgataaaaattactcataggtgaatcaaactagaaaagaaaaaaattgattcagccaaaatccatcataaaactaggatcctggtggctttgctagatcttgctataaggatggagatgctggtctgtatcttgtgacaggtagtggagtagggctgtcaacgagccgagctcgagcgagctcgtctgcctaggctcaagctcgatacaagcttgagccgagctcgagccgagcctataaaatattcgagccttccgataggcttggctcgagctcgactaccgagcttgatttttaagtaaaacaatatatatttcaaagataatctttaaaaaataattaatttctagttcatcatattaatagaagaggaaaaaagaataaaataaatatatgatgtcaataaaaggcatacaaataacatatttgatcttctaatttattaaataacaacaaaaaaaatcatatattattaggctcgttggaagctcgagctcggctcgacaaagctcgcgagcttagggagaggcttaggctcggctcgtctggagctcgagccgagctcgaatcgagcagctcgcgagcctcgagtttttttgacagccctatagtggagagagcaaccgggtggcaagtggtagtcgacgatggaaacatggaggggtgtagcgacgtggtatagagatgggttcgacgttgcgcagtagcaaccatccatcatctagcaagcatgaaaaaaatgaaaaaaaaacattctcgttcatgtcataaggacgacgagcaaaaaaaaaaaagcaaacaacctccatcaccagcggactataccctatcctctgcggctagcaatatggagcacgatgtgcaaatgtagggcctgtgcagcccatcaattcagatcaagtaatattggagattgcacgttaatttgatttgcaaaaagaaatggcaaaatttaccacagggcatcgaaaaaacgtgtaattagctcgtggacaccgcaagaacgagaatctgttgtcggacatcacaataaagtgtaattagctccagaacactcggggccttattttattatttcctgtgaatgtggagagagaaacattggtgagagtacgattttgcccctgccctcacaccagccagagcaccgccaccacctcctccgtgcggcggccggcgcggtgagtgcgctggggagagggggagaaaggcgagcccgctctgtg

SEQ ID NO: 22600 - DNA, 2429 bp, Oryza sativa
ccgcaagaacgagaatctgttgtcggacatcacaataaagtgtaattagctccagaacactcggggccttattttattatttcctgtgaatttggagagagaaacattggtgagagtacgattttgcccctgccctcacaccagccagagcaccgccaccacctcctccgtgcggcggccggcgcggtgagtgcgctggggagagggggagaaaggcgagcccgctctgtgccgcccgctgccacacccacgcaggccgccaacgcacgccgccgccggtggcgacagtcgacgcacgcgcgtgccgctgccttctctaccatctgcgccgttgtgccggaagacgaggaagacgacagcgacaaggatgacaagaaggaggaggccgtggagctcgagatgctgcacatcgaccacgcgtggaagtccgtgaagctgacgagctccgctggtgaccaccgcgggctgatgcaggtggagctgctccgttgttctttggtcgccggacattgtcgtcggcgtcagtgtcgtcaatcaacacgtctgttagctccacgccaaaggggtcatcggcggcgatgagcccacgcacgccggctacagtgcgaaacatcccggcgatggctgccgccgctcagacctgtcacagggacagaacacaagcgctgcacatgttcagttccatcgccgccgttggccaacccaatgcgtcgtcactgtccaggtcgagacccaagggcaaacttgtatttatttagtgtttctctctctaaattcacaggaaataataaaataaggccccgagtgtccaggagctaattacactttttttatgccagatagcaaattctcgttcttgcggtgtccacgagctaattaaacgtttttccgataccctgtagcaaattttgccaaaagaaattggtgcttcatgcgtgaaggtaaaggagagtatgcagatacaaatcggagtgtcatttccttacttgcttgttctgtcaatgtcaccgacgtggagtagccgccggttgtttctcttgacccagatgaacacctccttgctggttaaggtgatgtccgacgtccggcgacaaggcccgaagcagcgccttcgcctcaaccgccaccggccaccgccgttaaccgccacggtgtcatcgtcctcctccatagtgtgtcaccgatctgtgggctgggatggtggatcgattcagatccggggaagttgtttttatcgaagtaaatcatttactccgataatagtgggagcatgatgacaggacgtggggtgggatcggaagtagggaagttgtttttattatcgaagtaaatcgtttactccgatatcaatgggtgcgggatgacgggacatggggtgaggtgggcctggactaatacatgtttggcgctcggaatactaaggaacgcactgcgctcctaatagtactactcttttttttttacccttttgacatatattttttactcttacatacaccatagtttttttccttttcctataatatatgtaagggtaaattggataactcattgtagattttgcatgggagggtgataccgtttgtgcgtgtggcgattttggtaggttcaagaactatattaacccacatgataaatttgaaggactcgtttggacaatataaaagctaaattaacccacgaatagaactttagggatcatgataagtctcaggaccaccttcacattctcgtgttttgtacacaggtgtacggaccaagcatgtgccacccggaactcattcgcttgcgtacttgcacgggtagacgggtgatcaaagtttttggccaacgttacgcgtgactactcctattcatctttgcttcaccaacgtgtcaacggagaacactgaagacaacgaggtgaacggaaacgacaacaacactggagacaaggaggtaacggggaccgacgtcgacgaaaaacactgaagagaaggtgaacgggaacgacaccactggagacgtgaacggaaacgacaacaccaacagagacaatactgcctcaaactccagcggcggagtgccattcttatgatgctccaatttatcaactgcactaattcataccctaatttatcaattgcactagtttatatcctatatgcgtttatatcctatatgcgtcatgtttattgtcttaatattttagattaaaatatgtcaaattatgactaaatttccaacatgaaaccacatcgatatcaaatatatatgggcgtatcaaatatatatgggcagcttcacaaataggcataccctaatatacccatgttcaacatatgggcaaatccgtattaaaggtcctgtgggctgtggatgtaaagtgtattcatctgtgtcttcaatgtgcaagtttcaggctgaaacataccttaatcttgcatcat

SEQ ID NO: 22601 - DNA, 8426 bp, Oryza sativa
  unsure (1)..(8426): unsure at all n locations
cctccttgctggttaaggtgatgtccgacgtccggcgacaaggcccgaagaagcgctttgcctcaaccgccaccggccaccgccgttaaccgccacggtgtcatcgtcctcctccatagtgtgtcaccgatctgtgggctgggatggtggatcgattcagatccggggaagttgtttttatcgaagtaaatcatttactccgataatagtgggagcatgatgacaggacgtggggtgggatcggaagtagggaagttgtttttattatcgaagtaaatcgtttactccgatatcaatgggtgcgggatgacgggacatggggtgaggtgggcctggactaatacatgtttggcgctcggaatactaaggaacgcactgcgctcctaatagtactactcttttttttttacccttttgacatatattttttactcttacatacaccatagtttttttccttttcctataatatatgtaagggtaaattggataactcattgtagattttgcatgggagggtgataccgtttgtgcgtgtggcgattttggtaggttcaagaactatattaacccacatgataaatttgaaggactcgtttggacaatataaaagctaaattaacccacgaatagaactttagggatcatgataagtctcaggaccaccttcacattctcggttctgtacacaggtgtacgggacaagcatgtgccaccggaactccattcgcttgcgtacttgcacgggtagacgggtgatcaagtttctgggcaacgttacgcgtgactactcctattcatctttgccttcaccaacgtgtcaacggagaacactgaagacaacgaggtgaacggaaacgacaacaacactggagacaaggaggtaaacgggaacgacgtcgacggagaacactggagaggaggtgaacgggaacgacaacactggagacgtgaacggaaacgacaacaccaacagagacaatactgcctcaaactccagcggcggagtgccattcttatgatgctccaatttatcaactgcactaattcataccctaatttatcaattgcactagtttatatcctatatgcgtttatatcctatatgcgtcatgtttattgtcttaatattttagattaaaatatgtcaaattatgactaaatttccaacatgaaaccacatcgatatcaaatatatatgggcgtatcaaatatatatgggcagcttcacaaataggcataccctaatatacccatgttcaacatatgggcaaatccgtattaaaggtcctgtgggctgtggatgtaaagtgtattcatctgtgtcttcaatgtgcaagtttcaggctgaaacataccttaatcttgcatcatcataaatattgctgatatttagtaggggattttcggcatttcagtggtcgagtgcaacatgaagatatttaatatacgacagcataattcagagcataaaaacacataacactagtataatatgaacttatagcagtgtaaatcacaatactaagaaccacacttcacaaatatcattgacgctttaaccatactgccacatgatacaggcaactcaagcgtagcggctgcaaatcacactactctgggtttaatcaagaagttaaaatggctggtgcagcagcagagccacagacacagacttaaaggaacaaacgaaagcctcttcaagtagagtatgctgcaggccagtggccagcgctgaaactggctcattatttgtagtaacatgagataatgagagaataatatgtggatatggtattacttaagctcttctgataggagcatcagaagggagccatggttgcttaagaacatcctcaagttccaagctttgagcgaagaggaacagacttatcatgcccatggcatcatcatcaaatttctgggatcctctccaattcctgaaagcaaagcacaataagatcagccagaatatagaacaaaagatactgcaagaaaccaatctgaagagtacaaacattttaatcttcttgcaccgatcttttggatgtttcagggtcttgtcccggcccgacgcggtcagggccagcgcaggctccttccggaccgggattgatcagagtttcagttgattgctattcaaagtcttcatagtcggcctcatccagcatgtcgtcatcgtcatcgttgaaggcagcgacgtcggctgggtagcgcaggatcccaccgatcccaccaaagccacggcagaactgtgatccttcctgcgacttgttggtgacaaactccagggtgcagccatactgctggtaattctccgcgaaccactccagcagcaacggcttgtcgatgacatcaaactctcctgatgttgcctcgtccacaaagttgctctgatctgcctcctggtcactgttgaggtacttgatcactgtttctcctgtggcggtgttcttcagctcgtatcgcctgacatcaaggttctcccacacaatcagtgtatccacagcacctatctcgagcgccgttattgtatcctgcacacctaggacatacttcccggtgtcctggcttatctcctcaaagtacttgccgatcagcttcttttcttggacaaacttgacatcagacagcacctctgcagacatctcaattgcttggttgaagccactctcccctccatatgacacatcaagagtcttgattacctttgcttgcaagcgtggatcaaacatctcagattttcccagctcggtcttgaaatcggcagagccagcaagaataagcccagcgatgtttggctggttggtggctgaattgatgaagaactgggtagcaagctcagccgccttgcgcaggtagttgtgacgcctctccatgcgcaggcgggcaaagcggacagcagactgccctcctcgcccgtgcttcttcgggagatcgacgctgaacttgtaaagaacctccctgctgttgccactaagtgtaccatacagtgttccgttgccatccatgattatgaaaccaaacttgtcatcagactccagaagctcattcagtgcctctgtgtggaacttgttgtcacacagatacagcgaagcgttaatcggcctgaacggctcaaagtcgaaggtgaccttcttctctttgccgtcatcggtgacaatggtcccagtatagagcactaatccattcacgggaactcgactatacagcttcagcctctgttgggcagaagttatggcggccaacacggactgacggttgactctgctcttgatgttagaggcagttccatactcatcacccagcatcttggtgactcgggagacctgatcacgaggtggcatgataagcgaaatcatgctcgtaccgttgcccctggcagcatcaagtgccttgatcaatttcttgaccttccatacttcaatgttcttgtcggtttcatgtccctcgcccatcttggctagtgtttacagctctcttcgcctgaaagaataaaggtatggcaactttatttttttaagaattgattggtatgaacaagttaaaataagactgatacaaatacttttaatgaaccaaaactcatacagaatgacctaaatatgaatatatagtcagtgtaacatgtagacgtgcttaatcattgaaatataaataagttctggtcatggtgtatattaaatgaaaccacacccatatacagcaaaccaaaagaaatctatggagtaacttaatcaacattcacacaacacagcttttagttctcacaacgctacaatgattatatgcagcagactagccatccgatccaaaacagcacagacatcagaaacatatgcactgtgcgttgttccagttggggcaaacactcagataagtgaatgtaaagtatcagaaatggaacaattttagagtgtgggtctctgttttaacaaagttgtttttaccgccttcttgtaaataaataaaataaggtgcgaaccctgtagcttagtccacaggagatcagaaattgcactaagatcacagttcacaacaggagatcagaaattactgggcagggcattttgttggattcagacatgagcctatgacagaagggtgtgtttagttcatgtcaaaattggaagtttggttgaaattggaacgatgtgacggaaaagttgaaagtttgtgtgtgtaggaaagttttgatgtgatggaaaaattggaagtttgaagaaaaatttggaactaaactaggccgaagtaggacgtaatagagaatctccataaaaaagagtgtaatttttaagaggtttttacagaccagtcaagaaaacttcttgcaaactggaatgatatatcattaacagatccatctttttagcatcgatctgcatagagacagcacttactactaaatcaatagagactttgcaccctatgttttatttggtccttctgatccaacaacccaagcgaacactagcaagaaggtactaacactaggatagtagcgttgtctaaataaaatacatccaacagcgacgagatgaacctcatcatactattaaaagaacacaacaatcaagattagacatctcaaatatctctaaatctatccacgccgaaacacacccggcaccaccgaaccaaatcgtgagccaagaattaatatgttccaccatcttagagcacacacacaggaaaaaaaatccactgattttacaaactaaccgtgtaccgtgtagacgcccaatccaatcaagttgagaagaagaagaagagacacacagaaacagatacagatacaggagctggaaagctggaaggaagcgcctcaaacatggaaagaaattagagcacccttgcaatcatcccgccattagccacatgcgcacatgatgacacaaaagtactcccccctcccaaaatacaagtaaaaataagatcatataagacattctactcagtactatttcttataattttgtgacggagggagtaatagtagtagaagaagaggggaagaggcggcggcaaggcagccgggggtgcgcacctgcgtgaacgagcgagatggccgggcgccgcggcgcggcgagcgagaggttgcggtgatgttcgtgtgcgtccgcactgcgtgattatattggtgccgctttggctccgcgagctttagaagagaaggttttgagcgaggcagggacggtggtggcggagatcacgtcgtccaagagagagagagagagagagagagagagagaaaggttggcacacgtagcagcaggcgggagagccagagtatgtgtgctgttcaccaacccgtgcggcgtgggacaagtgtccccgcgtcgcgtcggtctcccgttgatcggttcggttctcctccttcgcgaagtcgcgcaacgcaacacctggcgcagcgaggcgtcggccaccgaacaaccgttgccgttcgcagcagcgagatatttttttgggtaggcacttttttttttaactttattaaaatttggtaaggttgaaaatgacgccctcagatcggagttttgtcagggtgttacgttgaatgtggttttgttataatgttatattcaaacgactctattttgctacactcctatttagaccaattttgattatttgcaaatgttttccactgtgatctgacttttttttttgcccctataactattttgttgacttacgtgtgacatatcgatcccaatccaattgtcgtcttcctctagatgcccctgtcgccaaacctagatctcccccgcgtgacagtgctccgccggtagcaagggacgtgggggttagggactgcacttcgccgccaaccacgccggcgccgcggcacaccaggcgctcaacctgaccgcgcaccacggcatcaccccattctccaatgagctcctcgacgtgggcggcgacctgctcgcggcggagctcctcattgaggcgagagcgtcaagaacaccatggaagctgctgaacctggcgccgacaacattgacctcgatgtctagcctcctaacgccatcggcgatgacggggccttgcgcggcgacgaccatgcgaggccagcgcgcgcaagccgtagtcagctccaccctgcagcatccagccccttgagtaggccctccacctcgtcggggagggagatcgacgctggccatggtggagctcgccattgaagagggacttcaaaatccaccatggagttaagccaatttgagtgggatttactgggggaattgatgatgaggatgagaggaaccgatttttttcattcaatttggggcgagagcaacctaggatggagatcaagagaagcattgtcgcatgatttcactggagaaagaaggatggtggcgggcagaggtggaagacgctcctccacaactgaggcaagggcatttgggtcaaaccaaataagaaaaacaacggaaaacatttgcaaataaccaaagttggttgaaatggcagtgtggcaggatggggtcgtttgaaaatagcattacaacgaagccacatttggtgatggcattctgacgaaaccctaacccgaagatagctaaatatcaattttctcgataccgtcgcgtgtccacggtcggctatgggttcacatcctccaccaattagaggggtgatgaatggcagaggcgtgtacagtaaaatgtaaaatgtgaggagcgtgtacagctctacagggaaattattgtagaaacatacaatataaaaaaaagacacatcagtgcctctttattaataccggtttgacaaaacctggcactgttagatggttttgaactaaaaataagttcatgataaaaacatgcttcacctggcattgataatcattcaatattgattgttcgacgacacatcagcatcgggtcttgccaataaccagcacataagaataacacatcagtgttgaatcttatatttatagtgagatgaatggacttttggcaggaaagtacatcagcgtcgggtctttagaatacagacccgacacttatgccaatgacatcagtgccaggtattctaatgaccgggcactgatgtcgctaatcatattagtgctgatttcagatatatgaacttaaccttttcgtatgaactcggattacgacaaagtttaatgaaaattgtagctctcgacaagatctatgattttatagttgacaacttattcatttgagctattttagatactcaaattcaagattcaaatcttgcttatgaagactaagaaggaaaatatccatttactaacaagatagattgatgcgtaggtgagttggtaaggatagttgcatcatgcatgtgaggaggatggtgtcttgagttcaaatctttacagtggcaaaaattatattatatacaacttgcgaaaatagatattagtggttgtggctttatacatacatgagtaaagatggtaggagtattcaaaaatattttttagcctaaattttgaatttggatacttattatcacagatgaacccatttcagtgctgagtacagataagcccatatcagtgccgggtctagagaataccagcacacatgagtctatccagattctatctaggtgcttctaggcactgaacaaagggaatcatcagtgccgaaagtttggtgtcaggtatattcacttcactatcaagcatttcaagccaactgacattgtccaagtgcaggaaaaggcagtaagcccccatcttactcaagacattcaatagattatccttacatcgtcccaagactgctcatgataataacaatggtgcgcacaaacgacaaagcaaacatctcaacacatgtaaaccccccatctagatgaggtagaatggaaacggaatcaaatgatcgaacgcgaatctcgctaagttgtgagttccatgatggctgtgacgatgtcgccattggcagccttgagtgccttcaccgccttggacctcgacacggtggcctgggtcatcaccagctcgatgtccttcggctcgacaccagtctcgtcgacggcctcatcatcttcctgggctgctgtcgacgcctccggcttcgagagcatgctgctcagatccggcgccttgaactgctctgcagcctgggtctgcagctgcgagctcaggtcctcgatcttggcctcgccaaaaatgacataggtgtcggatgtagggctcttgaagacatccggtttggagatgacaaaaaggatctgaaatggggcaaaagaaatagcaaacatcaacaggaatccaactaatagaactatttagattggctagataagagcagtcgtaagctcacattcttgctcttcttgacagtaacacggctcacaccagtgatagannnnnnnnnnnnnnnnnnnnnnnnnnnnnnnnnnnnnnnnnnnnnnnnnnnnnnnnnnnn

SEQ ID NO: 22602 - DNA, 556 bp, Oryza sativa
agttggtgactaacttgttagtttcagaggtcaatgagatagcgatgcatgaggttgtgacaaccaggtaaggtgattgtcacgcccagaaattcccgaatagaattccaagcagaatgtgcattaaaattcccgtccaggaccggccggggtacacaaacgacaaagttgacatacagatccacgtcttacaaacattataaaagtcttacataaatgtagcggaaaacttaaaaggataactggagctaagccttgacttggactgcagcgggaacaccactccacaggcatcctcgacggcacggacgaagcctactcctcggagaaaccaccatctaatgcatactcaaattctgggggttggggaaaatagagcaagactgagtactacccactgtactcagcaagtcataccggaataggggtatgatgcagggaattatcaaggggtagctataatggttcatttgcataaagcggacatttataaacagaagttgaaagcagtaaaacagttgtaataattaatcaatattaatcatccactgtccaa

SEQ ID NO: 22603 - DNA, 471 bp, Oryza sativa
aaattaaaatagaaacaaaacaaattaagaaactgggagaagctagctagcgcgcctgtccatttggaaaagatcgagtttaatttgaacacattagatagggagagtatatatcataaaaaaaaaggataagctgcaaaattgccacgtcggaaagctgcagcgtctcgttgtacacaagagctagctaaaagcacgcacgcacgcacgcacgcagcagccgggcggtcacacaggtcgacacggacgcctaatttgtaggactttgtgtttgtgtatgggcatgcttcgaaagcgatttatatataaatttccctttcaaatatatgttggcatattaaaaaaaattaaaaaaacaatcagatggatatggatatattgttttgtagctttggccttgtcatcaactcataatgagattgtgttattgtggggaggagatgccacatgtttgcgtcctagggagtggaa

SEQ ID NO: 22604 - DNA, 257 bp, Oryza sativa
gagtctctgcctccgcccccttttatcctcgcttcatccgcacttgcctcctcgtttcgtgctcccatacttgcccccacgattctcgcgcccgcatttgtctcttcgcatcttgcgcccactcatcacgtcgcccgttctatctgttcctgcctttagtgcgtctgtcagtggcgcattcgaggtggagtgcacaacggctatgagcgcaggctgagcaaaccatcaccactacctccgcaggagtagcgagcggg

SEQ ID NO: 22605 - DNA, 923 bp, Oryza sativa
acatatgtgagtacgtgacacatacaattgcccaagcccactttccaccaatatccagatcagtgggcaggagagctagtggacagtaggttggttggagccaacaatgcccacttctggtatatgccaccttggacgcccaattgcccaaggctcaggctgctattcagccgttgatgccgcggtcaccagagacgtctacactacacttgcacttctgcttttgcttggaatgattctggagatcgagatagatcgagatagcttctgccaaagccgtgcaggatgacagggccatttcttttctttctttctgagttctggaatcatgcggtgcgtgcagcggttgtttgtcgggctatgttttgacagaatttttatagaaaaactctcgattccttaatgaacaagattgactttgaaatgctgtcactggcctaaatacgtctgcctgtctctattggccgttagctgcttgttggcctataagctgcagtccgaatttgaattctataactttaccttttagagttgattttggttttttttttcgttatttagcttgccttttggacctcaatcaaagaacagaagtataaaaaccttaccctaaagttatttttgatttgcttcatttatttttcttagcttataagccgtagctcagacttcaaaagtgtttaggaatttggactccagcttctattggagcaattgtggtcgcccctcgggctgtagcatgccacacggagccactgcctaggagcaacattacgcaagcaatggtcttatcgtggttgggtattggtaaaaaaaaactatcgcaagttttttgaaatgtaaaatctttgccattaagatgcgattgggttaacctcaaaccatcccaaaaaagtcctgaagtcatgcaaggaggggaaaaa

SEQ ID NO: 22606 - DNA, 597 bp, Oryza sativa
gtaggcaggccggcagggcggggcgaggcggggcgcgtcgaggccgtccggccacacgcccacacccgaagacgcacacgtgcgaggccgggcggagaaggggcggcggggggcaccacagccgcagcgtcagcctctgcctccacattcgccgccgctcccgacgacgcacaagcgcgaggccgggcggagaaggagcggcgggggggcaccacagccgcagcgtcagcctccgcctccacctacgccgctactcccgacgacgacgcagccagcgtcgtcaccgtcgttgtatctccaaagctcgcactgctgctagtgcccgtgtcggcgttctacctccgccgcggcgcgccgctgtttctcacgccgcgacgcgtgctgctggcgggcgtggggctcggcgtcttcaccggcgcagatgacttcgtctagaaacaaaaatcaaggctctattacactatttagctcatctatttgattggctccttttgttttctgcacaacacatgcatgcacagcatgctgtcaactatgtttagtatatgctgcaaggaccgaccctgccgttcgtcgagctcggctacaagcacgccg

SEQ ID NO: 22607 - DNA, 629 bp, Oryza sativa
  unsure (1)..(629): unsure at all n locations
nnnnnnnnnnnnnnnnnnnnnnnnnnnnnnnnnnnnnnnnnnnnnnnnnnnnnnnnnnnnncattggacctgaactacaggataatagagttctctgacaaggcaggtattggagtgaagcagtatctcccaaactataccacagaacaggagtggcagtcccattttggtgcaaggtgggacacatttcaacagaggaaaaaagcctatgaccccttggccatcttagctccaggacaaagaatatttcaaaaggcatcagcgtcactacccttgccctcatgacagtatctaatgtaaatatttatttcctgggagcaaacgtttgtagtttgtacagaactgtaggtaaaatttcttttacaaaaggcaattaactgtagcatgggcaacacagtttactaactactgaatatcagcagtgaactagtggtgcactcatgaacattctcatcaagaagattaaaggagagcagcattgccttactttcaattttctatgaagctctttggaagcaataatttgagcattgtaccaatccaagcaaaatgagaattccagcagtacttacagccgaaagataagctgtgcaatgatgaaactgaccactaacaaaagaactcatgct

SEQ ID NO: 22608 - DNA, 439 bp, Oryza sativa
caagctttgacaaatagaagttgggttgctgacatccaaggggggcttttggtccagcttcttgctgagtacctggccatttgggatctagtagaagaggtggtgctgctacaagatgtccaggatcagcatgtttggaagcttactgcagatggcgtatacacttgcaaatcaacttataagcctatttcttgggttcgattcattttgctccctgggacgtatttggaagtgttgggctcccctccggtgaacaaattcttcgttgggatggccatcaataataggtgttggacagccgatcgtttagattagtgtgggctgcagcacacagtcatctgccccctttgtgatcaaagggaagaatccatccaactcattttgatctcccgtgttttttgtcgccaagtgtggccgacactctttttaagaatagggt

SEQ ID NO: 22609 - DNA, 1157 bp, Oryza sativa
cctttcttcatttcacacttatctcattacagggttccttacttataaaggtcatatatgccagcctggccgcttggccgaatcacacaacacacatgctcacacacccatccgacacgttactgtaaacgtcatcctggcgttgtagctcgtcacgcgtgtggtacagacgtgacagtaccgcccgccggagaaacagcttgtccccaagctggtgctgatggaaagcgggtcttgagcacttcataatcctcccaggtagcctgatgcgccggtaaagaagaccacttaatcaacacctgaacatgtgctgcattgccctttttcacaagccgacgatcgagtatttcttcaggtcaaacgtcagcggcatccaaaaccacagggtgaggaagagaagtaaagaccggtgtatgatcaggaacatgtgctttcaactgagagacatgaaagacgggatgaatcaaacttgagtctggtaactgtaaccgataagccgactgaccaattttctctagaatttcaaatgggccaaagaacttgaaagctagtttggggtatggacgattcaccaccgaagattgagtatatggctgcaacttcagaaacacataatccccaactgcaaaggatcgttcagaccggcctttgtctgcttgatgcttcatgcgcaactgagcccgttgcagttgttgttgtaagaaagcagatagctgattgcgttcagaaacaagatcatgactgatggactgaggagagaagtactggcacttgactgacatgaggatcagctccaaacaaagcttgatgaggagaacaacccaatgcagtgtgaaaagaggtattgtaccagtattctgccaagtgcagccatttgttccacttagttgatgttgcttgagtaatacaacgtaagtacatttcaagatattgattaacacgctcggtctggccgtccgtttgaggatgataagcggagctcatactcagagtagtgtcccacactttgaacaaatcactccaaaatcggctggtgaaaattttatcccgatctgagacgatagaatgagggatgccatgtgtcttgaaaactgttttgtcaactgcattggccacttgggaagcagtaaatggatgacgcaagggaataaaatggg

SEQ ID NO: 22610 - DNA, 5521 bp, Oryza sativa
  unsure (1)..(5521): unsure at all n locations
ttggaaagactttcgataaaatccattgatatgtccacccaggcttccttaggaattggtaatggtgttaacaagccagggagcttgcagtgttcagacttggcctgctgacaaatctgacactgcttaacaaagttagccacatctgatttcagacctacccaagaaaataacttcttcatcctttgataggtagcagtagagccagaatgacccccaacaggagaagaatgaaaagcattaatcaatttcgtttgtaatccagtgttagctccaatccatactcgttcatgatgtctgattaatccatcatgcagagaaaaaccttgtgtattaggagattgaacagccaattcggtcagcaaagtttgagcagcaggatccactggataagaatttaacacctcctggagccagaggggagaagccactgacagtgcagcacaatgaggtataacaggcatcctggacagcgcatcagcaactatattgtcaactcctttttggtattgaaaagtatattgaaaacccatcaatttagtcatagccttctgttgcaaatcagttccaagaacttgatcattcaagtgacatagacttttgtgatcagtgcgaatagtaaaagggcagtgctgtaaataacatctccatttgtcaacagccatcattatagccaaaaactccttttcatagatagaaagtttctgattagctggtcccaaagctttgctataataagcaataggatgattcaactggctgagcacagcaccaactccataagcacaggcatctgtctccaaaacaaagggaagactgaaattaggtaatgctagcaccggggtagaactcatggctagtttgagctgttgaaaagcttgttgagcagcatctgaccagaggaatgctttcttttttaataacactgtgagaggtttggctataatgctgtaattcggaacaaatttgtgatagtaacctgtgaggcccagaaaacctctcaactcagttgcagtttgtggaacaggccaggctaacatcgctgcagttttggcagcatcagtactgacacctttagcagaaattatgtggcccaaatactctaattgagcacaagcaaaagagcgcttagacattttggcatataactgatgttgtcgcaacaacataaacacttgtctcagatgatgtaggtgagaatccaagtcagggctgtacactaaaatgtcatccatgaaaaccaatacacattgcgaataagagatgcaaatactgaattcatcaggcattgaaatgtagatggagcatttgttaaaccaaagggcataaccctgaattgaaactgcccatgatgagttttgaaagcggttttaaactcatcctgttccaccatacggatttgatgataactggctctcaagtccagtttagagaagtattgtttgcccgctaactcatccaataactcatcaaccaccggcattggaaacttactcttaatagtgacagagttgagtttgcgataatccacacaaaaacaccatgtcccatctttctttttgaccaacaagactgaggaggcaaaagggctcatgctgggagtaataagaccagaatcaatcatgtccttgacttggcattcaatctcatccttttgtaaaggagaatacctgtaaggtttactgttgacaggagcatcatcagggtacaagaagatagcatgatcaaaagtgcgatgaggaggtaaacacttgggctcttgaaaaacatcagcaaactcagacagtaatggagctactacttctgaaatggactgagaatctgcattgtcagtaggttcaagcaaaacagcagcccaaatatcacaacccttctgccatttcaatatttgagggtaagaaatagcacataattcagtctgggaatcagactcttgaacaccctgcagtgcgattcactgatcttgatagaaaaacttcagagttttagttgcccagttacaagacatatcaccccattgagccaaccaattcatccccaatattgcatcatggccccccgactgaaccactttcagatcataagagaatgtctgaccttggatccaccatgtgaaattagaaaccacatattggcaagagagaaactcaccattagctacctgaaccaaggaaggggaaatagggcacaactgcaaacccaacagctgagcaaaattgagatcaatgaaactatgagagctgccggaatccaccaacatcaacaatactttattctgaaccaatgctctcaaacgaatagcattatggcgagatgcaccagataacgcattcaaagaaatatgatactgctccttagcatcagaatcttcttcggtagccactgcattcaaaagatcatctggaataacttcagtgatttgcatagcttttaattaaccagtgatcacacactgatgatcaggtgaatatttatccccacatttaaaacagagtccattcgctcttctatattccttcaactgtttagctttccataattcagctccttcaagttgaatggccgatggctcagagacaggaacagacgtatccactttagcgccaacccctttgtatgtcaatttcttaagaggtttctgtccactgtctagtaacacactttcttgcactaaagcaattgcagcagcctgctgaacagtgtcaggtaactggaccagcacagctgagcggatttcttcctttagacccagaataaaacgatacagcagcatcatccctcccacagatggatcaaacacacgcacctggtacactagtgaatcaaactgggacttataatcggcaactgaaccagtttgccgtaaggtttgcagcgcctgaactttttcacgctgtgcagtactttcaaactcgagagcaaccgcataacgaaattgagaccagtcacaaatctcttctactaacttaaaggattggtaccactgtgctacatttccagacatatgcaagactgccgcagaaaccttaaacatagccggaatttggtacatgtcaaaataggtctcgcacatatctagccaaatacggacatcagagccatcgaaacgaggaaaatccatcttaggcaagcaactcttagcacgaacaccctgatcaaaaccctggctagactccgcttcgttgcgaataaacacaggacgagtatggaaccttggtggcggcggcggcggcagtggtggtggtggggaaacacccgcattgccaagagaaaccgcagatggggagcccagaatactcacttgatcggaagacgccaaactcttttgcagccgcgccgcctgaagctgatcttgctgcagcttcccaaccgcctccagagcgagatccaccttgacgacggcctgatcgagccgccctccgtgtttcgtcatcttgtcgtccatagcctccatcttctgagtgagtaactccaacttctccaacaatttcccctccatcgactcgagcgattggcataacggagcgctgagcttgatgggcgccgtggtgagcgttcgctccaaatccaaccgaacctgaaccggacttacagcagccgcacccgagggtagccgcctaccggagcatagggattttaccagtcagatcgagagaatttgaacgcatcaaccacggaaaacccgaatctgataccactgtaacactactagatcatagcagaggaataactagagcaggagaggtgaagaacagaggaggaggagacagagtcgagaaagaaaggggcagagcagagttgttgagaggagagattcgtttttcctttcttcatttcacacctatctcattacagggttccttacttataaaggtcatacatgccagcctggccgcttggccgaatcacacaacacacatgcgcacacacccacccgacacgttactgtaaacgtcatcctggcattgtagctcgtcacacgtgtggcacaggcatgacattataattggtatattcgtagctgtgttactcaaattttacaaaattagagccatgccatcgtcgtcacgttttccatcttccccatttgtacatgaggttcacctgttagattcgtcttcttccttcatcctctcatcttctcttttctttttcccatctctctccaccatttcttcgtttcttctttcttcacatgtagagcagaaggaggagaggagcggggtgccggtgctccagtggctgggaggtggcgacgcagcgaccgaatgtgttcccgagcttggctcactcgtggaaagtgtcggccggtacagggagctagggagatggccagaacaatggatggaagggcacaattccggcggcaaagaaggtgatggtggtggtgggatggggtggctaaaagagaggggaaactaggggaatgggttctccttggtgaggcaaaccggtggtgcgaagatttggtgtgaggggagccagtgagggagattgattgatgatgaggtggtgggcagacatggtagagaaagaagaagagagcgacaatgatggaactaggtgtggggtgcgtcggcttcgggcaaactgcgatggcggtggtgcgctgaggacgatgccctatcccccacgtggatgccgttgaggaagaggagctcatcatcgctggtcatctccatgaggagctcgtcatcctcttcctcatcctcctccatggacaaacgtgcgtagaggcgtggtcggggagagccccgtcgacgagctgctctggtggctcacttcctcggctcctcccacgaccaccatagatggcggcagaggttgaggttgcacggaggaggaggaggaggaggaggatgagggagcttgttgcgggtggtgccagcgagcgagttgatgtgtgggcgccgagtggttgtgctcgccggtgtaggagaggttgaaggtgtttgggttggaatgtctcctctccacttgcttgcagcacaacagcagcagcacaaggccgccgcagcgcagcctgctcccaatggcgccgaccacgccggccgctccgcgctgcccacgacgactcacccatggggaaggaagatgataagggagggtgaaaggaagaaaataaatctgacgggtgagtaacacgtgcagataggagagtagatgaaaaatgtgatgacgatgatattacgaatagacgaattataatgatatttatctaaataaacatatttaaaatggcacggatcgaataaacccaaacaagggtatccgggagggacgcacgattctacctgtttttgttatttttggcccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22611 - DNA, 2450 bp, Oryza sativa
ttttaaaaaattatgtgtcgtactgtagtagaaagagaagaaggggaggaggaagggggagaagagggaggagtatagggggaggccgggcaaaccgatcgctgggcgatcgccctggcgatcgatcgcccattagcccccctccttcatcgtagttcattcgtcaaatccaacgatccagaatcatccaatccaacgtcttcagtcgtcccacctacctcggttttactaattagcgcgtacgagacttctctaagtcgcacgcgtgccacgtggcggaccctcatcgtctgcgggtgggtatggtgggcaccgcaagttttccttttttttcctaggatttttttttggagatgcatatatccaaagtaactaacccggacagttttagataataacgataattaaggtaagaattttctttttttttcaagattttttagtaacagattgaaatggaatctatacatgaagtgaaattttgaaacctttcaacttgaaatttgaatttttttaagtcaaaatttgaaaactttcaacttttcatctcaaattcgaaaaactttcaaaccaaatttgaaaactttcaacgcaaaattgaaaactttcaactcagattcaaaaactttcaagtcaaattgaaaaactttcaactcaaaatttgaaacttttcaactcgattttggaaactttcaactcaaatttaaaaactttcaacacaaaatttgaaaactttcaattctacatttgtaaagaggtgtgcgaaagattgaaaaaaagaaagaaaaacacatctggaggtgcaaaaatcgaaaaaaaccaaacagaaaaaagggcgcgcaagaaggggggccaacaggcgcgcgcgccagctaatttgctgaagtgtacgcatgttaacagcgaaatttggtaagcccttaagagaattaccatgtcaccaatagtcggattcctgctatattcggttaaggaaattaatctattaaaggaagcttatccagaagtgaccgagttcaaggaggatgcgacatgatagtttatctattaattaggcagtatttgttagtttcttttatctttaggaaaatgtgtttagtgtcctataaggattttatgttttccttttatctttaggaaagtttctttcttgtcctacaaggacaagtatctccccacgggtataaatatgtacacccggggtcattgtaaactatctctagatcaatataactactctcagcgcatcgtcaccctctttaccgaggtttttacttatcatccggcggaacttggcacctgacacgaggctgcatcggttttcgatctccggcgaaggagtaagtcatatgttctgccggccctggtgaatctatcggctacgtcagtgttgttcaaggctgcatcgcttcgatctcttggatcgctctggtttggttgatatatttgcatacctaatatctcaattatatctctaattgcattgtgtttagagacgcatcggtttagttgggctgtctcggttaggtttgatcttctgtcttagccgatatatctctacaatcacaatgctattgtaaatagatttgttatgtccatcacattagacagatctatcagctcatcgagtattagattatcatatacaatctcgtgctgcatcggttagtttcgacctactagattattgttgataatataaatcttgttgagccgataagttcatactagtgttttatcgaggtgctagccgataagttatctagacgttgcatcggcttataaggattgcatatacatataagttggatttagccgatgacaacaaaggtttcattgatttatctaatcttgtggattttatgacatcggacctctagccgatgtatgctttaacaatcagatcagtacttgttctatcatatcatattgttagttgattggtttctactggattatattactgttatattgcatcatcatcagccgactgcctttatatcattatctacattggacatattatcgatagttcaaaaccctattcctatcggctggaattactccatcggcttgacaaccgatcggctgtttgatctgttgtttacatatcttgtcagctgtaggatcaaactgactggcacacccgcacctcaccaagatttggacatgcactagagctaagcagatctcctaggccagtgtgtgttttttgcgtcaacaggttgatcggtttctggattcaccgtggcacgagagggggccgcccgttgcctgctggggacgggggcgaaacctgaggtgtggtacgattggttagagggagttatgcgaaaggtcctatcatctttctatcacgtggtggcatgtcggcgtacggaaacgtatcgtggggctgtgtcttgtgggtacagttgtgcacctctggccagagtaaaactatttgaata

SEQ ID NO: 22612 - DNA, 1846 bp, Oryza sativa
tatagggcgaattcgagctcggtacccgtgatcgagggaccccctttgtgagttcggccgggggaaagggcgcgctgatcaagaacgtatatccgcctagagtctttcgagaccgcatgtgagagctgggattatacaggttcgggccgctagggagcgtaataccctactcctgtgcgtgggatttagggttgagtgttacaaaggttcctaaactctagggagaactctcactcttcttcccctggggcttaagctaacttagagtcgtcccccctttttggtgagaaaggtcctccttttatagttcaaggggataccacatgcaccgccttggaaggagggcgaagcggggcgacggcgggcggagcggtgacacgcacgaagccggcggggcggcagcgggcggagtggggcaatggcgcatgcgggcgaagaggggcgacggcgggtggagtgccgacgcgtccgaactccgaaaccggcggggcgacggcgcatgctggcggagatcggcgcggggcgtacagcgatcgacggcggcctgggggccccgacttgctgatgctgttgaagacgaacaggagggcgtgtacaacttgctgcttcttgtggtgatggacgacgacggcgggagcttgctacttgttgctgctagcttgcttcttgtctgtggatttaacagcttggcgttggatcttgcggcttgcctgtggatctggatatgctcgctgcttgctgatgaagatgcgcttgttgctgacgggagagctgatgggatgacgagaccgacggacggtggctcgccggcgacggatgcttgctgcttgacaccggcgatccccacagcggaggtgcgtgtcctcctcctcctcgaacccatcgccatcgtcgtcgtcgtcttcagcggcgtcggcatcggcatcggcatcgtcgtcgtcttcagcagcggcgtcggcatgcgtcgtcttcggcggcgtcgggcgccgcgtttggggtgtgtatggggggagtgcggcatgcgcgtgtttgctacatcagcggcggaggtggaggtggaggggtgaggtgcgggatcacggtgacgccgccgccgccggtggtagctcctccctcgccggccgccgcccgcgcccgctgcgcccatctgctctctgccagccgcccatcgcacgccgtctcagccggccgccgctcagccccgctcggcgccgcccgttgctactcccccctatcccccgcagcaaagagaactaaaaagaagagaaaaaacaaaggggaaagttgacgtggcacgctgacatgtgggtcccacgctgactcagctgccacgtagatcaaaaccggggtcaaaaccaccaaaggatctcaggtgaccggatttgtatagttggttttgcggttcaaggacgcttttgtatcccggtgacaagttgagggaccttcggtgtactttttcctttgcaatattagatccgatgcttggtgggctcagcccgtttagtacatgggcctgatagtccacatgtatgtttcgttttttgttttctaaaattagtttttgaatttgtttcaaatttatacgtataaagtttctatatataaggtttatacaaacaaaatatattcttttctaggccatgctaacataatgctgaattgatttcaaattcatatatacaaagtttctatggcacaaagttttatatgcaacaaagcatttacgtatgcattttgaatagtttaaatttataaacctttttatataaaatttgtgtataaagaaaaaaaacataggtgggttacctcgtgggctggcaaccccgggaatgagaaaatcactact

SEQ ID NO: 22613 - DNA, 1475 bp, Oryza sativa
  unsure (1)..(1475): unsure at all n locations
gggcttgcaaaccggaactaaagagggtatccccacaagtaaatgtaagtggtcgttttagttgtaactaggctctattgagaagagaggagaagagggagggggcaacatgcatggtttttgtagctatgtgtagctatgcgatcacacgtcacgcgtctagaaatgcacgatcggtcacgcatcaactcaacccattaatctccaccaagtcgatcgtgtcattattaacatgtactaatatttattccattatctaaacaaaatgtgttaacttgtggaccgtcctcgtataagctgatcatctcctccaacaatgttgtcggcccaaaagctaattagcacttgttaacaatgaaatttgacatcagattcagaaaaaaggaaggaaattgaagcagatttggtgttgaatcaagccgaacttggagtcggaccgcacatcgactggatgccatatcggctgaaacaaagtatgaagctggttgaagcttgatgaagccgatggccgatgcagccgatatgacgtgacttgggctcgacatgggcctagattgggataaccatcattgccaataagagatagagctcgattaaggcaattgtatctattaattaggatattgagttggtttgttagaaatttggtaagtgaccgccatatatagtcttgtttgtatcttaagtttagaaaggtttgagtcgtgtccacaataccacccttttacttttctcgttttctggcgagttctttgcaagaggtaacctgtgtcaaaggcccgcgctatcgggctaacatgtcgctttagacatgttaggctcaatatcacgagtcattgctatcatatgtcttagttaatctatttttagcttctcaatttagctctatcggtcgtggctcgctttagggtttatacttgtttcgattaaattgtcttgctagattagattagctaagacatctaccatcctgaaaaatgtctaatttcttgattgtctagactacatgttccttttcatactttgagatgcatcatccctagtcgtgcttagaaccatgcaaattagcctgcaattaggcattataagaatagtattggggtttcagccgatcttacccaatatgcatgtttcaccccccctgtttaatgtatattcgccacttatatagatagatcgttttatataagcatatcaagctttagtcagtatcggttagattcctaacttcatgcttaatttctatttgatatgtttatatggatcaatctgtctatataagtttgtactagagtattagctagtacgttatttctcttgctctaaatattgtcacatcggttactttcataatacttctgttactttcataatactgtcttaaatcaatctgttaaactctatagatactattacannnnnnnnnnnnnnnnnnnnnnnnnnnnnnnnnnnnnnnnnnnnnnnnnnnnnnnnnn

SEQ ID NO: 22614 - DNA, 6580 bp, Oryza sativa
cgagtcattgctatcatatgtcttagttaatctatttttagcttctcaatttagctctatcggtcgtggctcgctttagggtttatacttgtttcgattaaattgtcttgctagattagattagctaagacatctaccatcctgaaaaatgtctaatttcttgattgtctagactacatgttccttttcatactttgagatgcatcatccctagtcgtgcttggatgcatgcaaattagcctgcaattaggcattataagaatagtattggggtttcagccgatcttacccaatatgcatgtttcaccccccctgtttaatgtatattcgccacttatatagatagatcgttttatataagcatatcaagctttagtcagtatcggttagattcctaacttcatgcttaatttctatttgatatgtttatatggatcaatctgtctatataagtttgtactagagtattagctagtacgttatttctcttgctctaaatattgtcacatcggttactttcataatacttctgttactttcataatactgtcttaaatcaatctgttaaactctatagatactattacatccgattgggcgtgtttagggtttattattctttgatatatccagtccatagccaatttggtctaactccatcggctgtgaccatcaacgatacactatcggcctatcggccgatcagctatcggttgactgattctgcttttattctttcttgctgattgcaggatcaaatcaactgacacgcccttgacacactcgaggctagccttggacctgcactggagttaagcagatctctcatgccaccgtgttttcgcatcaacaacgctgtagtagtaacatctcggaaaaagtatgaattaccccctgaagaattgtgagtacgaattacccccctaaacctgaaaaccagttatttttcaccctcacctatagataccggatgaaaaaaaaccccccaagcagctttgcaagcggttttggtctacatggcagcccagtcagcaattcttttctttttaaatcagtgggccccacatgtcagtctctcactctcttttacccctcacctctctttctttctcaaaatcctctctcttctccttccctcaccagctcacctcgaggacgacggagctcgggaggacgggaggagcacgggacgatggcgcgcggagtgggcagcggcgaagagggcgcctgcagccaacggcggtcgggacaacggggagggcggagtgggtggaggcgaaggtgcagctgatgcgatagcgcgtgtagggctctaccccgtttgtcagcgcgctgtccagtcccgcccgcaacgctcccttccccagtggtgaaggtgctgcggtggagccgagctcttcattaacggccagatttgaccaatgcgcagcggcgagccgacgcgggagcatgatgcggggatggaggacgagcgctacggacgcctcccagctccgcacatggctgtcttcgccgccacaccttcatcttcgactgtgccgtcgttgcctccgcggtcaccgtcctcgctgtcggtcgcgccgccagttgcgccgctctcgcctccgcctccatgcgtggcgcgctcgccgcttcgccgccggtcgcgccgctctcgcctccgcctccatgcgtggcgcgctcaccgccttcgctgccggtcgcgccgctctcgcctccacctccatgccgggcgcactcgccgccttcgccgctggttgcgccgctcttgcctccgcctccatgccccatgcgctcgcgcccctcctccatggcgagcgtgtgcaggagagcgggccggccaccgccgccgtgctattcagaaggggagggagaagagagagagagagggggggtgaggatctgacaagtgggccctagctttgttaaagaaaatgtttgctggctggactgccatgtgtgctattcaaaccctaaaccgctctcaactgtaccctaggggtttttttgtccggtattaaaaattcatggtgaacgatatctggtttttgagtttaggggggtaattcggtcgaccgctatagtttagggggtaattcgtactttttcctaacaactctaaggctttatctatggagaaaaccctactatctagtgtgctagtatggaggtgcgactagggtttactacgatttttaattgtggcagctaaggtttcgagatgagttgtctcacttccaatccatcttctactcataagcgtcaactcctactatcgccctatgccataatctatcgccctatgccacaatctctatgtaccaaaataagttgattttttaaaggcaaaaattagttgatttctaaagttgaaagtttatcccaaaataaattaatttatagcctcttagctaccctggttcataaatagaacatttttacttcttccatattcttttacttacccacccactaatattactttcttattaatgagcggcacattgattttcttttctcacggttatttttttcttgagtaatcgatttattttggatagagggtgctacaaatgatgatcccaatccggtagcttccctttgtttttttgttcatctcttctcagttttgctccctctgcggattttggcactcaacgtttcacccatcacccatagaaggatttaaaaatgagaggcaatcttaattatttcatttttttccttagtactagaaatgcaataacattatgaggtatctccagattactgagcgataatcctttatttaacgtgttaagttaaagagtccccaaggggttataatcttatgaccctctcaactgattaatccaaaagatcatcacttcatcacaaactaaatcctctaatgacactttatacaccggttcggtcatgatagtgatggcccgtacttgccttttcttttcaacttaacacattgttagttgacaaacaatcaaaaggactaaaacctaaacattaccgagaatatatatataatcagagcttcatccttagtatcccaggaattaatattttatcgagcaaaactatacccctgcacgttgaacccaacaatcgcaaatacaatctactaatctgatttatccattcaaaaatcacccaacatcattctgaagttaccagatgattactatatacacagaaccaagcattggaaattgacatcagaagagaagaaaacaagattttgacaaagaccacctaattttacaacagaaacgaaaatgactgtacaaaagcactgatttctaccatgtacacatctgggctacatgtatatgaatgacataatgctctgcttttttcttgttccattttttattgactaaggctaacctatatactccctctgtttttttatttgatgttgtttagtttatttttgaactaaccaacgtcatataaaaaaggaaggagagagtatatctgtgtctcatgcctactcggagttcttctgcctagccgatgaatatgcagctgcaaggagggcagcaccagtcccagatccctcctccatcaccctaagactaacagtggctgcaatctcctctccaaggatctcaactagagcttcattcagatactctctgaagaccgagtagccttcgaagaggccgccctcgatcgcgaccaccgttcttcttcgcacgcctcgcattgttcgaacctgagttgaaccacaaagggttccatcgcagccgatcttttgcagtatcgcgacaatcgcagccgctgctaggcgggcagctctccgggtgatgatgtcggagactctggcaacaagcttccgggtcttgaggggaacatctggtagctgcattaggaaagaaaaaaaaaagaaaatgtgagagatgtcagtctgaagaagctgtgcactgaacagaaagttgagattattgtgagcagctgtaagaaaccttaagatgttcctcaagtatcttgccgacttctctcaagtccggggaatcatcctcgcggatagcagctaagtttggtgtactggacgaaaaggcatggcaataagatgatcgattttatctttaagtaatctgacaacagagttttgtaaaactcgaaatgaaaagtacttgaccacgaaattcaaccaaaacatagccttggaatgaaaagtgtgatgtttcaatggctcaggccagctatttgacaggccaaattgaagagaactacctacctcagaaagaatctactatacacggaatgcaacgaataaactgatgttcattcccagatctaaggacaagcacaccgtctatgcagaaggtgaaaaaaaccttgcaagatgctatggaaatattcaattattgaaagaaataaggaacagctacaaaccataattagtcactttgttcctattccactaattatgaacaataaccatgctgcatttgtaacattattggacagaactagcaaatggtaagccgacagtgcaagttgataaagcaaataacattgacaaggaaatagatcaagtcaaagctaatgggaaactaaggaaccgaggagagtagcgcaaagagggtagaaattatcacataggagcataacttaaggtactccatattatatactccaatgttttagagttctgttgcaatggagataagagaaacctagcatatatttatttgctaaagcataaactgatctgaaagaattaaattcaagttgggcaccttaagacgaaaggggtcgatagaccatcaacagcagtaccaaatatatctgactcttcagccattttttggaacaccaatcttgcaatttccccaagatacacaccagagatcattttctcaaaaccctacaccaattaaatgacattaatttcggcctaattatcacaaactccaaacttcccatttttcagaaggtcttacctggtcataataattccatgtttcgttgttgaagcatatatcataaggagtcaattctatttgtggaggccgaaaactaccccattccacatttactacctgattcatggaacattgtaatacagaaaagaatcatcagagattctgtctccacattaaaatactgatcaaatcagagatttaaagaaatgaaataaaagattaaaactagcataccgttcgttcagaattggtaacgcgacccaaagatttaataattgcatcgttgcgttcaatatagcaagcattggtgccagctccaataatcacagcagctactgtgtcatcatcataataatgcccgagagctaatgtccccacagtattgttcacctatttgttgaacaatacattgtagaatcaaccagaaatgaatgtattttaatctactagtgagattacatgcatcacacttggaaagcatttttggatcacaaataaagtctcaacaaatatattcaccagagcaaaagaataaatgcaagcttaataaataacaattacatgatctcatcatattcatatatcatatgatcatgcgattattcttagaaaaatacaaaaaaagaggcaggagattacagtggggtaatatacaccaataccatacttccagcaagtgaccaattcaaggaacttaagaatcaagttggttcattttcttttcctagatcctagctagtcagtaatcttcaagccattgtttgaaatattaaacttgtgtcctctaaatgaacatgaagcatattgcttcctagcttccaagtcagttacatatgaaagagatattacactagatgaaatattagcagtcacataggaaatgaagtgattctatgaggataagccaagataagagattcacaaattatctattaatagccacattgtatactcccaaaaggattcacagttccaagtcccagaaaataaaggggcatattttctttacggaccaatgaatgtaaatttatagcacttttgttctttacacatgtgacaattaaagaatttttaaagttcatgctgaagatacactttttggacaaagttcccagttttgaattgcatgtacatgctgataccattttgaaaaaaaaaaacaaataggatgcattgcatagcatccagttgctccaaatttaaactcaagtccataattgaatgtaatcctgttgtcattttgactgaaactcagattgaactagaaaaaaaattagttccattcaaattagaaaagataccaacttaggtacaatttaaggccgacaacaggagtaacaggtcaatgttttagactgaaaactaaatcacagaggaagtgtacctcatctttcttctagcagaaccatagtactttttcgaaagcatgatattaaaaatagtgtgcgcacatacaatggatttatcagttacgaagctaattaagacagccaatgcataaagaagagattgccgatggaataaaaataatcaaaatataaatattcagacatgtcaaatactttttcctttatggaaggagttttttctaatacagtacaagcctgcaacgtaccaatacattgaccttcatattgagtccattccta

SEQ ID NO: 22615 - DNA, 1136 bp, Oryza sativa
aagtgtccctcatctttcttcttccataaccatagtactttttgaaagcatgatattaaaaatagtgtgcagcacatacaatggatttatcagttacgaagctaattaagacagccaatgcataacgaagagattgccgatggaataaaaataatcaaaatataaatattcagacatgtcaaatactttttccttatatgtaaggagttttttctaatacagcacaagcatgcaacgtaccaatacattgaccttcatattgagtccattcctagcaagggcttcatttaggcactgagcaacatctttcccgacctgatattccataggtacaaaaaacagagtgaaataacctaagaaatcaatagtaaaacaaggaggcaagctggcaaggtactgtgtagtgtgtagacaaattgcagcacttcagccatgaaaaaaacgatggaagtaagacgtataaaggtatcaaggtaaatgtaaggggtaaaacatttataagattttgcgttacatattcacaataataaagctattgttgtgatcattgaaaatttagagttttgccagctttctatctatcttgtagtttattgctcatagaattctggaatagaacttacatattacttttctcttcaatttaaatggaaggcatacaatgtaaagcagattaattgaagacatagttttgtaacttacagcctcttcaattgaaaattctttagtccatcgaattaatgtccccgaggaaatggaagtctgtctcacagggaaagaaaatgtaaaaccaagtgccctcccctcaacctccccaccctctctttcaataaaattcttcagtgccgaggcaatgaaattgaacaaatcctgcaaagaaattaaaactcacatacagaaactactaaacgttatagggaagtgaaataaaagggtgaaacatacatcgcttgtacccttagtcaaattttcggggataggctgatgttcaacttttcgattgatgattgtagaccctgcgccaagttctactttcaggactctaaagcttgttcctccaagatcaatggcataactgatgccttcctcgctcctggtcatgtcatgtgaactactgtaagacaattatccaattt

SEQ ID NO: 22616 - DNA, 2066 bp, Oryza sativa
agtgaaataaaagggtgaaacatacatcgcttgtacccttagtcaaattttcggggataggctgatgttcaacttttcgattgatgattgtagaccctgcgccaagttctactttcaggactctaaagcttgttcctccaagatcaatggcataactgatgccttcctcgctcctggtcatgtcatgtgaactactgtaagacaattatccaatttcatatttcttagagaacttgtccacaggtggtagaatgtgatgcaatgactaatagatagaccaacatatcatatatgtaaaaaatcataatgatttcagttagggaaaaatatgatatgcatgaacactacaacattttatacaacaatatctacatcgaatgattcaaatgaatacgaggattacaaaatcattgatgaagattccctaaataaaattcccacaaattctggaaaagtaagttttgagttataagcttatgataagccgtaaaaagttgcattgccaagtacctcaaaatggacctgattttgcttacattgtatcaatgcaagatcaacaaaggaagaagggaaaacacgagtcttggtactgccacataccaatgtcaatgcattgatataccttaattaccatatatcaatgttagtacacacttaatttaccacatatcaatgtcagtacatactcattccagttaccaatttattaccaagaatctaaatctagatgttttggctgaaagttgtactacaaattgtatcactgagacgtgtgttggtaagaagcatgacacatcaatcccgcacttccccctccaacataccacctagcaattaacgtcaaaacagcatccaaccgaagaacaagtaccacaattctcaactgagtgtactatgcctagtggccattatggataccatacaacctacagcccgatgcagacaactgatgaaaggatgtgctggattcattaagaatatgacacttataacaaatgatccatatgattacagggctccaaggaaatcgtaatgtagcataagagaaacatgccataaaaactgttcaaagacttcaggaaattatccatatgattacagggatccgaggaattcgtaatgtagcgtaagagaaacatgtcataaaaactgttcaaagacatcaggaaatgctaacagtaaacaaagcaatggtattgttcagttcaataaaacggaaaatttgcatttcaagaaagttgcattgttttatggaaatgcaaaatcaccattgatcatctccacaaggaactagacaaattaagattctttacagaaaaatgaaaacggccaaatttgactagtgcccaacgcaatcagcactccactcgagggccaggccggtggagtgaaatcagcacaagaattggtaaagacattaaagatcaaagaaacaaaatgcacaacttaaatgtgctgagttcatgggtgacgaaataatagcggttcctttggaatgttctgttacaattacacacagaaggtcaaaaaccaagaaattctctttccccgcacccacaaagaaaaaatcaagaaattctcatcaattcgaaaccgttggaagtgccacattggaatttggaacaaaaacgcagcaaacattgttcgcgtgctcatactccgccggccaaaatggcgagtcggcaacgaaccgagattgcaagaatgaagacaaccctacgtacgacacggtacaacacgacgaacaaacaccaaaacccgagagagagagagagagagagagagagagagagagagaggggaaccatccatgatccggacgcgcggcaacgtcacgtacccgtcggggagcgcgtcgacgcaggtgagcagcatccgcaccttgctcccgccgtcggaggcgaggccggcgaacatctcgatggccagcgagttgaccacccgctgcagcagctccgcgggcgtggcgcaccgctcctccaggtcccgcaccaccgccaccgccctgttccaccgcaccctcgccgcccctcgcctcgccaccatccccgccgccaccgcgcacg

SEQ ID NO: 22617 - DNA, 1820 bp, Oryza sativa
gtggcgaataaataggcgagaggagagagagagagagagagagagagagagagagagaggggcgtgacgtggggatgacgtaggtggcaggagagggtcataaattaattcatttaatcaatttaggaattaggaggagtactgccaaaattaagaggccactggtatgatgtttaaattcttccaagtttgactaaaggaaagaaaagaaaataaaatcctccgtatgaaattcaccgggcagcaatgaatgtcttctatatttgtgtaattctgaaaaagaaatactagtagaaattgttttgatcttccataaatttgctgggatctcatccggattttttttccctgcagtgatgaaggaaagatattaattgtggtatcacgtaatgctatctctatctatctctctctacctacctatcctctgcaatctctgatgtatatcttcttgtaaggtaacaatggcagggcactaatgataccaaaacagaattgattcaaggagtgcatttgtgtttgatggaataaatgtgtatctcacaaaatttttcaattaatgcagatggaagatcacatctcgtttctaaagttgggtatcttttgaaattaatggaggaaatttagaggaattatgaaagaactgaactaaatcacacggaaaatctgtgaaatccttatgttctaaataagtgaaaatggtcatgaaaattcctgatcaaccgatacccgtttctgatttttacgggctaagtaatatggaaatatttaccgatgaaaacacagaaaaagatgtaaaaaatatgggaatagaaatggaaatgattttgctttaataaatgccccaatatttatggtccatttctttatctcactcaaaatttagaggcccatcaactcctcaaccaaatccctaggttaactacaaaagtcaaaagggtgatagattgtaatttacatagtgccatcttgaatttatttcatgatattacacagctacaaagttaaatgtgtgattttacaattcaatgtttccgatttttattacaggttttcaaccaatattgacttgtttccgtctgtatccgtatagtatcggttccggttttccaatattttttatactattatcattttttgctatactgtttccgattttgtttttgaaaaaaaaagagatatggttaagtaaatggttgagacgtttttttgttcgtttccgaccctttttagcccttgttcagttaatccctatgtgggagggattggaggggatttattaacacctattatggtgtagaattattctccctcaatcctctccaatttctttcaatcccctctaaactgaataagacctaagggatgcatttacaacttgaaattaaactctaaccatacagaattcctatgttctaaagaaccccttaactgtgtaattctcataggactcgaacttgagtttctacattatattctacacaagtacctggtacaacaatgtataaaaggcaaatagcttaaacataacagcataatatgattttttttcttttttggtttatgaaatctcttaggccttcgggttttggttgaaattttgtagatagtttatcttttgtagaaattgagattaggatttatcggaccttcccgagccaaaaacaagggatagttttcataaaaatcgctgactcccaataacattcggtcaaattttataaaaataataataataaaatggtctgaattttttaaacttggtcgggaactaagcagttcgcgttctcgagccagtccagtttttatggaaattgaca

SEQ ID NO: 22618 - DNA, 16632 bp, Oryza sativa
ttatcggaccttccgagccaaaaacaagggatagttttcataaaaatcgctgactcccaataacattcggtcaaattttataaaaataataataataaaatggtctgaattttttaaacttggtcgggaactaagcagttcgcgttctcgagccagtccagtttttatggaaattgacaaggttttgtcaatttatattaaactagaaaaagtgcccatgcgttgcaacgggaagaaaattaaggaaaatctcgctggcggattcggccgtttggagcagagggatgtgagccgctgtccatctcaaggagagcgtagccgatcggtgacactgaagatggcggatgtttttttttatgattttgggtgtgttaggtcttagatacgactcatatgttccgcttgttgctatgctcttttttgacgatttgtgttctgtcacaccctgatttttgtttcagggatttgtaaattatttctaaaatttatattaaattttattaatttacaagtgaagtttaatgtgagaaataaaatttcctaattaaaacatggctatatttaatcattattaaattctccatgattaattatattctttggaattttccaattatttactttaataatagaaagaaaattttagtaattatttaaacaattattaatgattaaatgatctagataaatattttgttaaatactttgagtgtccaactattttcataattttcttgaaattattcgagcattggaagtgttttttaaaattcaaagatcatttcggtgattaatttaaatggaaaagtaattaaaatcctccctccttggatcaatacccatgaagtctgttttctgtccctctcctcctcctttcggtctgtttgctttctttctttcccgttcggtccagcagcaacagagaaagtctagggagcatccctcagtccctcctctctctgtcgccgggggcccacgtgccacagtgtcatcttcctgaactcccatgctcggcgaagccggcactgccgcctcccctttgctccatccatcttgtgctaaatcccgcgaatttcggctcaattttcatcccgcgtacttggaataaacctagttttttttccatgtccaaatctcgtcattcccgagtcaggcttccccaattgacggacgaaaatcaggtgtgacaaaaggaaagttacgaatattttaattagttaagatttgatcgagattcccatgttgcaaaacacccttagactgttattagagttcttttttgaatgtttgttggaagagttagaagcgtactgacatgatgtttgaccattcgtatataaatagtttttttttttacttcttgtgatccactacatacgtgttcctcgtgaattgctctaaacattgacgttggaaaaaattcggttgttttttttggaacattttaccaatttagtaaactaagttgatgacgacatgacgtccaatgatgctagcaaccgaccgagctcgtcgatctccaaaattccaaatcatttcaccctacattacctttttttttttttggaaaggcgtttcactctttattacttgccgttgtatgcgtgagcaagtacgcaggaaccgaggaaagcagcgtacaaattgaggcgggccgggcttaatcattaactcgagcaaggaaaaagtacaccgaaggtcccttaacttgtcatcgacttacaaaatcgtccctcaatcacaaaaccagatatataacatccctcaacttacaaaactgttcattttggatccttcggtagttttgaccacggttttatccgacgtggcggttgagtcagtgtgggacctacgtgggtcccactttcagtctctctctcctgtctttctcttctctccttcctcgctctcgcacgggcgtggggatgctggtgacagggctggtgcccacggcggcgcgcgcggctggagggtggtgcggccggcgacggcggctcccagggtcttagcttcatccaggtggcagcgcgcaggctcagggcggtcgaggcggcgagcaggggcggagctagaaaaaaacaaagggggttctactcgcttgctttactctggtttgaatcaaatttagcttgatacgggtgcctaaatttaaactgacgggatatatatatggtgaaaatagataaactataggtaaaaaaaattttttgaaccgggttcgtgggtacccctccagctatactagctccgcccctggcggcggggaggcttgggtacggtggcgacggcttcgggtcccacggcacgccggcgagccgatgaccatgccgatggtgcagaacgcggtggcgaagaagcccatgaccagctgcatctccatcaccagcgcatacgtgacggcgcggccgccggcggcggcgtgcttgtaggcgagctcgacgagcggcagggtcggtccttgcagcatatactaaacatagttgacagcatgctgtgcatgcatgtgttgtgcagaaaacaaaaggagccaatcaaatagatgagctaaatagtgtaatagagccttgatttttgtttctagacgaagtcatctgcgccggtgaagacgccgagccccacgcccgccagcagcacgcgtcgcggcgtgaggaacagcggcgcgccgcggcggaggtaggacgccgacacgggcactagcagcagtgcgagctttggagatacaacgacggtgacgacgctggctgcgtcgtcgtcgggagtagcggcgtaggtggaggcggaggctgacgctgcggctgtggtgcccccccgccgctccttctccgcccggcctcgcgcttgtgcgtcgtcgggagcggcggcgaatgtggaggcagaggctgacgctgcggctgtggtgccccccgccgccccttctccgcccggcctcgcacgtgtgcgtcttcgggtgtgggcgtgtggccggacggcctcgacgcgccccgcctccgccccgccctgccggcctgcctacccagagaagactgagagagtaggaagggagagaagaggggaaaagagaggtgatgacgtgccaccctgacatatgggtttcatgtgggtcctacgtttattcatctgccacgtcaggtaaaacccaaagtgatccggttttgtaaattgagagcatatatccggttttacgttcgaggacgatttcgtaactcgatgccaagttgagggaccttcggtgtactttttccactcgagcaacaaacatatgggcttcgctaaaagcccaaacaggccggcaatatgttgcaccgtgggctcgcggcccaaccaggcagcctacgggccgagccatgcgtgggctcctgaagctggacgacaagaacctggccggctactgggtcgaaagtttctagagggaagtggaataagtccacttggctccctcgaatatagatatcttaataagtgaaatcaacaagctttctccaaggagaatgagccacatcattaaaattgcaaggaccgtcagattcaattggtaaaacgatatagaccgttgaatcataggagactcatcaatgatagtgaaatccataagatcagtcatgaagcttctagacgaaaggccctttggcagagaactcacgttcctagtcaaaatagcctactcaaataaaatatataatttttcataaacataatactatacaatacacaaatatagatggagagcaccagcagctcatctaagtgacccaaatgacagaacaccatccacccgtagcgccaattttgttactcccttcatctcaaaatatataaaattgatcctacttcgcatattccttcatttcaactaactacaaccatcttctatttaatttcttcatgtacttctttatctcaattaatcataaccttcacactttctatgaaaaaaaataaaacataactttcccatttaattttattgtcctctccttaatcccataaagaaaacgtaaaggtacctactctctatctacaaatataggcattacaaatgcttaaaatttattaaaaaatataaggatttatagaataacttaccttcaatctcacctctcattcaaatttcttttcatcttactcaactattttctcaactcctatcattactcggtaaagagatataaagttttatatgattgaacataatctttgttaaacaatatggaaatccttatatttgatgacagggagagtagtaaaaaaaatgtcatgtaattatcaagattggtcgtcaacttctatacgcaggttatgcgaatgcttaccgtcacgcgaagcatgactaggtggctagtaataatctaatttgtatccttaactctaataccaggtattttaacccctaaaacttttaacttttaaaaccggcgcaaaataactccctaagtggttttggctgacatggcacgttcatttagtccgcactgctgagtcatcgtggggtcccacatgtcagcgtccctctccctctatctctttcctcttttctcacatcctctcccatcgccgccgcgggcgcggtgctcccttcctccgctccgcgtcttcggcctcggcctccgcggcggacacctcgccggcgccaagggacgtcgttgcaacccttgtccgtgcgctccttctccgatgctattcgacctcatggtcctccacggccgcgcctcaggctggcgcgcgtccccggccgccgcgccgtcgtccactgtcgttccgcctacgtactcctgcagctccatcatcaacggcaccctcccgccgtcgccggagccgtgcgccggagcagcgaccgtccgatcgacccggagccatgtcgaggggctcgtggttgagggacctataataaacttattcctccagtgaaatgatcgacacgctacggcccacgtgtggtggggcttgttactctccaacagcagttacgatatgggttttcatgcaactaactaccggtgctgattgctgcaaatgccgttgagaccaaaaacaacacgtacgatgggcacggaaaaaggcttaagttgggtgagattttaacgtcaatcaagtcagttagtagtcagagatcatcaccggaatatgcaacgttcaaagagaaaacccaaaaaaaacaaaaaaggaaagcgaatcgatttcagtactcagagcgcttgacctctgatttaaccatcgattcatcagtcgaaaacaacgcatgaaaagcggccctaacgaccgatgtcaactcagtcgatcgatcgaccatcaatttcgtgaggcaaatgcaacaaactcactcgattcgattcgatcgatcggtatatgtgtttacttgattgatgatgatcgatcactggtgattggtcactgccgtcgccatcgttcgtaggatcggattgattgattggcacgccgccatcgagttagctgtagctagccatcgatcgcagatcgagcttctttttttagtgagccgatcgatggacgtcgacgccgcaacgatgatcgagtcgatgacaatcgaatgctcgatcagttcagttgagccttctcctgttcaccgatcgatctatccacaccgaccgcacatgcgtgcgtgcgtgcgttgcaacctagttcacacgacggcgacgtacgtccggtgatcatgtatgggcacttggcacctactaatgtcctccctccccggccggctttgaattgctatactcagcggcgaacgcagaaaaaagttaccagggattctttaatttgacctatgcggactgcggtagaattctcaggtgtccaatataatttggttggcgtgtctcatatggtatagatatataggctataacggtaaaaaaaaaaacatgcaggtatcccaaggacccctgttggaacttagtaggtacgcataggggcagatacagaacaagatttaagggagaactcatctccttctttcttcttcagtcccccctactatttattttttcactattcttctcctttcgtctcctcttctatcaatggtgatccagcggggtaggagggactcgagtcccccagcacccatgctggatccgcccctgggtacgtacgcccctggctatatcctatagctcccgaatggagaaagcgtttggattgtctagctagttgtaatttgccttgttaattttgagctcacctttttactgctacgatcgctttaagattcgtgtggcactcttaatttagcccgctccatcgcctccttccccaccatgactcacttttgtgtaatcccggccgcccgtgtgctaccaacctctctccattgctagctccttcactggcacctaattcgacacctttaattatgttcgtaataagtgtgaccatacttactcatcatagtcactcatatctctttagcagctggcattttatatttgtcacctccattatactgccgccacatcttaaatttaccatcaccacctattgtccttacctgtatcttggtcggacacaaatcttctgcaattctgcttatacaatgtgtgactgataggtccgcctagacacaacacatatcagtgatagctactatagggagtagtattacattggatcttatcggccttgctaatgccactcaagtgctcctctttatcctatccaatgacgacctaatttaaccatttcatagaaagagatgtcattttcacaaccgtcttcgtattgattcaagatcgagaagacaacagcttcgtgaggttctccttctgcaccatgttgtcaacctcctagcacaagctacagtcacataaaatatgtacaactaatatattcaatactgagtgaaggcacgcgtatactctacttagcttaattagaacatgaatcacataccatggtatgtaaaattaagctggcctcatcagctagagattattacatagtttcaagtaatagtgttattgtaataattagctatagtttctttgaagtaaataccggaatgaattacattatctaaaaattggtgttaatgttagggtgacaacccctttaaaaaatctataatgatttgttggcttgttttaaaattattattccgtttttaactattccttcaataattgacctcaaattatcgatagtgttgatgtgcatctgtttgggagcccatatcctataagaaaaaccataattgattaaccctgacaaataaatttccaaataggtagagataacatgccaataaatcccggtggaattgtggctataccagagggcccttgaagacattctctgcgttcattcgtgttttgattatttgtgtcacaagttaaatttggcgcttatttgtgttcctagtacgaatttgtgaggttgactcttgccatttatctattcggtatactttaaaagatgcatacttgtgggtgtgtacatgtgctgtttgttttgtgtagagtaaattgaatcgtcggtacacgaacttgttaggtagatacagtctagtgcacgaacttataaaatgctttggtgtatgaacttgtctggtgcgtgcggaggaaggcgaaaagaacactacgtggctaatcttattgatttaggggctgattaggatatcatgtaaacatatatctgagaaggttgttattagacatacaccttttcaataaacatggctaattttattgatttaggggttgattaggatactatgtaaacatatatctgagaagattgctattagacatacacctcttcaataaaaaatagaaaaaattgagtaggatataatgatagtagaaaaaagatttaaaaactgagcaatggtataagggttagaattataccaaattcatttttttcatgatgaaagataaaattagagaccaaatttataaatattgcatgtcttatgcatactcactacacgtatgcacgtcatatcctaatcaacatcagcttcgtaaaattaatattgccaagttatttctatcctcgtttgcacgaactagacaagttcgtgtattgaaacgagcattttacaagtttatgttctaaattgcacccacctaacaagtttgtgtaccaccaatgcaatttactcttttgtgtaattggatatcctatctttctatatagttataaagaaagacatgcaagaagccacatcatcaacaattttaaaccatcttttggataaaaaaactacttattcatccaattcaatcatttattaattacccattcatctccctttgcttcaccttatagtcacacatagcactgttacatattttgtggataacaccatatttttcgaatacaattcaaataattgtttaatatgtgtgttttgttttattgtgcatgataagatagcatatatttattaggtatcgttacttgaatctattttcagaaaaaactttagtgaagtagagatgcaaattgtctaactacaacgatacccatattgtgcatgaaaataatattcatatattataacaatataccatgatccttagaaaaataaagcatgaattttatttttaataatataaggcatatataaatccacattatcatatattttatatatacttagagttgcacctaaccatttaaaactatgattttgtttgacgataaaactataaaacccgtgtcaaagacatgtggtgctaattagttataataatacctcttatctgaaattgatagtctaattacttaagcatcgggttaattattttaatatgcattcatactattgcaagaaatttattccatattacttaggaacttaattaaacctcataaagaattacaaactcatattgcattatttctacgactacttgacaacgcactcaactgtcgccaccacgtgatttacaagaataataatattatgccaggttatatcatacacacatatatagagagaggatcagtacgaagatcaaaccgttgaaaaacattatagagttgagtagtataagcaatgatcgttaactagcagagattcgacaggtagtttaactgatcaggtatgaaacttttctttttttgaacggctgatcaggtatgaaactgatgcatatagaataaattctgatatgactagctaatctgtacttatcccatcttttttttaagtacttatccagttatgttaccgttaggaaaaaaatactaaagctagttagtttgtcaagaaactgttgaaaagaaggtaaaagcagaaacagttatctttgaccggtttggccgaattaacctttttcctttctgtattttctttctacagagcctaaccttttctctaaagaactgttggcgtaactttatttggtatatgggcctctaagttttagcttaaattaatcaagatggtaagtttcttttctcgtatatattatataagtcatgaaaggtgtagaaaattaatcatgaaagttttagctcgcacggtgattgtcaggactctgtctccgattgcattaggctggatgcttcctttcaccgactagaacggacggcacaacagataaattggatcaaatcgaatctctatctctactattataaaaattaatatgtttttttttcgatatttctgtacgtcatccgtgtatgagtcagtttttttagtttgttcgcttttggaaatatataaggaatcgtataagaaataactatcggacttctaattgtagctcataatttcctaacaaaatatatatacaagtgaatttatcatagtgaatttcaccttaactaacccatatctctatctctactattataaaaatcgaagatgtttttaccggtattttggtacgtcatccgtgtatgagtcggcttttaagttcatttgcttttggaaatacatatccgtatttgagtcggtttctaagatcgttcactttcggtaatatagaaggaatcagaaggaatcataaaagaaatcatgtcacggagagatcctcaatagcggggaatcgtgagaccccccatttgtgagttcggccggggacggaggctcatctcttggaaatcactcgctcgtccctaggatcaccggcgagcttgcacgcaaacggattatacaggttcgggccgctatggagcgtaacaccctactcctgtgtttgggattatggatgagttttacaaaagatttcttgactctagcaagcgcactcgcttcctccctcctggagtttaggtttttttctctacccccccttctcagtgggcagggtcctccttttatagctcaaggagataccacatgcaccgcctctacctaccctctatcggagagggatcccactctacttttcctgggctttaaaccgtgccttctcccggaagctaagcaacaaccggttctcgagtggaaccaggcgccgccccccgcctgactcgggggacagccctgtcattccctcataaatgaacgatgacctgtgatagcccttcctcgagtgacgctcggacgtgacgggtcatacccacccccactccgccgggtacaagggcgacgtgaggacatggttgccctatccgtcggatgtgacggtgccaggccggtcacaaaccggtcacatccgttagacagaggttagctaggcgcgccgcacgtctgcccttaccgcattaaatgcggtgagggacagttggtgcgtcgcacatttatggctgtttagcctgtgctctcgctctttccctccgccgcgtggaagccgggtgagggcctcggggcgaagccgcgggatagcccgagggggtgacgccatgccccgagccccccccccccccgcggcttccacgactcgcgtgacgcgcgaatgaggctaacttgcagagtcacgtggccggagggaaagtaattcccctctacttcacataccccctagtccatatctccgatagtagcccccggcgctatatcaggtatcgatttcctgagatcgttctgacatggtgcctcacgactcctcgagctggggttgtgggcccggtaggggatccaaaaggatatcgccgcgtggccaagttggcatgccaaccataacagcggtttgaccgccactgatcgcgctcatgatgaagatgcttgaggcgcgataatcccggggggtcagtcagaccacgcctcgattctcccgctcgctactcctgcggaggtagtggtgatggtttgctcagcctgcgctcatagccgttgtgcactccacctcgaatgcgccactgacagacgcactaaaggcaggaacagatagaacgggcgacgtgatgagtgggcgcaagatgcgaagagacaaatgcgggcgcgagaatcgtgggggcaagtatgggagcacgaaacgaggaggcaagtgcggatgaagcgaggataaaagggggcggaggcagagactctgcccctttcctttcgccaactgcccactcgtcctttcgcttctcgaaccctaacattctcgccacctcatactgtctcgcgctccacgctctccgccacttctccgccggttgccatggcccaagacaccggcgacgcagtgctcccttcctcccgcatcacagcagacatgcaccttagcctttcccgcaagatcatgccggacggtgccgtcgtgcgggcgggagagtcgcggccgtgaccgcgatatctggagcgatccatgcacctcttgtccttcgccatgacgggcttgattccgcctttctccagattcttccatgaggttctggatttctacgaaattcatgccttgcatctcgcacccaatgccgtgatgacgctggccatcttcgcgcatttgtgcgagatgttcattggggtgcgactgacgatgcggttgttctaggccttcttcattccgcagctgttgcaaggcgcggtggtggggggatgctacttccaaccccggccaggcacggcgggtcagtacatcgagagccatctctgcaagaaatgggaggactggaagaaggattggttctacaccgcgttgccggaccatccgcgacttcgagttcccgctagccctcctgaaaggtccgccgcatggctggcaacttcggagctgggcgaggaatacgacgcggtgtgggatcgccttaggggcctgcagagcctgggcctcacaggggcgatggtctttggcgattacttttgccgtcgcatcgcacctcttcaggaacgatcccgtggagcgtgggaatacattggtcccaacgaccccatgcggacgcatgtgggcgagcgctgggactggggtgcggaggacgcgaagagggtgattcagcgggtgctgggactagactccgccgagccaacactaatcccagatgggattcttcccctctgctgcgaccgcgaccgggagagcattctggccgtgatgtctgccgtcggcgccggtaggagccggtccagccgaggcggcgccagcggtagcgtcatcggcacgggtggcggtggtgcgaccacgggcgggagccgggccgaaggtccaggcggcggtggctcaagggcgcctggatcaagccgcggacccggagacgattccgccggcgacccaaaggggaactcctcgaggtccgatttgccagatttgcccacaacacggcgagcaactcctcgagccatgaatctccgtgcttcttcaggacgttgtacgtcttggtcttgagtcctttgaggatttcggcattggctcgctcgacttggccgttgctcttggggtgggcaagtgaggcaaagcacaatttgatacccatgtcgtcacagtaatcgccaaacagctcactagtgaactgggtgccgttgtctgtaatgatacggttgggcactctgaatcaagacgtggtgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgacctgtaaggcttgagccggctggtgggtctgcttggcgtggaactggcatgccttgctccgctggacccattcttgggcatcttgtaatgcagttggctaataaaaaccttgccggaaggcttttccgaccaaaattcgtgaggccgaatgggctccgcactcaccctgatgagcgtcggctatgagctcgatgccctgctctcgagaaatacacttcaagagtatcccgttggcggcacgccggtatagggtcccttctataaggacgtaccgtttggagatgcgcgcgagcttttcaacttctgcgcgatcctcaggatgagtattgccttcgagataagcccagatgtcggtcatccacacgacctgacgaggggggttagggttgaccccctcgggccccgaggggcgcgggtcgcccggagtcgagtcggtgggcgtgtcattggggtccctcaaagggctcggtcgcaccgatggttgcgcgagcctttcctcaaaggtccctggggggagtgggactcgtgccgacgcaacacgcgacaactcgtcagcaattgtgttgtcgcgtcagggcacgtaccgcagctcaagtccgtcgaagtggcgttccatgcgccgtacctcacggacgtacgcttccatttgcgggtcggtgcactgatactctttggatacttgatttacgaccagctgggagtctcccaagaccaggagacggcggatgcccattccggctgccgccctcaatcccgcgaggagcccttcatattctgccatgttgttcgtggctcggaagttgagacgaacgacgtatttgaggacatccccgtttggcgaggtcagcgtgactccggcacctgcaccttgaaggttgagggagccgtcaaaatgcataacccagtgcccgccacgaatgttggcgtttggatcctcttcttctccgggaagggaaaaagggacattggacggaacaggttcgtccaccggggtccattccgcgatgaagtcagccaggatttgacttttgatcgcgtgccgcggttcgaagtgcagatcgaactcagccagctcgatggcccattttaccactcgtccagtaccctctcggttgtgcaaaatttggccaagagggtatgtcgtcactacggaaacccgatgcgcttggaagtaatgacgcaacttccttgagaccattaagacggcataaagcattttctgggcctgcgaataccgggtttttgcatctcgaagtgcctcgctaacaaagtagatgggccgctgcacctttcggcggggccagttcgtgttgtcaggggctgatgactcggagcgtgcctgttcggaggtctcggggggatcccggactgcctcgggatcataaggctcggggccacctgccaaagcctccgctcctcccttgggggcctcggggtcctcccgggggctggaaactttgggcgctaggccttcgggggatgaggggccattgcaagccgaaggggcctcccgttcgccttcctcacgctcaactactagggcggcactcaccacatggggggtcgcggccaagtagagtagcaatggttcctccgatcccggggccaccaagataggggggaagtgaggtaagctttcagctgattgagagcttgctcagcttcctccgtccatacaaacggcccggagcgcttgaggagcttgaataggggcagcgccctctcacccagtctcgatataaatcgactcagggcggccatgcatccagtgacgcactgcacatccctaagcttgctgggggggcgcatcctctctatcgcgcgtattttctcaggattcgcttctatgcctcgggaagagactagaaaaccgagaagtttgcccaccggcacactgaacacacacttatcggggttcagctttacgcgcgtggacctaagactatcgaaagtttcggccagatcttgtagcaacgtgtcctggtggtgcgtctttaccaccagatcatcgacatatgcctctacattgtgccctatctgattacttaaggtaatacgagtcatgcgctgaaaagtagggcctgcattcttcaacccaaaaggcatagttgtataacaaaaggtgcccacaggagtaataaaggcagttttttcctcatcttccctagccatacgaatctgatggtaccctgaatatgcatctaaaaagcacaaaaggtcgcaccccgcagtggagtcgactatttgatctatgcgtggtagagggaagggatctttggggcatgccttgttgaggtcggtgtagtcgatgcacatccgtagcttgccgttggccttcgggatgaccaccggttcgccagccactccggatggatcacctcgcgaatgaaatcagcctccaggagccgcgccacttcctccctgatgaaggcctgccgctccggggcttgacgccgcactttctgccggacaggtcgcgcatccggccgcacggcaaggcggtgctcgatcacctccctggggaccccaggcatatctgacggcttccatgcgaaaacgttagaattcgcccgcaggaaggagacgagcgcgtcttcctatttggcgtccaaggttccgccaatcttggcggtcttggacgggtcgtcaccaagggggatttccttgacaggcacctcgtcaaccgaggtgaggcgcttcttggaagcgcgggacgcaggggcttctagggcctgcggctccgtggccaccaccaagttgtctgcgtgctgctccgcgtaggcgagggcgatcttgacatcaccaaggacggtgatgggaccagcaagacccggcatcttcatctggaggtaggcgtagtgggtggcgaccatgaacttcaccaacgcgggtctgcccagaaccgcattgtagggtagattgaggtccgtcacatcgaagtcgatccgctcggtgcggaagttggtggagtcaccaaaggtcaccggaagctctacatggccaagcggccatgtgtgtcccggagtaatgccaatgattgggagcgacggctggagcttcatccctggggccttaagtgcatcaaaggcagccgaggagatgatgctcagactggcccctccatccaccagcacacatttcatcttgacattgtggatggtcggggagaccaccagggccaactcccccccccctgagcaagcaccgtcggatggtcactctggttgaatgtgagcttcacctccgaccagcgtgccttccggaccgcctcatgcgtgggaacaacggccagaaactcccgcttcatggccttgaagcttcggtgagaggcgtgagcgcaagcccccccgtcgagcgtgtcgacggtcccctgaggtatctggaaatcctgatcctcaccgtctcagccatcatcagcaggggccttggtcttggccttccctcgccggtcaccggttgaggtcgtgggggcttttgccttccgtcgaccctgccgcttttcctcattagcccttcggaaccactcggcaaatttttgaccgagcggcagtcggcgaga

SEQ ID NO: 22619 - DNA, 8380 bp, Oryza sativa
gattatacaggttcgggccgctatggagcgtaacaccctactcctgtgtttgggattatggatgagttttacaaaagatttcttcactctagcaagcgcacttgcttcctccctcctggagtttaggtttttttctctacccccccttctcagtgggcagggtcctccttttatagctcaaggggataccacatgcaccgcctctacctaccctctatcggagagggatcccactccacttttcctgggctttaaaccgtgccttctcccggaagctaagcaacaaccggttctcgagtggaaccaggcgccgccccccgcctgacacgggggacagccctgtcattccctcataaatgaacgataacctgtgatagcccttcctcgagtgatgctcggacgtgacgagtcatacccacccccactccgccgggtacaagggcgacgtgaggacatggttgccctatccgtcggatgtgacggtgccaggccggtcacagaccggtcacatccattagacagaggttagctaggcgcgccgcacgtctgcccttaccgcattaaatgcggtgagggacagttggggcgtcgcacatttatggctgttcagcctatgctctcgctctttccctccgccacgtggcagccgggtgaggacctcggggcgaagccgcgggatagcctgagggggtgacgccatgccccgagcccccccccccccccggtggcttccacgactcgcgtgacgcgcaaatggggctaacttgcagagtcacgtggccggagggaaagtaattcccctctacttcacatacccccgggtccatatctccgacaaatccgtttaaaaaaattcacatgctaacttgagacgatcggactcctaattgcagctcatgattttctaaaaatatatatatccaagcgaactcccaatttcattttaactaaaccatataacaataataagattaaaataaacttcacccgttgcaacacatgggcatttttttctagtaatcctaatttttattgacttttgggtcctgcaatttgagttttattgatcaatcgtagcaaattaattaactagtaggttttccgcactatttgacgtgaaactagatataaattagaattatatttgattaaactattttccttatataaacaccaaggcaatagctaggaattaaaggaactggtgcgaaatacataatgggatctaaaatttgacagccaaatttttacaatcttgttatcgtgatggcctatcatgatgactcatagagcatgatcacacctagctctattcggtttagctttacctattcgatcggcttaatattgtgtcctactacttttaattagttatggcttttagtcgtgcctttagtcttaaccttctgggtttttgtattctacttatgtcactaattaagcatgctcccagcttgtttggtaactcgagggaaggggattgggagtttacacgagggaattgatgatgagattatgggaatttgatttttaattccaatatcttgtttggtagaggtgatggaaattgatagggagtttagttggagattaggttattaataaaaacggatggctaagatttgtttaattacctgcccctacctaggtattgaaaaggagggagtttcttcctcaattccccatctccatcccaccaaaattcccatgtctcccgaccaaacaaaacacttaatagcctcatccctctaaaatcctaatcccttctaaaaactccctccaaccaaacaggccatccatgtaattaagatttggggcctctaatttttaggggtcctgaacaatcgcacatcctgcgcatgccttgttctgcgttacactatgctctgccttaacaaacagggccggatctacattattaggtccggtgttagacgatatcgatgactttcggcaaaacctatagcaaaactgcttatccatatattataacactatgatccaagcataattagtatattatgacaccgctagacaagttataacaccaataaaccgatgaaccacatgagttggttaaatgtgtgggaatagagggcactatatcaatcgatatatgtttgtatgcgtatacccatgatgattgatccagggtgtaaatctttcagttttgagaatttttatatgcctatagagtgaacgtacggtgactcattttcgacatctcttaattaatacatatagatgaatcatctaattactaaccactccaaaacttgcagtgtcatgcgtgcactaaacttaaagccgaagttgttgacgacgtaatatacagttacatcattacacataatttaaggtgacaaagacggtgacagaaaaaggcaatagaaacgtatgactgcaacatagggtcaccggcacccatggtattatcttttggcttatacttctacatatcaggcaaaatttttaaccttaaatttgaatctgattttcaggttattttttcattgaagtttatttttcaacctttacttttaaatcgataagaacatatacataaaagttttattcacaaattagtttccgtttgtaactatgttgtttagattatttcacaaataagccaaacgatggcaacgttattatgcacctcttaatataaaaatagataaagtttatgcatgtaagttgttaattaataacgtacggttagctttacaatttttttaaaaaaatgtagaatattattttccctcatgttttgccttaatttctcaatctggtctattagaacatgatgttccattaattgcaacccccctcccccaaaaaagaaatgtccatctctgagtatctcaaaaataccagtttaattttgaactgacaaaaaaacttttcttgtggaactgacggttgtttgaaagctcgggctggtggttaattctgaactgtcaaaaaaaactatgaaccaattagctctgcttttacatataggagtataatttttcttgtgaattggtgtgttactatatatgcatgagtccatcaattattattgtgggtttgaattctacgagcaaattaagattatgaacccaaaataataattaaacacatctatcagtgggacccacacaacagtgaccgttgacactagctactattaatgtttagtggcgtgctcatcaactttgacctcctactgtggcctagcttccaccttatccttgaattctctgggagtagatggcgatcaaattgaacttaatttataactgctaaaatttgatcgggattgtaatatattttctaatattcctacattattgttggtccaatttccgttggcaaatggaattatggcaacatcaatcataggctctgcattctgcatagcagaaagtcaggagcaccttaatatggggttcagcaaacaacagttttcagccaccaatactataactcctgattgcaattagcatctgcaaattaataatcactggtcagtctactttgcaaataacatagtctatcaaaattaattattgaagctgagatgtggggctgataaaaggggggcaaaagctagttagctaagctctgaacaatcataatttcagtgcaactatattaaagctttgccattgatttttcttcagatcttctgagattgcagatattattactgacgacccatgtttaggcctgaatatctaaatttcatacacatatattcagtaaaggatatcattaatttgtcactttcattatcgttgagagggcaatgatgtacgtacctggccgggtgaaaaaggtgttaaagctaaagtttctgatcgagatatctgatcaaagtttatctgcaacaaacatagcagtcaggcaccaattttctcatcacaaccgattcattcatgctatatgtgcagaagcaagagagaatccaagccactttattgagcagctaacattagtacttttaggtaagcctaagacatcatgggagagaccagaccaccggttccagtagccatttaaaaccatatactatacgtctatcaaatcatcattagcttaattgtattgttagagcagccccatatatacaaagtttcatcaaaattaattaggatcgatcccatgcaatgcatgcattcggattaaaagctggtataattagtagctaggtagtagtagttacctgtaagataatatccccaatcaattgaacttgtctgattgagttgctccagcaaccaattcactcaattaaaactaatccagaaagatcgaacaacatgatagcaatgtattggcaaatcaaagaaccctcgtttgcacgccttgtccatcgactatatactgtctttctgcctgatatattaattacgttctgactctccgtgaattggtaattaaattaataaaaaccttaggttaattttcgggcatcagattctcacctatgctttcgtaaatcatataagagaactttaattaaaaaaaattcttggtgtagaagatccagcattttgatttggatggaccatatcctcaagtggatggatgatgccgaatacgtagtacagagataaggccccatccgaatttagtggccaaataaattttaaaatctaaaataaccccccaaaatctcgagcaaaatacgtgtggacaggatcgtctgcggcctccaagaaaatggcgctttcagcgcacgtcacttcgggccggcctctcccagccgatccgggccacccggcggggacacgttgtacggcccacatctgtccacgtcatcgagaaacacacgcacatgggggccatgcatgcaacgttagcgaggcacagttgacgcagcagtaaaatcttttaaattttttctttttttttctcaaacgcctacgtgaggcaaaatacctcgacgtacggcgtacaaatgtacagtattacaatctgtgtacgtacaaaatacacctcctaagtacgtacatatacatgtatatatattgcaaccctctctatatagtaatagtaatctaggaagggaaaatgggggctaattcgcctaccacagcgtaccgtattttgtacctgtagcttcccttctatacataccgtaataatacggtatatatataatatacccaatatatatactatcgcgtacgcatctgacagacgtacacttggtgtacgtgtcctctcagcggtcgcaagccaagccctctgtacaatactgtaatgtacaggtacgtgtacgtgtatactacactacctgcggtcacgtatacgcatacgtatgcgtatatgtgtacggaatgcatcagaagctgatggggtagacgtgctgcatgttggggtagaagaggccccaattctgctcgacgccggcgtccttctggttctcgttgaacatggagaagacgtaggtctcgatggcgccggggtggcgcggcgtgccgcggccgacgtggttgatgaggttctggttgtagatccgggcgttggccggcgaggcggacatgccgccggcggagggccagcctgtctcggagacgacgagggagacgccggagccgccgtgcttggccatggcggcgtagaacgcgtcgacggtggtgtcgaacaggttctggtacccgtaggcgccgtcctggacgacggtgccggcggcggtgaagagcgcgtaggagacgtcgacgctgccctggctgtaggtgtaggagaagtaggggtagatgttggcgagcagcggcgcgccggtgcgggcgaggaagctcaggacgggcgccatgaacgcctgcgactcgccggtgaactccgcggcggacggcgggctgtacacggcgaggagcgcctgcgacaccgacgtcgtcaccttgatgtggcccagccccgccgacaccagcgcgccgcggacgttctccatggccgggaccaggctggacgtggcgccgccggcgacctcgttcccgacggcgacgtaccggaacgacaccgacgggtaggcctggatgttgttccgcacccacgacgccgccgcggcggggctggcggcgaggttggagagcacgtcgttgggcgcgccgacgacgacgctgatccccgtgccgcccaccgactgcagcgccgcctggtccggcgcgtacagccgcatcgacgtgatgccgttggagcggtacatccccaccaccgagctcgccggcggcaggttgttcgcgctcatgccgtagcacaccccgatcgcctccgcctctgcatcaccatcatatcacgttagtaaaattttttattactttaattatttacagcaattaattaactattactaagcttgtggttgctttatttttttcgatgtgcattttaagacttgtttatgtgcgtttgtctagtacggacttatataatactccgtaattggttgtagctcattgagtaaaggctgggattctattctattattaaaaaaataactaatttatagagctgtaaataattatgtttttatgtttagttactgttaatgaacagtagtgcatgggtgtacatgtattactgtttaatattaatctcgttttaaatcgggaaatgggtacacatagcaagaaagggcggccggagagtagtgtagaaaagtgacagaatgcgatgcatgtactactattgaagaagtacaaatacatacacatcctttttttgacttattattttttcgatgaataataatttaaattttaatcttaatctcaagaaaaagacatttaactgaaatttgtatgcgcgcttggactagcttgatttaatttgcatattttttttgtgcttctctctctttctctagactctactactggcagacaaaaatgggatgtttttagctttgttttactgaaaaatattatactgattaagttggtgtcaagtgcacgcacactgacgaggaataatatatatttgcttcttgcttagttgcttgaatgctgcaggtttcctgcttctctagcttgacctagttgtcactcgtgactaaagacgtgtctaaagtgtgtaataactttaacaagtatgctaataagctagctcgtgaccaaggataaccttaaacaacgggataagcttttgaccctaagtggattaatctcttactagctagcaatctcactctactacctaaccctgaaaattaggtctaatagttgaaaactctcccctgatgggtcacctcaggcatctagctatagctcttgatgcaatttttttttttgactttggaaagctatcaagtgtttatcctacaacaaatagcatgtacttgcacgccacttgtcagctaatttcggagatggacaaggaatatactacccaagaaacatagagaaattgagagagaaaaaatgagatagagaaattgaaagagagagagagagagagagagatggagatgtaatggtttggtccaacgtcagcagcatgaccgttggatagtccacgtaaggtcgatgtggccaaaggggaagctagctagctaactaacaaagcagcatctaataagctttagctgaagcttagtttagaccacccgtgtgctaatagtcagtgagtgcagtggagtaatatgcaactactcaagaaacgtacatgtccaattaaatgaagcacacccctacaacttactaattgctccaatttgtcaggtcataacatgctttaggacaacataagcaacacctgtcctaactaattaatttctgactactggtgatcatggatgtgccatgtgtttactactactctctttacagtttagttgcactatatgtgtcaatatttgtgttagaacaagactaatagctataatatgtagtacactatttagtagtatatatccatcattagatattgttagtgagtgagtgagttagttactagctagtacaacatgcatatatcttacttaaagaatggaacagtgttggtacaagatatgggagtttgtgtcaacctggaggaccattggactgggcaggtacaatatcatgcatcatttgaaaaatgtcaagcgatagatatatatatatctagagagagaaaactaaagacgacagataatgagatatggtgtggtgttgggttagggggtggttaagcagttgttgcaaccgaatcaataagggaacaaacgaagcggtagggatcaagagagagatagaaaagcttatatttgtgagagagatagcacttgataaattgaattaactttcatgaatgtcaaaaacaaaaaggctatctccagtagctgaattcttagcctaacatgactactgatgagagatagaaagaaagacagatcataaagctaggttatgtg

SEQ ID NO: 22620 - DNA, 1629 bp, Oryza sativa
gatcacttggtgtgtcgttgcaacctctctaaattagtaaattataagcaagcttagctataactggtcatagctgattctattaatcatcagtttggagcatccaaatgtatctggccgttgatcttattataatgcaaaactgatgtgtggataggaaggaacatggtgttgctatcagtggagtgccgttatgcaactgctttctagtataactactaatgaagagataatattaggtgcaccaaatgtgttcatacaaaaactagcctgcagtgtctactctcttgtatagattaattacaatttcatatgtatacaatacgattaggacctttctatggatgaattaatcatttgatcaacatcttgtgcatgaactggtcaagttcattgtttgctatgggcatttggtagattataacatagatatacagagagaagtttcctgttggctgctaaattagcagcctcctagctttatgacatgtatatatatgctaaaaaaggtttaatttgacatgtgccttttggggactgtttaatataattgatcaaattatataggtaaaacaacacacattagggtgaggcgatgtttctcgatcgacacaattcgtcgttgttgtgttaacacaggtctttaattcattattcttatagattttgaaaagattgaaaagaagcacatgtatgcagttttcttgttgatgaaagatgaatgattttaaattttgctgcgggtaggtagttagttcttgctgtaaattatttcaagcatgtgcccaaacattgcctaagcaacttacaaggccacattaaaaaaaaaaaggtaatcagagagcacaactaggaacggttcattgcttttgacatgaaggggagaaaatgatggattaatatatgcagtgtttgacagtatatcgaacagagatgtcaaaagcatctccctttggcaaaccacaaaccgtcaatttggaaagggacgatggcatttgcatttgatccgaacatcatagctgacctctggccggctaaaaagtacaaaacatgtgacatacaaagcccaaaaattcaacctatagttttgtcctttcagtgtactgaatttcatcttaattggctatttttctcatcgtagcaggaacatgtcaccttctcggttgaattggttactcgttacatcgttttgaaattttttttttttactattctccgtacaaatcttcagttggttcgaagcaccgaaacacaagagagtcacacaaataaacataatgcatgctacacggagtttgattaattgtgccccttagcaatttctcttgtcccaatcaggttggttaccctgcgctttttggctcctacgtggacaccaggtcaccccttgtcctgttgctgctgtctctttgagtggatgggaggccgggtgcctagtcggatacatggaggccagaggggccacctggaaagttcactttatccatactcctgcttatgtggacataggagagccaacatgtcatgtcagcatttgtggcatagtggcgactcctcctattccattggatttgcatgtttcatgatgattttattaggcactatgtgcacacatggcctccatgcaaa

SEQ ID NO: 22621 - DNA, 741 bp, Oryza sativa
aagaaaataaatctgacgggtgagtaacacgtgcagataggagagtagatgaaaaatgtgatgacgatgatattacgaatagacgaattataatgatatttatctaaataaacatatttaaaatggcacggatcgaataaacccaaacaagggtatccgggagggacgcacgattctacctgtttttgttatttttggcccatattgagtgggctttccttttacctttgcaataggaaaaagtacaccgaaggtccctcaacttgtcatcgggataaaaaaatgtcctcgaaccacaaaaccagatatgcgaggtcccttaactatacaaaaccggtcacccgaggtccttcggtggttttaacaccggttttggtctacgtggcggctgagttagcatgggacccacatgtcagcgtgccacgtcaaatttcccctttctttttctccttttttttagttctctttgctgcggggagtagcaacgggcggcgcctggtgggctgagcggcggccggcggaggcggcgtgcgagcgcgcggcggccgggaggcggagcatggcgcagaagaggcgacgccgcggatgaacgcgttgccgacgatggtgtcggcgcacgacgcgaggccgagctcgaagatgacggcctcgacggcggcggcctcggcggtggcgggcgcggaggtcgggaggcggagcatggcgcaaaagaggagcgtctcgcggacggtgaggtggggg

SEQ ID NO: 22622 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnnnnnnnnnnnnaagccaaggaagaaagaacattagcatctcaaatagagccatcaaccaccgcaacatagcttcctccaaaagaaacatgtattcttccaaattttgtaagcagcacatcctcacatgggtttctagtctaccaaacagtgcccaataccggtttgaccacgccacttcctgcaccagtccacatacatacccttcaaggttttcctttaaatctccttctctccctccatctccactcccatccctctgctcttggcagtgaacaactgtcctcctgcacattttgtcttcctctcaaaacattgccacagaatattgttcattcttgacacgtagaagagccatgaggccatcactcttgcagtatctgaagctgctcctgttacttgcccttggtggtgtcaccaccatgcatgtgcctaaacaagatgtgccatcatccctggaggaactcacccttgatggccatttcagcttccacgatgtgtctgctgctgcacaggactttggcaacctgtccagcttcccgccggttgcggtgcttcatcctggctcagtggctgacattgccacaaccatcaggcatgtgttcttgatgggtgagcactccacgctcacagtggcagcccgtggacatgggcactcgctgtatgggcagtcccaggct

SEQ ID NO: 22623 - DNA, 733 bp, Oryza sativa
atatatatacatgtatatgtacgtacttaggaggtgtattttgtacgtacacagattgtaatactgtacatttgtacgccgtacgtcgaggtattttgcctcacgtaggcgtttgagaaaaaaaaagaaaaaatttaaaagattttactgctgcgtcaactgtgcctcgctaacgttgcatgcatggcccccatgtgcgtgtgtttctcgatgacgtggacagatgtgggccgtacacgtgtccccgccgggtggcccggatcggctgcggagaggcgcggccccgagagtgacgtgcgctggaaagcgccattttcttggaggccgcagacgatcctgtccacacgtattttgctcgagattttggggggttattttagattttaaaatttatttggccactaaattcggatggggccttatctctgtactacgtattcggcatcatccatccacttgaggatatggtccatccaaatcaaaatgctggatcttctacaccaagaattttttttaattaaagttctcttatatgatttacgaaagcataggtgagaatctgatgcccgaaaattaacctaaggtttttattaatttaattaccaattcacggagagtcagaacgtaattaatatatcaggcagaaagacagtatatagtcgatggacaaagcgtgcaaacgagggttctttgatttggcaatacattgctatcatgttgttcgatctttctg

SEQ ID NO: 22624 - DNA, 2306 bp, Oryza sativa
gattgggagcgacggcgggagcttcatccctggggccttaagtgcatcaaaggcagccgaggagatgatgctcagactggcccctccatccaccagcacacatttcatcttgacattgtggatggtcggggagaccaccagggccaactcccccccccctgagcaagcaccgtcggatggtcactctggttgaatgtgagcttcacctccgaccagcgtgccttccggaccgcctcatgcgtgggaacaacggccagaaactcccgcttcatggccttgaagcttcggtgagaggcgtgagcgcaagcccccccgtcgagcgtgtcgacggtcccctgaggtatctggaaatcctgatcctcaccgtctcagccatcatcagcaggggccttgtccttggcctcccctcgccggtcaccggttgaggtcgtgggggctttgccctcccgtcgaccctgccgcttttcctcattagcctttcggaaccactcggccaaattcttgaccgagcggcagtcggcgagactgtggcggtaagtgttgtgtaccgagcaccacttgtccgccgaccggccctcgctggagggaacggtggggctcggcctatcgccggtggcctttcctttgcgcggggcccgcgtgggcccgtctgctgcaaggacatggccctcgtcatcggagcgggctggtttccttttgcctctcctatctcgccgcttagagcggggggcagattcgggggtagccgcagccgccgcaccggtgctgggagagttctaggcccatgcctcctccttccgggccaccttgtccgccaactcgaagagctcggcagtggtcttgggctccttggaggcgatcttctccagaatgcgattatgccgcacgccgttccggaatgcatatacaaccgcgtgggctggaatgcacggaatagtgttgcggacctgacagaagcgctgtatgtacgaacggagggactcatcatccttccgccgtacatcgtgtaggtccgcctcttcccccgtgcggggatatgtgccctggaagttcgtaatgaactgctggcacagatcctcccaggagtgaatggagccgaggggctgggtcatcaaccagccacgtgcctgacccttgagggccatgggaaagtaattcgccatgacccggtcgtcaccccttgccgccacgataaccgtggtgtagatctggaggaactcggagggattgatgctaccatcatacttctccgtaaggttggggcgaaacttcaggggccaccggacattccggagactcgccacaaaggccctacaacccgtccccccaggggtgagtgtggggggagggccgcctcgtgaagaggagcgtggcgctccagatgaggaggcgccttccccgacatgggcagctcggcgctcgtctcggcgtcgctcaatgttgattcgagcgtcctgcgtcccgtagaggccgtcatgacgcctccggctttccgaggcccctgacgatgttagaaccgtggaccacctcgagatcgtggccgatcgacgagcccttctccttgccgacgaggagagggtgaccgaggtacgcgacgtaccagcggcagcggatcggccactcatggctaactgccgctgggtagtagtgaccaggttggccacgtcgtccagccaacgctgaacaggagtctccggctccaggttcaccgggggatgccgcagaagggcgcctgctgcctgaagcgcgccttggggcgaaccgccatctccatagtcgagacggcgggcgtgtcccggcacgtcgcggcctccctccgccagggggcggagagagagccgaatcacccgaacgagtgagatcctccctccgcgaaggttcgcagcggggaggagttggagaaccatggcgacggtgacgaggacctcggctcgtgccggaatccccactcccgaacggggtgggagtaaacgccaccgcctcctcctctatttccgggacctcgaccatggtcggctaaggcctggagaaaattgggacagaagaaggcgacttactctcggaatgcgcaaccgcccctacctggcgcgctagctgtcgaggagagatcctcaatagcggggaatcgtgagacccccatttgtgagttcggccgggggcggaggctcatctcttggaaatcactcgctcgtccctaggatcaccgacgagcttgcacgcaaacggattatacaggttcgggccgctatggagcgtaacaccctactcctgtgtttgggattatggatgagttttacaaaagattt

SEQ ID NO: 22625 - DNA, 604 bp, Oryza sativa
  unsure (1)..(604): unsure at all n locations
nnnnnnnnnnnnnnnnnnnnnnnnnnnnnnnnnnnnnnnnnnnnnnnnnnnnnnnnnnnnntcctcaaatacgtcgtgcgtcgcaacttccgagccacgaacaacatggcagaatatgaagggctcctcgcgggattgagggcggcagccggaatgggcatccgccgtctcctggtcttgggagactcccagctggtcgtaaatcaagtatccaaagagtatcagtgcaccgacccgcaaatggaagcgtacgtccgtgaggtacggcgcatggaacgccacttcgacggacttgagctgcggtacgtgccctgacgcgacaacacaattgctgacgagttgtcgcgtgttgcgtcggcacgagtcccactccccccagggacctttgaggaaaggctcgcgcaaccatcggtgcgaccgagccctttgagggaccccaatgacacgcccaccgactcgactccgggcgacccgcgcccctcggggcccgagggggtcaaccctaacccccctcgtcaggtcgtgtggatgaccgacatctgggcttatctcgaaggcaatactcatcctgaggatcgcgcagaagttgaaaagctcgcgcgca

SEQ ID NO: 22626 - DNA, 1114 bp, Oryza sativa
  unsure (1)..(1114): unsure at all n locations
ccatgcagcagtgctcttggcaaggggaaaaagggttcaggcattatagattctagattaatttgttccactagatcaatgagaacagtaggtaaaaaatcaaatgtcagagatatgcattgaaagcaaatattaaggttggttaaaaacctgggggcaaaaacaacactttaataaacaaaaagaaggtaaggttaatttagaaaaaacttacaagattaaatacaaattcaaggaagtatctctttttgcttcatcctctacagataaaagtcgggtgcgcgcctgcttcagatcgctatgcttgttcaaaacttttggtgacaatccagagttattagcttgcttttcaataagtgatatgagcttccgtaaatcattagcagcttgtccataatccctgatcatttcgtataaggtggctcttcttgaaattgcctgaaattaagaagccattaatgaaatccatgcacaaccacataaggctaaaacagtccatatataataaatgtatcacatattatgcatatgtaaatgtgtgcaaaatgataactgtgtatcataaaacaagagctactgcactttaccttcagataagttgcatcaagaaccatggctagtgaacaatctgctatagcatcagtaacttgaccgagtgcttggtatgaagcagcacgattgcaaaaacagacagctgaaaaggggcgtgaatcactattacgtgccaatgctgctgaatattgttctacagcctctgagtatcgacgagcttgaaatgcttcattcccagcagcctaaaaagcaacatgagcacaaaaaatattaagttatcattaacaaaaatgaaaggctatctaatcggtttcttgctcattctgtgatgttgcgtcaaacataggaaatagagatgcactcatagttactaattatcctgggagtcaataagttgtttatttcttgcacatcctactcagtaaaacagtagaagttgctaaagttgaataaaaaatgcagttctgactgcaagaaagaaatcatgtatcgatatgatagacannnnnnnnnnnnnnnnnnnnnnnnnnnnnnnnnnnnnnnnnnnnnnnnnnnnnnnnnn

SEQ ID NO: 22627 - DNA, 497 bp, Oryza sativa
  unsure (1)..(497): unsure at all n locations
nnnnnnnnnnnnnnnnnnnnnnnnnnnnnnnnnnnnnnnnnnnnnnnnnnnnnnnnnnnnnnttcagcaggatggctgctcctgatgttatgcagctaattaacccaaatgcaagcatgcatgcatgtgatgtaatatgtaagatatgatctctatatttccattgattcttcagctagcttaattagccagccgagccagccatttcattggccatggcgcccacagagatcaccggaccatgcatcgatctagcggccgaaccctatgccgaaagccggcggcgccgcccagtagtccgccgggccggcgtcgacgccgacgtccaccgtgcagctcaccggaaccaggcacaggcccctgctcctcagatccatcgtcttcgcttcctcacagctttcatcctgattaattaattaattaatcgagttaattattgtcacacaaaattatcgtaggcaccatttagtattttacaattattttgctaaattatg

SEQ ID NO: 22628 - DNA, 2713 bp, Oryza sativa
  unsure (1)..(2713): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacatgttgtgatcattagctatgacgtgagcaccagtgagaaaacaccgtttaaagatgatatgaatgtagtacatgcactgtttgttaggacaagtgatagatagttgattttatttgttgatgtggtggacaagcctatccagttggtgactaacttgttagtttcagaggtcaatgagatagcgatgcatgaggttgtgacaaccaggtaaggtgattgtcacgcccagaaattcccgaatagaattccaagcagaatgtgcattaaaattcccgtccaggaccggccggggtacacaaacgacaaagttgacatacagatccacgtcttacaaacattataaaagtcttacataaatgtagcggaaaacttaaaaggataactggagctaagccttgacttggactgcagcgggaacaccactccacaggcatcctcgacggcacggacgaagcctactcctcggagaaaccaccatctaatgcatactcaaattctgggggttggggaaaatagagcaagactgagtactacccactgtactcagcaagtcataccggaataggggtatgatgcagggaattatcaaggggtagctataatggttcatttgcataaagcggacatttataaacagaagttgaaagcagtaaaacagttgtaataattaatcaatattaatcatccactgtccaacgctataccacgttgcaacaggcccaaccatccacctatactattcaattccagtagactagtctagggtgagtctaatcacggtgaatctggttgaccgcccataaccgcgggcacagctattcgaatagttttactctgatcagaggtgtacaattgtacccacaagacacagccccacgacacgtttccgtgtgccgacatgccaccacgacataccggaaagaggccgtgacaggacccttcgcataaccccctctaaccaaacacaccacacctcaggtttcacccccactcctcgcaaggcagcgggcagtcccctctcgtgccttggtgaatccggaagccgcataggccgtcgcagggcccattcaaactccatcacgcccacccttgcctggatgcgtcggctagaggaaagctacactacaagcccagccgttgcccacgctggcttgtggtaagtacgaggaattcttccagggtttcccgcgaaccggtccttaattgctctgggcgcgaccatcaaaaccatgcacccacggcccaccatttaatattaattaattaaccaacaccggagcagtgagcattaaccgacatcaatcctagaatctgatatctatgcattaatgtagttccccattgtgtgctagttgaactaagcaaaactaagcattccctagtccaatctctagtcatgttatatcccaagctaacaaaggaacatggtacaagatagcatggctatgacagtaggtaaacatcccatagtgatattataaaacaatgcaatatttgaaggaaaacaatggagcatttgcaatataggatcaacatgttcaagtgacaagcatgacttaccttgctctgcagctggaggaacttcggcgactatttcaaggtacaccggagcgtcgggagagccggaatctaagcgacaaacaaagcaaacaatacaaacaggctataagactactgaaacagagaacaaaaccatttttaatggattctacacatttttcttgatttactgagacttgaatgggcttaaacggagctgggatgaattagttataaattttagaagattcattgtgtttttactataaacggaaaaatccttaattgatttattgcgcaataaataaatcccagggagagagagggggcagcgccaacatgtgggccccacatggcagtgacccgaggtgggcggtccacggcggaccgggtccacggaccggggaaaccggcgcaccatgtggtgcacacgtggcgccgacgtggcgcacacgcggcggccgaaccgacggccccgatctaccctacccaagggtagatcggacggcgggtgtggctcgcggccggcgtgcgcgggcacggctcaagccggcccggcggccatggcgcgcggcggctagcggcgcgcatgcggcggcggcgcgagacggtgaccggcggcgacggagggcgacggcatcgcggcgacgcgggcggcgaagcggcggccaagcggctagcggcgcgggagagagagagagaggaaggggaggggggagacctcaccaacgacgaccgacgacagcgagcgatggagggcggcggcgacggcgggacgatctccggaacctcctagcgaacacggtggaaggggttagagagggagagggaattggaagagggcgaggacgccggtcgaaggcggcggccatggcggtgctcaccggcgaacggcgcagagtgggttccggcggcgggatccaacgg

SEQ ID NO: 22629 - DNA, 17434 bp, Oryza sativa
acgtggccggagaaggcgggaacgtgtgcgcggcggcggatacggggcgcggcggcgccggctggaggaaggggacgggcctgacaggtgggccccacctgtcggcgaccctgggagagaggagggaggcggccggctcggctgggcctcggcctgtcggccggcccagcggaaagaagggggggaaaggagagaatgggccggcggcccaattggaagaaaaagagaaaagaaaaaggaaaaagaaggaaaatagattttcctgggattaaatattgcttgtgctcaattttaattggttaaaattatttctagagctctgaaaattccactaaaaatcttgttagcgtatttcgacatgtagaactcaagaaaaattccacatgccaaatccgattattatttgtattaatttattagggttttctcttgcttttacaccgatattttctctggtggattataaattcaatttaggcttgggaaagaacttcagggcgtgacagtgatgctcaagaatctagcagttgtatgttgattgggatagtctagagatagctccaattccacataaccaagttcctcagcttgctattgattgggatgcattagtgatagaacattccacaacaacttggttgatctatgcctttgatggaggaagatgaaatgtatacatttgttggacttagggctgaggacaagagagccaaacaaactaggcttgaagttgagaggcaaagggattatgttcctacaccaggtccagctcataccgaagggaacttgaacattaacaaggcagagattgttgttaattgatgtaatacttggtgaatctgaaattttctataactaggatgatcctcctatggaagttggaagcttatatagtatgattgaatttaggtcaattgtgaggcaacacgctgttaaggggtaatttcagcttgggacaaagaagattgataaagaaatgtttaggggcttttgcacagctgagagatgcccatgggctatcgtggcaaggttgatgcctgatgaaagatccgtgagggtactaacaactaactaaataaatagtatctcatatttcaaatattggtttggctatatgagttgtctcatggatgtaaccatcttatgtgtgtgtgtattgcaggataccataaaaaaattcgcccattctcgtgcatcaacagggagagtaaagataaagatggcaagttataagtgggtggcaaataacacaattccttttctaaagaaggatccaactatgggtgcaaagcagctgatggggacttagaaaccaagtacaatatcactttaagataccatactgtgaatagaagtatggcaaggctaaagataagatttttggtacatatttgtttaacttcaaggctaaggttgagctgaaaatgtctaaaaagtgttgtggagatagattacaagagattgttgatggggtttattttcatatattctattgtgcactcaaaccttcgattgatggtttcacgaatggatgtcgaccatacttgagtatacactccacagcccttaatgggagttggaatggtcaactagcttctgctacatctatagatggacataattggatgtttctagttgcatttgtattctttcaaagcgagaccacttacaattggacttggtttatgcaacagcttcattaggcaattagggaacaatcacacttagcaatctgctcagacacttgtaaggggctggataaagctgtgaaaaatgtatttagtacaacagagtatagagaatgcttttggcacttgatatagaatttcacctagaaattttatggtctagtgtttgggaacatataccctacagctacgtcttacataacagacaaatatgagcattacatgaataattcactagacaaatccagatgtgaggctatatctagaaacttaccacaactactttggatgaggagtaagttcttagaaaagataaaatgtgactttatcaccaacaatctggtagagtcatggaacaaatggatcaaggatttgaaggatcatcctattgtagatcttgtagatggcatcagagcaaaaacaattaacctattggcaaggcggaggaagataggtgagaaattggatggcgctagattagcgtcatgctgaaccttcagggagaactgcaggataagcacggaaacacgctcgccgcacactggcgcgccgtgcgtgccatgggccacggcacacaggcttgacaggtatatatgatgaatcatgaattgctcttttatataccaggattattagcttttttcgcttggggatgtgaccccattgtttgtttgttacacaagttatccttttgatgtggtgtggtatgtaccagaaaaacaaaagaaatattcagaattgaaactgatgtgctcttggtgtgtcatccaagtcttgaaacaatgcgacctctgatgaaaggatcaatatcaccgtccaggacagagttcaattctgacagctggaggcctgtgttgagatcatgaaccaatttctgaggcccaaatttgtaccttcttgtctctcggctgtacaattcctccaccgtctgcctcttgatcgtcttcaggttcgacgatcttaactctctggatataacaagtagctttgctttcagcctgcttatagctttcatcttgtttgcgaagtagcttcgctcacctgtggagatataaagagtcagagctgcatgagagttcacagtgcatgaaacatttggttaatttagtacctgaactttcagcagtaactccagttcgaatgtgttgaaccctaatggctgaatttctgtgatcccgcctcttatgatcactaggggaaggagaaatctccagatcattctcgtccaagtgaagattaactggtctgtctaagaagagaggaattatatcgaccctagctgacgttgcctgcaagctttggtcaactttaggttagccattttgatataaaacagcatacggtgaatgccatgataaagttgtgtgcacaatatgggcatccaaaaacttgtacagcagtttatccaggtctttttaaacacagaagtcaaatcatgttgacattgccactattctactccctttgcttaaaaaatttggatggccaatatttcagccagaccgattaaagaaaaggggtcacagtagttgaaaaccatgtataaattctgaactatttttagaaatttgcatattaaacatgacaagctgaaacttaaacctaagtatgtgctattactttctccgttgtatcctaatggaaggctacgtagttcgacttttgttcagtattttgctgatgcggttctatatgtttgccttggttggtacatacatatcagtcagttctagtgaagtaacaattttaaatattggagtccaggttttctttatttgatattacctgtctaaccaattgcttgaactaccttgcagaacatctcatggttctctatgcaaatgtattagggaattgcaaggaattctaatctcatcactaatgggtagaacaaaattatgataggaactaaatattaacaatagaaaaatgtaatcacctcataagtgccagcattatcgacagaaggatagatcattctgtgagttcctttttctccagtaagggtgccaaacatgtactctgattcaatttctatggctgcagtccatacacgaccacttgttgatgtgatcttctcaaccagcccatccttacaaccttgtttccgtgcccaacttgaatacatgcaaaagatcctctctgcccatagctgcaatggtaaaaaaaatcttgtttataaaaaactcaaaaggtggaaatggttaattttgctcaagaaagaattcaggtaaacatcaacttctataaaactgcaccacagtgctgataaagtaatagctaagaatttagatttggaaggaatatttatagtgaccctccatgagcaattgagcattttatatcttcattcacacgattcttaggcatatgtattccttaatttaatgagcagcatttcaataataacacagattcatggaacgaactgagcagtaacattatggaaagtacaaaggtagtgttattattactttgttagtacaatgttggcgttcttttattcttctctcattaagatccaatgaataattccattaaccaacattctataatcaacttgcctcagaagcagcaccatctgatccagcagtgacgatgatgcaagcgccttccttgtcgtacggacccttaagaagcttgtacatctgataacgatctagaaactcagtagcatctacggaggtcttgtatgcctgcttaaacaactcaacattgatgacatccatctctgagagttgactaatcagcttagcctcttcagcctgcaccgcatatcttaagcatcaaaaggagaaaaatgctaaattctaaatcacaatttctgtagtgaaaaaagaaggataaaggggtggaatttttgaggtggttagagctgagtgaagggcagacaatgcacacagttcagtcctgctatcaagcattgtccattcacacaacagtataggaagctttactttgtccaaatgtagggaaattttctgaagcacatcttgcaacaaggaattaagcaatcaccttatagcgaaggtctttgagatggtcgaccactctgatggcatcagccagagcagagagtgtctcgtgcgatttagctggattgtcccacaagttgcgccccctcaacacctcttcctgtctgattctccgcgcttcctccatctccagtgcactggatgcagtcgtttcgacccggacaacggcatcttcgatcctctttttcaaagagtacaaaccttggtacaatcaacaagtaactgtaataagtctgaaaattctgcggtttcaattttaatgacttctgctcaagttattctctagtgctgtcactatgtttggcctgaaaaattcccttctcttttaacactttagcatgatttccacaggatttatccgcatgaagcaacataatcaaagtactagtagcttgtattttcgttgcattcagattttgcatttgattgaacttgaactatgaacattcaggacagttcttactcaatacaagataacaagaacaggtatgtccacggccatattagtaacattgccactgaaataagccacgctctcagaaacaatttccacaacctaacacaatagcagagggctgacccaaagagggagccgcggggactcaccgagctccttgtaggaggcggcggtggaggcgccgtcgccgcggccgtccgccgggagggcggcgactcggccggcgctggaccaggggcgggagcgggagcagcagcggggcgacgccgcggcgcgcacggacgccggagagggcgccgtgggcgccatggatggtgagcgcgagggaagggggagggggggtttaaagagcggcggcgagcggcggagggaggcggcgcgcaggctgaggggctgggtggcgcggcgtggctcacacgcgcctcatccgccgcccaatcagcgcgcgccaactattctgggcttgggttgtgtgcccgtggccagtgggtgttgaactgttgacaaagcgaaaatggccgaatttttgtgagggctcctttgggacaaaggagaaacattggaaaaaattagaatcattggaaaaaaatttcgacctttggaaccaaggaatgggactggaagatttgtaaggattgcttttccacaccccctattttataggaattctaacatgagcacaaacctcttgttttatatgttttagttaagcctaatgcacactctctcttgctcgggtgtggatcccctagagttggggatcaactccactgggtggatttaggataatcctaaccgtcctttattttgtacggatgttattcattttcttcctcaaatgtttttttattatctagacatccaaaacctccttgacatgattatctaactccgaactggagcgtttcgacttctgagtggcggcatgatgagactgctagaggcagacgagcatggagcataccaagtgggaggtggcacatggtgctgaatctaaagccaaaacatgcccataagggttaacaatgcttcatgtaaatcagtgatagatgcacatcaattgaggcttcggagaacgaaacaattcatcatcagtgcacatcatagctcaattggctacttcttctttgggcatgggaaagggtggacctagcccacagctaaggcccgcggtgccctttagtgctctcacagtaagctagctcatatatggtggaaatttgttgtggtccatggggttttgacaccaagccctagcccatggcctagggtgccacgggccagggtccgcccctaggcatgagcgcatagctatcgtatgtgttttcatattctttgatagtagtaggctggcaacatcaacattagttctccactgaggccgcaatggttgccgccgagaaagaaggcaaaggaaagatgttgcttattccaatctattcactagaaacaatggctacgattaactgaaatctatatggtggagttgaggccagctgcaggggatctgtactaccctgcttgccatatctatactctctctctctctgtattttcaaaatcctgtgttccaaataagcaccaaaagtatcaatactctactatttttttaagtgaatcatgtttaggatcatattttcttacctgatagttctaggtattagcatatccttttactttagactaggtaagaaatttttaccctagattagttgtttcggatgagtggctcaaagcgtacctctcatctccatctctccttgcatgttgctcgtctgcatatataaccaacaaactcgactacaatatgaatgtgatgaaagtaaaattcagtggtataggcctgacactagcaaagcacagtttataccatgcaaagatagagcttgagttgcacgaaactaatatcgatctgtgaaggcctagaggaacaatctcaatgtcctcaatatcgagttggggctagcacaggaaaaggtggaggcagagtttgattgcttgagttgagcaagcatggatctttagctttggatcaatgccaaatggtgaaatggaggtggagcttaaaaaaactgaagctactggtggagggcaatattgacctcgagtggaagccgccaccagcaaatcaaagaacaaggttagttgcactagccattgggcggaggcggaactcgagctacacatggctacctttggaggagatcattgttgacgtgtcgacgtttgatgtcgcgattccgatatttgcatagtatggggattgttggtactaggatatatgcgagacttaggtaaaaaagatggggacgaggatttttatacaggttcgggcccctgaattgtcaggtaataaccctatatccagttggccgaagccggtattgctcttattcaccataatcacaccagtacaatatttggggtagcctatctaactgttgtcgacatggcggtctgaagttctgactcgtagtcgacaacagggtagtcttcctcctcgagttcgtgcccagcgagatcaaagacagcgctagatccctacggccggcctctgtaggtaccggatagggttgatccaggcatatctctgatgtcgatatctggcggcttgtcttagcgtatgttggcttgtatgttgatctttctatcttgatctattgttccgtcccccctctcctcctaggggccttgtatttatacctataggtgcccctttgtccaagtagaactagggaaaccaatatggatacaatccgagtagtcattgtcgtttccatgtagaactctattcatccttccttatgcagaactcctcctatatccgaagattgttcccgtataagacatggtatgtggtgggtcctaccgagattaaatcaactactattggatatgtggtatccataaccctgacggtggacggagcttaagtggtgtggaagcaaagtacctagacctagtgcagtaggtggggtggagctcgggttcacaactacaacgaggattctacaatcaagcgttgtcctagtacaccctgtgcttgtacttcgttcatgttaattaactcatacctagacccagagtagcagatacgaataaaggagggtgtaagagaaggaacatggagagtattctgtaatgtgcgaaaggaaaaatggtctaaagtgaactatgatgataaaaagtaatccaatatgcaatatgcaatcttctagtgaaattcatagcatcttatgcattttttatgcaggtttgacagtatatttctcttaacaatcattaaaattttatatagtttatatagtaagtccaacacaatatcacggaaagcattttcacgtgcagtcaaaatggatctatggaaagcattttcacgtgcagtcaaaatggatctacgtaagcggctcggctctccacctgtcattaaagacctgtgaaaattaggtcttcgtattcagacggccgactgtctgtgtagatcgaacatgtggccatattaaaatgtctgcttttgaaaattagaaatgtttatgaagttgtaatcttaaaatacatatgatatctgaaaaatattcttcgtatgcattacttttgttctaatcctcaagagattagcagcaactagaaaattgtggggtgcctagtgcgccggcgcgcgccgctggcgcttaatttgttggataagataattactagtagtatattagtgttagataatgattgtttaagataattatcataatatataagattttcttttttcacgagatttttttaactaacaaattgaaaataaatatatattcgaagttaaatttttaaaattttaaatccaaatttgaaaaattttaactcaaaatttgaatttttcaagtcaaattttaaaaacgttcaacttttcacctcagatttgaaaacttttaactcaaatttaaaaacttttaacttatatttgaaaactttcaactcgagatttaaaaatcagcatgaagacacggggatgacatggcgcgcgcgccagcaagcgcgaattagccaccgcgagaaaattgccccaactgtaaacttagacgggcccatagcccccagcccaagcgactgaaggcccattcggcagccttcccggggcccaatcaaatcagtctgtgagagagcttgggccctcactcccggtaggacggcagcctccatgtagaaggcccacataataaatgtaaattgctcagcccatacacgtccaggtttccagagagataaatgtggcccatcaattaccaaactaacaacctcaaacaaaataaataaataaataaaaatgagtataattaaaatgaaccgagcgcaggctgcaggtgggggaccacatgcagagtcagcagcaacagcgacccgccgtgtcctcatcgatcatcggttaggccggccccagtggcggctgattacgaccggtggcgccggcgaccgccccatccacccacgcccatacacgcacgcatgctgtcgtctcctcgtctctcttccagcttgtcctcctgtctcattttatatattctatctactgcttcatattataattttttcgagtcaaacttaattttttttaaaatattaataatatttaaagtatcaaattagttttattaaatctaatattgaatatttttcataatatatttgttttgtgtggaaaataccactatatctttctataaactttgatcaagaaatttgattaaaagaaaagttaaatgagttataatataaaccagagggagtagtcatcggccggtcaacatcaattgttcaatcgttccatgtaaagataagatttatgatagtatactacacacatgtaggtttagctagccacgtgtgttgttgctggtatgtactccggccagtcatacgtggcggtagcagccgccgccgccggcggtgtcccaccgggcagtcatacacaaggggctcgatctctggataggccgcgcgaattaatgcaagttggccaagttgtggccgctggatgcatgcatcctacgagtttgtgtgtgtgcatatgctttgccggcttgcaatttgtttactgcttgatcatcagatcatgaccatagttccgaattccgattaattagatcgatcccagctaatcatgatcagcaggtgcatgcatatgtctcggagcacctgatcaatgctgagtaagctaacaatacctactgatctgttcgtgcatgcatacgctgcatgcttgctgctgattatatctcgatccaggccaggcaggcagcttcccgtgtggcctgaatggatcgatggtcgcgtgttgtttgcgtgccgattttgtgcagctagccaaattaagtctatagctagccgagaaacctggacatatgacatgctcgatctgcagcagctgtgacgaacgaagctagagaaagtcacaggaaattaaggcagagcgagcaggcaggaggcagcatccaggtcgtctgagatgtgatgagcgcacgcacaaaatcacgccaggattgcagccggccagccaggtgagctccatgcatgaccgctcaaattttaagcaatcgcgcgcaaagcgcttgattgccagacgcaaatgacgatcgacgcacgtactttcgcctaattttagttggcttgccaaacctttaattttattcgttagattttaaattaaacgcactgaaaattagctctttccttatatgccattgatctaaatttacgcaccctctcataccactctcgtctgttgaccgttaacttttaagtaaagaaaacgtatttgcccttctgagtattggacatggctaacaactcagaagagcaaatatgtcttttttacattagagttaacagttaacacacagtcaacagacggaagtggtacgagagggtgcgcaaatttggatcaatgtatataggagaatagccaatttttaatgacatacaaaggatcagaccaattttcagtaacatataaggaattctctctttcacgaataacttgctcagcccgccctcaagttgtatagtaggtccatcttggaataaggttttcccgcctatctttaacttgattcccgctaattataatcgaaacgtttttcaaattggaattttctagttttcaatatataatgtacaattctatagtagtacttgttaacgtagaaatacaatgcaatattctgtacgtagtactagtacttgtcaaaattaaattaaacgatacatttgtcaaaaagcacaagcctacgaaggctggatatatatttatggacaataatccttaaattaactggctgatttatccaaaatcttaattaagccaacgaaagatcgatcatatcgacggacacgattacttttttacttcaccattaattaattaactaatgcgtgattaacaaatccatgggctccagacgtcatcgagggccagattaactaacctctatacgtacacctactcctcaaattcatatgctttttatactttatttcttaattaattcctcttcgtgttttttgttaagttaaatgacggaggcgcatatacatacgcatcgatcgtgtacgtcattgtttaatttaagccctgtcagcctatagctttgtcgtctctctctctctcgtgcactcaacacaaacttaaacagtacacatatagtctagtgcaaccggtactacctaatataacgacctgcatgtatatactccctccatcccaaaatgtttgacaccgttgacttttttaaaaatatttgaccattcgtcttatttaaaaaatttaagtaattattaattcttttcctatcatttgatttattgttaaatatacttttatgtatacatatagttttacacatttcacaaaaatttttgaataagataaacggtcaaacatattttaaaaagtcaacggcgtcaaacatttagagaaggagggagtatatggtatagtgtgtactagcctttctaatctcaaaatagttagcatatataaatacagatatttaaattagttatcatgcatatataataatcatcgatcgatcgcttgtgcactgctacatttgtagctgacctatatatgtctagcttttgtgatatatatatgccgtgtatataattaaatagtgtgtgttacatgcatatatacattgcgtgtcatatgatcatatcatcgtctctgcttgatcaatatatcgatatgatcgatggacaggccacgtacgtaagagctagcaagtagattagcaaggatatcagagctaggatatatattaaagctaacaagatatgtgtatgctacaaaagggagaaacttaattgtactcgatcaagctacaacttaatcattactaattaattaacaatgtggtgttgcatcatatcgttgcagcttgacacttggagctcatatatcctgaccaatggctgcttagagctaagctaattaagcacgtatagtacgattcactaagtaatagcacatgatacatatatacaagctaagccgaaagtaaggcggctaagacgcctctcgtgacagcaataatccatttaatttgtctatacacacgtaatgactgattcatgtgtgtgtgtgtatatatatatatatatatatatatatatataattcatcttctagaagatcatcatcatcatcgatcgatcacctcgtgattatcgatagatgcactattgcacttactgcctaaatgtatataattattacgtgatagtgcatctctctgatcaagatgcaggcagaatacaatcgttagtggtgaaatcaatcaagatccaacacaatcactgtacaggattaattaagtttttgcaaaaatgttgcgcatatatatacaagtaagtggctagttaagatcagattgtttataacactgaatggtatatgagatgtgccacaatatttgactttgtacacgggttgaactcgacgtcaatgggatcaacaacaatacacgcctagctactactcgtacctactactactactgctactagtcacttaatcaatggagagatcagtggccgagtcttgtaagcaattgaatcatgaggtaatattgatgtttacacgtttgaaaactataaaaccactcatcctgccagctatctatctagctactcccaataacttgatctactctcttttcatcacatcctattttttaaaattttgtggagggaagagaggtctttaagtttggcaagtgtgtgttatcatttgttagactgaaatgattaaaattagtcgtctagtgtttagctctacctgcaccatctttttcatttacacttaaatcttccctaaatgattgagattagtttacacttctactattaatagaaatattgatattcttcattatattagttgttttgtggagagaaaaaaattaatgtagtaacaaagctaacctagcaaggggactgatgtatatcaagcggcgtacatactctttttttaagaaaaaaatgtctcctaccagaacacctatagacctaaacagtgcaactgattaataattaagtaaacctatcttgaatctctctccatgaaggagaatttgtacggcaccaatgctcactgagactgactatttgctaaggaccaccgtataattggatatataaggggttaatatgcttgtttattgattcttgagtattgatgtcgtgacaatttgctagtaacttaggccaagtggattgttgttgtattaactaactacacacaccctttgataattattgatatgtggattatcttgtgatttttcaccatgtactcttatcatacatatgggtgtggacaacgacttaaaaggtggctattaccgaagttttcttattttttgaactttttaaaatttttactttaaaataaacactttcaaaacttagttctaaagtctgaaccttttttatcacgctagttgcgttatttgatcatgccagtctaactggtgtggcgagataaaactgtcacgcccgatatgtgtggtgtgtcagtgttggtttgccaaaccaaacgggctggcgtgattaaaagattcagattctagaaaagttttagaatggtttatttttaaaaataaaaaaagttcaaaaaataataaaaaaagagattaccactacactaagacatagaattgttatggatagccattgggaaaattttgcattcgtgcacacaaactgtctattgggaaaagaaaattacgctagtagacaaactagctgttgaaaaaaatgacgctcttggtcatgtacaaactatttaatttccataaaaactatatgtcaacgattctgtgtcgtagggtgatgtgcccgtgatacatatagtaataaatatgccttaaaaaaataactgataaaattaactttgagtagttacttacttacacagtcaaacctgagctatatatacgtaattaactaccacatacatatatctatatcttagtttgaatatttttggttaattaattaaacataaataggaaagtgacatgtctgattctgaagcgctctctagctagggtgtgtggtcactactccccagtcccagtctgtggcctgtttgaaaagctgagatggggttgcgtttgcgtgcgtgcgcgcgcgtgcgccggacgcgtacgtcctaatcccttgtgagcccccaatcgaccattccattccactccctaggacgcaaacatgtggcatctcctccccacaataacacaatctcattatgagttgatgacaaggccaaagctacaaaacaatatatccatatccatctgattgtttttttaattttttttaatatgccaacatatatttgaaagggaaatttatatataaatcgctttcgaagcatgcccatacacaaacacaaagtcctacaaattaggcgtccgtgtcgacctgtgtgaccgcccggctgctgcgtgcgtgcgtgcgtgcgtgcttctagctagctcttgtgtacaacgagacgctgcagctttccgacgtggcaattttgcagcttatcctttttttttatgatatatactctccctatctaatgtgttcaaattaaactcgatcttttccaaatggacaggcgcgctagctagcttctcccagtttcttaatttgttttgtttctattttaattttgtgtggctattcaaccacgtccacgtcatgcaatgaaacctctagctaaaatttctatggaaaatacgtacgtggaatatataaatgtatgtaattaatgatatacgtacaagcataatcaactatatacaaaaatgcgtgtacgtgctatgtactagctcttattgcattaagctatatatatatagttctttatgtatactgttgttaactatttgtgtacatatgtacacagacatatagagtacacatatatatacacacatgcgtaaatatacgtaccattgtactctcgatcgtacgtatagagatgtatacatgtatgggccggccggggtaaaataaacggcgtggaaatcttatcttatctggatggaaacaacgtaataggggcttcaagttgttcctgtggctgcatgtgcgtacgtggcttatccactcatgtatcatctatgatcctggctagcctagatcacaaagctcaatctactacctctgtctcatattataacactttctagcattgttcacattcatatagatgttaatgacatacatatatatttagattcattaacatatatataaatatggataatgataaaaaatcttataatatgaaacgaagaaaatactgtactactactgtatgatcgacctagctatagctgcagccgccatcaaaagcatcgagatcaacaggatgagatcgatccaaggagaagaagaagctagagaaaggaatcgaagaagaagaagagaagagagaagaatcactggaactctctctctcattcatcaccttgcccatcacactgaaggtgataggaaaggaaagattctgggcaaagtaaaccatccatccatgtgaccatgacatggataaatcaatccatccatgagctgatgaccggtcgagatgtagctagcacacgtttaattaattaattaaattcgtttttatcctcatacacatatttagttctctcatttttatccatacacatgcagcatatgaaagttaagatgcagatagatgttaagttgcttgttgatttatctagctttcatatgatatagtggaaacaaaatatccgggtaatccggcaaccgtggctgtcgatcgatcttagccattaactgctgcaattgtcaggtaacagtggtgggtggtcttggttaatcgatcatcatgcatgactcattcatgcatattgcaggcccccacatattccaaattatgctttatcctcatagatctccattaattactccattggccactaccacctttgcccatgcaactagtactagtgtactctatatatatatgccattcgttttccttcagaaatacttgggcctcttattttctgaggccaggaaaataatcaaaaggcataagcatctttaacatacatgtatgttaatttctcttagaaagataaatgtatatacatgcatggttgtgcacaaaggaattaataatgcactccctccgtactcgtaaaggaagtcgtttaggataatgtttaagttaaacattgggaatataaatcatgaataactctcaagtttattgagtttgaaaacgtaaaaaatatatgaatagatttgtcttgaaaaatactttcataaaagtatacatatatcatttttcaataaatatttttatagaaataagaagtcaaaattgtgttttggagactgtgtcgctgtccaaaacaacttccttgacgagtacggagggagtactatatacccctctctacttaaccctgatgttggtagcattatacaataagttagcatgtgcaccaacttgctgatgtgtcagctagatgagcttggaaggaacacaaatattctttctcagctactgtttggctcatgactttggtgacggatggctaatgcttgtactcctatattctctataaattaacaagagcaagaagacatggaaaaacatcggactcatgtagaatcacagtccaagaagataaccacttcctagagccggccaaggcaaattaaagtac

SEQ ID NO: 22630 - DNA, 1762 bp, Oryza sativa
  unsure (1)..(1762): unsure at all n locations
nnnnnnnnnnnnnnnnnnnnnnnnnnnnnnnnnnnnnnnnnnnntctatatatatatgccattcgttttccttcagaaatacttgggcctcttattttctgaggccaggaaaataatcaaaaggcataagcatctttaacatacatgtatgttaatttctcttagaaagataaatgtatatacatgcatggttgtgcacaaaggaattaataatgcactccctccgtactcgtaaaggaagtcgtttaggataatgtttaagttaaacattgggaatataaatcatgaataactctcaagtttattgagtttgaaaacgtaaaaaatatatgaatagatttgtcttgaaaaatactttcataaaagtatacatatatcatttttcaataaatatttttatagaaataagaagtcaaaattgtgttttggagactgtgtcgctgtccaaaacaacttccttgacgagtacggagggagtactatatacccctctctacttaaccctgatgttggtagcattatacaataagttagcatgtgcaccaacttgctgatgtgtcagctagatgagcttggaaggaacacaaatattctttctcagctactgtttggctcatgactttggtgacggatggctaatgcttgtactcctatattctctataaattaacaagagcaagaagacatggaaaaacatcggactcatgtagaatcacagtccaagaagataaccacttcctagagccggccaaggcaaattaaagtaccaagagagaattccagcagcacaaaagctagaggtttattactagcaaagccagtatatatcaacggcctgtagcaatctgctgacaggacaaggtgtgttcttgcagtccacataagcagaaaccaagtaaggataaacataaaacgacgtcatttcgatcgattgagtatatatatacttctagctagtgatctctcttccttgtcacatatatttcgtctatgttatttatttacaggcccactactacacatcgtccttgtatgggcaaaaaaatattctctctgtcctagctggtcttgaggaaatatttctcgaactaaaaccaattattgaactcttttaaagttgacaaactagtaggatgttaattaaacaggtcacattttattttcagagcaaaaggctagctagctatatagttggaggttggagatagaagtcgatcatccatcaaccagttgctgcctccaattaattctcaaaattttgaagtccgcgtatatattgttgaaacaggaactcaatttaattcatcagcaattgacaggtgactagcaccatatagcatgcagctagccaataatccggaaaaagaaattaaaaggtagatccaagaatgaattagagctagagagacttatatttataaaacgtcctccaccatgacagtgaccagatgatataaatccatgcgtagtacacggatcgaagcaccacataagcaatctgatcatcatcatcatcctcgtcgtcgacctcgtatagctcacgagccagctttgcatggaggccatgtgtgcacatagtgcctaataaaatcatcatgaaacatgcaaatccaatggaataggaggagtcgccactatgccacaaatgctgacatgacatgttggctctcctatgtccacataagcaggagtatggataaagtgaactttccaggtgcccctctggcctccatgtatccgactaggcacccggcctcccatc

SEQ ID NO: 22631 - DNA, 1364 bp, Oryza sativa
tagggcgaattcgagctcggtaccccatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctccccctgcagtttcggtgcctgtcgctctcactgcgagtttaattattctcttctgctgcttaattgctgctgctgctgctgctgctgaaagaaggttaattaagctcgtctcgtgccgtctcattctgcccatcactcacacgcatcgtcgtcttcgtctatgggaccagtaaaaacctcgcatcaatcactttcgttaaaagatcaggaaacctcaattttgactgatcttctctgatgactcacctctctgaatttttgcttatcgagagtcgttctctcaaagatatatctatcctttttgagtggtggcacctcaccaaaacaaaagtgcatatatatatatgtctgaagaatatagtataattgactgcagtttaattaacaagaaaaattactgcgagtagtaattaatttctgcaagcaagcatatatagtatcttgggagcatgccgaaagggatgtttctagctagctagcagctagcttttagaggcacatttcgtacacaaattaactaacaatcttgcagatgaagtctttgcatgtttggtgcatgcatgcatgtcatctcacagttgcttgcatcttttggaactttagaatgtttcaacacataacctagctttatatctttctttctttctatctctcatcagtagtcatgttaggctaagaattcagctactggagatagcctttttgtttttgacattcatgaaagttaattcaatttatcaagtgctatctctctcacaaatataagcttttctatctctctcttgatccctaccgcttcgtttgttcccttattgattcggttgcaacaactgcttaaccaccccctaacccaacaccacaccatatctcattatctgtcgtctttagttttctctctctagatatatatatatctatcgcttgacatttttcaaatgatgcatgatattgtacctgcccagtccaatggtcctccaggttgacacaaactcccatatcttgtaccaacactgttccattctttagtaagatatatgcatgttgtactagctagtaactaactcactcactcactaacaatatctaatgatggatatatactactaaa

SEQ ID NO: 22632 - DNA, 1563 bp, Oryza sativa
  unsure (1)..(1563): unsure at all n locations
ggtaatatagaaggaatcagaaggaatcataaaagaaatcatgtcacggagagatcctcaatagcggggaatcgtgagaccccccatttgtgagttcggccggggacggaggctcatctcttggaaatcactcgctcgtccctaggatcaccggcgagcttgcacgcaaacggattatacaggttcgggccgctatggagcgtaacaccctactcctgtgtttgggattatggatgagttttacaaaagatttcttgactctagcaagcgcactcgcttcctccctcctggagtttaggtttttttctctacccccccttctcagtgggcagggtcctccttttatagctcaaggagataccacatgcaccgcctctacctaccctctatcggagagggatcccactctacttttcctgggctttaaaccgtgccttctcccggaagctaagcaacaaccggttctcgagtggaaccaggcgccgccccccgcctgactcgggggacagccctgtcattccctcataaatgaacgatgacctgtgatagcccttcctcgagtgacgctcggacgtgacgggtcatacccacccccactccgccgggtacaagggcgacgtgaggacatggttgccctatccgtcggatgtgacggtgccaggccggtcacaaaccggtcacatccgttagacagaggttagctaggcgcgccgcacgtctgcccttaccgcattaaatgcggtgagggacagtgtgcgtccacattatggctgtttacctgtgcttcctctttccttcgcgcgtggaaaccgggtgagggccgcggggcgaagccgcgggatagcccgagggggtgacgccatgccccgagcccccccccccccccggtggcttccacgactcgcgtgacgcgcaaatggggctaacttgcagagtcacgtggccggagggaaagtaattcccctctacttcacatacccccgggtccatatctccgacaaatccgtttaaaaaaattcacatgctaacttgagacgatcggactcctaattgcagctcatgattttctaaaaatatatatatccaagcgaactcccaatttcattttaactaaaccatataacaataataagattaaaataaacttcacccgttgcaacacatgggcatttttttctagtaatcctaatttttattgacttttggtcctgcaatttgagttttattgatcaatcgtagcaaattaattaactagtaggttttccgcactatttgacgtgaaactagatataaattagaattatatttgattaaactattttccttatataaacaccaaggcaatagctaggaattaaaggaactggtgcgaaatacataatgggatctaaaatttgacagccaaatttttacaatcttgttatcgtgatggcctatcatgatgactcatagagcatgatcacacctagctctattcggtttagctttacctattcgatcggcttannnnnnnnnnnnnnnnnnnnnnnnnnnnnnnnnnnnnnnnnnnnnnnnnnnnnnnnn

SEQ ID NO: 22633 - DNA, 614 bp, Oryza sativa
  unsure (1)..(614): unsure at all n locations
nnnnnnnnnnnnnnnnnnnnnnnnnnnnnnnnnnnnnnnnnnnnnnnnnnnnnnnnnntgacggttatggtcgttttcaccggtagaaaccgttatcagctggacacttgccaagaggagaagggagatgctttttggatgcttaagcatctccacattcccaaggcacctctaggcctataaatacccctcctctctctcatttacaacacacatggagctgaattacatgagcctctattatatcttttgtacattataaaataggtagagagtgaggggaagctctggaggagtacccgaaagtttggcactctctccaacttctaccttttctaggaggaattctggaggagtaccagagctgtcggtacactctgctccgggttcggagaaacttcttctattaagtaagcattcaggatctttttttatgttatttaatttcttagtctaagtgagataaattttcatctttacgggttcattgtttagtatccccgtactaagtgctctagtactaggactttggataaaaaaaggaagtcctgcgaagtatagagtataataataacttatacgtggtgtctacgttagagattacctttatttgt

SEQ ID NO: 22634 - DNA, 1044 bp, Oryza sativa
catatcattattcatacaaaaattataaaatagtccaccaaataattcttatttatttttttgaagttttaaattcttttaattttcaatttagtttgttttcttttatttaagattaactttcactatattttcctactcaactattttataaaaccttctttatcaaataaacaaaatttctatatattctttcttttcccacacaaattttctctctcatcaacttacaacaaaattttggagacaaaaaagtgtgcaaaacatagctccagatgtaatatgaccaaaaaaacattggaggatgaagttgctaaccttttaggcacctccgatttgtatataatcaccaaagtaaattcactagaaattttggcatgacctcctctcttttttgaagaaattttgaagcttgctcgggctggaggaggaagaagacatatataaaggggtgggactttagtcccggttggtgttaccaaccggggctaaagatcgacgggatctttagtcccggttggtatcccgggggggggctgataagccctgacagtatttgaaccgggactaaagaccaaccgggactaaagatcaaatatgcctgttaccctttttaaccaggactaaagatctttagtcccggtttttattgcaaccgggactattgtgaaaatagcccgaccgacgaaagatggtttctccactagtgtgataatctgcctcttgtatttagggattttttctgcgagagcaggcagaatgtcgcccttgtaaatttgcaggaaccgcagtatgcgctccaacatttctttaaatttcttcatctttccatactgttctataggcatttgagatggcatttggctatccacatattcttgcttcctagatatcttattgtacagatgatagagttctgtaaagtgctggtccttcaagttcctcacctgccagtgcataaaacataacaataacaaatttattcgaagcttatatggacatgaacacagaaaaagaaaataatcgatggattatgtatcctta

SEQ ID NO: 22635 - DNA, 9836 bp, Oryza sativa
cgggactaaagatattttcccgctatttccaaattcttttcaaacccagttagggttaagaaccgggactaaagataatagcactgaatattgaatttcgttgcatatgtgtttctaaaatagtaaataatgcattaaaattatttaaagtcgaaaaattaatgacaaaaccttcgaaaaattatcgttgtctatagtaaattaagtggataatatataataagcacgtgaatgatttaaaattgttaaaaattctaataatcatatataattagcatatgcatgatattaaattgttaaaaattctaataaacatatgtaaataccacatgcatgatttaaaattaataaaaattctaataatcatatataattagcatatgcatgatattaaattattaaaaattctaattaacatatgtaaatcccacatgcatgatttaaaacttttaaaaattctaataatcatatataattagcatatgcatgatattatattgttaaaaattctaattaacatatgtaaataccacatgcatgatttaaaacttttaaaaattctaataatcatatatacctagcatatgcatgatttaaatttgttaataatcatatataactagcatattcaatacatccaaaatagtttacatcgtgtacaaaacaattacggcaatacatcggcggtgacggttgtccgcatgtactttctcctcactattgttccttccttgtgatcgctacatgtgtaaggggtgtcttcatttgataggaggatactagagtcaatcgtcaccgtgaaaggggattgcccatcaaactgatcgtaatcctcgtcagtcttgtcatctactccgacgatttttcttttgcctgggagaaccacgtggcgcttcggctcgtcaggccctttgcccttctttcctttgctagacatgtccttcacgtaaaaaacttgcgttacatcattggcaaggacaaaaggttcgtctgagtatccaaccttgttaaggtcaaccgttgtcatcccactgtcatcaatcattacgcctccaccagtcaacctaacccattggcaccggaacagagggaccttgagaggtccatagtcaagttcccatatctcctcgatggcaccgtaatacgtaccagtggtaccatcgtgtcccatggcatcgatacgaacaacactgttctagttcgtgctcttcatgtcttgggctcttgtgtagaatgtgtacccattgatatcatatccctggaatgtcgcaatcgaaccagatggatccctcgccaggaaggccagttgttggttaatcgtctcgttacccatgagatgttgtcgcagccacgcggggaaagtatcaatgtgatgccgtgtaatccatgcatcggacttaccgatgtttctggcgtgaactagagccaagtgctcctcgatgtaaggagccaccaatgaagattgttgcagaaccgtgaaatgggctttacgaaataaattgttgtctaccgtcattattgctttccttccgagagtcccctttccccgtagtctcccttcatggcgtgattcaggtaccctgattgggtgaagatattcaataaattctatgctgaattcaatgacctcctctgttccataccccttcgcgatgcttgcctctggacgagcacggttacgaacatacttcttcagaacgcccatgtacctctcgaaaggaaacatgttgtgtaggaacacaggcccagaataccgatctctttgacaaggtgacaaagcagatgcgtcattatattaaaaaatgaaggtgaaaatatcaactcaaagctgacaagacattgcaccacatcattctaaagggcttctaacctatccggatcgatgaccttctgcgaaattgcattcaagaaagaacatagctttgttattgttgcctggacattgtctgggaggataccccttattataactggtagcagttgtgtcatcaacacgtgacagttatgagactttaggtttgtgaactttttctccttcgtgcttattattcgctttatattcgtggagtatccagatggtatgttgatgctctccaagcattgaaacataattttcttctctgccttgctaagagtgtagctggctagactcaagtaatggctgcctttcttctttggttccgggtgaaggtcgccgcgttgttccatatgcttcagatcattacgtgcttccagtgtatctttcgactttccatatacacctaggaagccaagaaggtttacgcaaaggttcttagtgaggtgcatcacgtcgattgcgtggcggacgtccaagaattcccaatagggtaactcccaaaatatggagtttttttccacatcgtcgcgtgaccatcttcgctctctataggctggctgccaggcccctttccaaacactactttaagatctttcaccatagcaaacattgttttcccgctgcgatgtttaggctttgtacggtggtccgccttatgttcaaagtgcttgcctttcttccgtattgggtggtttgcagcaagaaatcgacgataacccatgtacacaaccttcctacagtgcttaagatacgtactttctgtttcatccatacagtgagtgcaagccttgtaccccttgttggactgtccggataggttgctaagtgcaggccaatcgttgatggttatgaacagcagcgctcgtaggttaaactcctcctgtttgtcctcgtcccacacggggacaccttccttcttccacaacagtttaagatcttcgaccagtggtcgtaggaacacattgatgtcgttaccaggttgcttggggccttgaataataatcggcatcattatgtacttcctcttcatgcatagccaagggaggaggttgtagatacacatcgtaacgggccaagcgctatggccgctgctcatctctccaaaaggattcatgccatccgtacttaaaccaaaccgtatggttcgtgcgtcctttccaaagtctttaaattttctgtcgatgtttcgccactgcgaaccatcggcggggtgtctcagcatcccgtcctgttgacgttcttcagcgtgccaacgcatcattctagcattccccttattcctgaacaaacgccttagccgtgttattatagggaaataccacatcaccttagcaggaattctcttcttcgttagctgcccgtcaacctcacctggatcatatcgtctaatgttgtatcgtagtgctttacaaatagggcatgcttctaggttctcgtactcctcaccgcgatataggatacaatcattcggacatgcgtgaatcttctgaacttccagtcctagagggcagactatcttcttagcctcgtacgttgtctcgggcaatttgttttcctccggaagaatgttcttgacgagtttcaataaatcgccaaatgccttgtcactaacaccattttttgccttccattgcaagaactccagagtggtatccaactttttgtgcccctgctcgcaacctgggtacaacgacgttctatggtcctctaacatcttgtccaatttataggcccccttttcactttcgtagtcctccttggaatcctgcaacatctgaccaagatcttccgcaacgtcgttataatcagcatctctgtcctcctcgcctgtttgatttccttcaaatccagcgtactgagcaaagtctggaatattgtcctcttccacttcatcttcttccatttcaaccccttgctctctgtgggatgtccaacaattatagcttagcatgaaccccgactcaaacaagtggaaatgaatacccttattgcagaatactccttctgattcttacacttattgcatggacaacaaataaaacccttatgcttgttagcttcggccactctcaaaaaataatgcacgccgtcaataaactctttggaccgccggtcaacgtacatccattgccgattcatctacatgaaatgaaaaaaaatcatacacaaataatcattcgtacaataatgacagtcatacaataatgataaaataatcacaaactctttcaatagtcatacaataatgacatatcattattcatacaaaaattataaaatagtccaccaaataattcttatttatttttttgaagttttaaattcttttaattttcaatttagtttgttttcttttatttaagattaactttcactatattttcctactcaactattttataaaaccttctttatcaaataaacaaaatttctatatattctttcttttcccacacaaattttctctctcatcaacttacaacaaaattttggagacaaaaaagtgtgcaaaacatagctccagatgtaatatgaccaaaaaaacattggaggatgaagttgctaaccttttaggcacctccgatttgtatataatcaccaaaggtaattcactagaaattttggcatgaccttctctctttttttgaagaaattttgaagcttgctcgggctggagaggaagaagacatatataaaggggtggggactttagtcccggttggtgttaccaacgggggctaaagatcgcgggatctttaagtcccggttggtatcccgggggggggctgataagccctgacagtatttgaaccgggactaaagaccaaccgggactaaagatcaaatatgcctgttaccctttttaaccaggactaaagatctttagtccgggtttttattgcaaccgggactattgtgaaaatagcccgaccgacgaaagatggtttctccactagtgtgataatctgcctcttgtatttagggattttttctgcgagagcaggcagaatgtcgcccttgtaaatttgcaggaaccgcagtatgcgctccaacatttctttaaatttcttcatctttccatactgttctataggcatttgagatggcatttggctatccacatattcttgcttcctagatatcttattgtacagatgatagagttctgtaaagtgctggtccttcaagttcctcacctgccagtgcataaaacataacatcaacaaatttattcgaagcttatatggacatgaacacagaaaaggaaaataatcgatgaattatgtatccttagggaacgacttagaatcgggcgcccgatagggagggggaaaaatcgagcgttgacgtcagcatgacgtatgtcggcaaaaccactttaaactacgttttctcttaaattatttatccaaatcatgattcgattgcaccattaaattcgttgtaattaaatctttaaaacaagacaacacatggatatatttcgacgaaaattttttttagcttattattgaattatttttaaatgttgcacgatgttccaccaagtatattgaaattgtttcactaagtagatcgaaaatgtttcaatcgtttaaatcgggcgttgtttaaatcgcccgatcccccccccccctgcgccggtcgcccgagcagcagtattttcgttatcgttaagttgagaaatatgacagtgataagatttctcattagcaattaccccatccgtcacaaaatatagcaacctaggatcggatgtgactcatagtactaggatatgtcacatccggtccttaggttgctgtattttaggacagaggtagtacatacataggattcaaaaataaatcgacatttgttaaatgaatcatggtatattcgttcaatttaattagtttaatgatcaaggaaaatgctgcaaaagaaattttataccatgtgctccagtccccgcacatagagattccccatctatatcttaaatactgctagagtacagcacatctacatgtcatactagtagtgcatcaatgtaccaaaaattcgatacaactttatttgtttctataacaagaaaacacaggagttggtggagaaacgaccaaaaaagaaaaaggaaggaaaaaggaaccgagggacaatggggattggaaaacgagtaaaactattctaaaactcaaaatcgtgccaaatagttgttgccttagttttcaccatgcttaggctgtttattaagtttgtggtgcgagtgtttagtgttagtatatttgatattttagatattgtgtacgctccttcatattcgaggaaaagaaagctcaagtttatgtcttgtttcgttttcttttaatctagatcaggatgatctcagcttctttattttggagcttgtttattatgaactctagagaagtcatgatgaattagaagcttgggagagccaaagtgattttagcatgccttaccatttgatacaactactcttgccaatcacctgaacctgaatgtgttgtttgagtagtggagtacgtagatggcacataaatgtcaaggttgtcagcacacaaaaagatacattagtggcgatgttatcaaatactcccttcggggtcgatagtacttgtcgtcatatataaaaatatcaacaattgaaatattttttaaaagtaatcatattttagaaattattcatagtcaaagattttaaactttgacctcaccattatccaaaatgacaagtattatcaatccagaggaagtagcaagctacaaacggcatgaaaagggatggcatcggcgagtgaaatctgctcatgcttataactggaaaaaattacagagagaagtgaccaaaggaaagattgcaaaaaatttactgcacacctggagaggcctgcggttgctgtggaatgttcgagttagtaatttgcgtagatgattggtgaaactgttgttcttgtttgcgcacaggctgccttctttgtgaacttatggcattgataatttgcctctcgtattctgggatttttttcccaaatagtaggctgaatgttctcctttttaatttccaggaaatgcaatgcgcgctccaagaataatttaaattttttcatctcttcataatgatctattggaatctgaggtggcatgtgtctctgtagcttttgaaacatctcatctcattgcataaatcagtgagttcagtaaagtattggtccttcaagctcttaatctgtggataaataaagagaaacacacataaatttgtacaaattttcagttccaactttacatgcaaaattaaacaaaaagcgtagagttaggtggcaaacagatcaaaaggaaaggaagggaaaagtaaatgaggggaaacaggaagttttttttttttgaaaaaagaatacttaacattctctagttcttctatcaacaatctagatccatgtgaattgaaagcttcagagtgcttaagggattataacataccttaccatgtcatatatctcatcttgcaaataacattgacctggatgatcagtttgagtagtaatgtgcatagttgctgcataaaaagaaaaagattgtcaaaacctgaaacaagatactttgatgaaaaaaaagaaggcatcaatagcaggctagtacaacatagaatggatgccggtagcatgtggacttttttgtgcctgctatcgaaaaactaaaaccacaacaatgaactaaaggtcagattgcaaaagttatgcagagtagcctttacaaaattactgcgactttacacggatcgaaattcgaaagcacgtttgatgaaacgtaggcacagatcaacttactactgaatggaacttcttgaaggccgcactgtgcctgagtatattgcatttgttcatcaatgttattttgttgcaagaacatcccggctgaagtttgaaagctttgttgcactgaaggcttctgttccatccccaattcttgctgcagttgattcgactgagactggaacgctgccataatatgccgctgtgattgatgttgctggttgtgctgagactgaggttgcatcaaacccatccattgctggtgatcatgcagtgggtgctgaacctcctccatctttacttgttttcgcatatgcatccgtggaatgtcagaaacaattggcacagtttcaagaagctgctgctgtagagttgtcataataagataaccctgggagtccaattgttgtgactgatgcagggacatggaaccatttgactgaaccatggaatcttatttaagagtttgttgtaatctctattgtattggatatataaatacaatcgccctcccacgttgggtcgtgaggcgtctcataattctctacatggtatcagataccggtttccttctaccctaattcgccgcttcctctggccttcgctttttccgcgttcgcttctcttccactgcccacgcgacttccgcgtccccaccaccgcgccgcgccccagcgatttcccctcacgatctcgccgcgccccagccccaccgcgccttccgcgtccccaccgcgccacgacgcaccgcgccgcgccctcgctcgttccgcgccgcgccctgcctccgcgctctgcccccatcgcgccacgccgcgccctgccctgctctgctcatgctgcgccgccttctatcttcgccgcgtcgtgattattctgcctctctgccatgtctaccgagtccacctcctcttccacaacctcgggaacaatggcatctacatcatccggctctactccatcttctgctgccagcaccggggattctaccggctcgatcttcgtcaacccgtatgccaccgtcaacgtcaagactcacataccaattaccctggagctcaagcaccccaatttcaacaagtggaagaccttcttcacttctatgtgttgcatgtttgggctccttcctcacattgatggcactgcaccccctcgtcccgacgactcgacttgtgcacaagccgattgttgtgttcggggctggctgttcggctccgtttccgatgctatcctcgacgtcgttatggaacccgaccagaccgcccgcgacctatggctcgccatcgacgatctctttcaagcaaacaaggaaccccgcgccatctatctcagtcacgagttccactcaatgacgcaaggtgacatgcccattgccatttattgtcagaaggtgaagactgctgccgatgccctccgcgacgtcggccaccccgtcaccgaatctcagcttgtcctcaacttgctgagtggcctcaactctcgtttttcgagcaccgccgacaacatcaccagcgcccctgttctgccctccttcacctcggcgcgcaacaccttgttgctcaaagagctgcgagttgccaatgcacacaaggtccaggctgagacaaccatggtggtggctgtctcctctgccaatgcctgcacttccggcacctgtgcgtcctcttcttcatcatagtctcgtggcggtggctccaacaacggtggtcgccgcaaccagcgacgctacaatggtggccagaacaacagcagtggtggcggcaatggcggacgacagaacaacagcaacggcggcggctatggcaacttcgggaacaatttccagcagcagcagcaccaggctgggccacgacctaccggcccatgggtctgtttcaatccatgggctgtgcagcagcagcagtctccctggcgtcccagcaacagtgccggcctcctgggcccatatcctcaagcacacacgacatttgcaggcccatatgtctctccaccaatgccgggcttgccaccaatacagcaatctcagcccaattgggatcaggcaggtctgattgctgccctcaatcagttgtccgtgcaaagtccaagtccttgggtgcttgacacagaagccacttcacacatgtcctctaccgacggtattctcgttactcgtcttc

SEQ ID NO: 22636 - DNA, 13225 bp, Oryza sativa
  unsure (1)..(13225): unsure at all n locations
atcccctaccctgtggcatcgtcgtcttggtcatcccagttcagctgctatttagagtctccacaaattagctattcttccatgtactaagatagatcatagtttctgtcatgcgtgtcagttagagaaacacacgcgtctacctttttctcggtctcagtctagtacatcttctccttttgagcttgttcactgtgatgtgtggacctctcctgtcttgagtacttctggctttaagtattatttagtggtgctggatgattttagtcacttctgttggacttttcctcttcgccataagtctgatgttcaccagcatattgttgagtttgttgcttatgttacgacccagttcggctcttccattaagtgtttccaggcggataatggtaccgaatttgttaaccaagccactacctcgtttctcgctagccgtggaaccttgcttcgcttatcctgtccttacacttctcctcaaaacggcaaagctgaacgcatgcttcgcacaatcaacaattccattcgcaccctactcatacaagcatccatgcctccttcttactgggccgaagctctagccacagccacatacttactcaatcgaagaccctcaacttccgtccacaactctattccgtttcaaatcctgcatcacaaagttcctgattattctaatcttcgggtttttggttgcctctgttatcctaatcttagtgccacgactcctcataaactctctcctcaatccgctgcctgtgtttttcttggttacccggcttctcacaagggctatcgttgtttggacatttctacccgtcgtgttttcatctctcgtcatgtggttttttatgaacagacattcccgtttgcagctattcccgaaactgcttcttcttttgattttcttctatagggtgtttctaaagcggtagctccgtcctccttggacgtcgagcatccgctttctctaccggtcgctccctctcctgaggtcgagccgccggatgacttggccggccctgatatgtatcggcttcttctccataatagaaggctacaatcatcgcaagctctagaaccagctatattggcgccttccagtgcatcctctggtgccgatgctagtactacgggggggagcatgtcttcttcatcaccagtgcaaactatatcgaattcttctattgctcagccgcctgccttgcatagtgttccttctgctcggccgctgatctctccatatcgccatacgtatgtgcgtcgtattcagcctgtggcggttcatggtcctatacgcaccaccagagcttttcgagctgcacaacatacacaggatcaacagcgtcatgctatggtaactcgctctcagaccggcaatcttcgtcctgtccatcgcttcaattatactgctatgcagacttctgtttcgccagttccttccaattatcgtagtgctttggctgaccctaactggcgtgcagctatggctgatgagtacaaggctcttgttgataacaacacttggcgtttggttcctcgacctcctggagctaatgttgtatccggaaaatggatctttcgacataagtttcattccgatgggactcttgctcgacacaaggcacgatgggttgttcgtgactattctcaacagcatgggattgactatgatgagacttttagtccagttgttaaacctgctactattcgtgttgttctcagtattgctgcctctcggtcttggcctatccatcagcttgatgtcaagaacgcatttctccatggcaatctagaggagacagtgtattgtcagcaaccatctggttttgttgatccttctgcgcctactgctgtatgtttgctccaaaaatcgctctatggtttgaagcaggctcctcgtgcttggtaccaacggtttgcaacatatatttgtcagttgggtttcacatcttcagcatctgacacttctctcttcatttataaagatggagataatattgcatatttacttttgtatgttgatgacatcctgctgactgcctcgtccacttcacttcttcagcatattactgctcgcctacactcggagtttgctatgactgatcttggtgacttacacttctttttgggaatttctgtcactcgatctgcagacggtttatttctttctcagcggcaatatgctgttgacttattgcggcgagctggtatgtcggagtgtcatcctactgcaacaccggttgatgctcgatgtaaactttctgctatagatggagctcccgtttcagatcctacggagtacaggagtctagctggggctcttcagtaccttactctcacacggcctgagatagcttatgcagttcagcaggtatgcttgtttatgcatgattcccgtgagcctcatcttgctctagttaaacggattttgcgttacatcaagggtactctacacattggtcttcacatcggaactgcaccagttgactctttgatagcttattctgatgctgactaggcgggttgtcctgattctcgtcgttccacatcagggtattgtgttttcctcggtgaaaacttggtctcatggtcctccaagcgacagaccactgtctctcgatctagtgctgaagctgagtaccgtgcagtagcacatgctgttgccgaatgttgctggcttcgacaacttcttcttgaactacatattccacttgcttcggccactaccgtttattgtgataatgttagcgccgtctacatgaccgctaatcctgttcatcatcgtcagacgaagcatattgagattgatattcattttgttcgagagaaagttgctttaggacaagttcatgttttacacgttccgtcctcacatcagttcgcagatatcatgaccaaaggcttgccagttcagttattcactgagtttaggtccagtctttgcgttcgtgatgttcctcccactttgactgcgggcgggtattagagttagattagatttgtatcgattgtatccgtatataactcttatttaagagtttgttgtaatctctattgtattggatatataaatacaatcgccctcccacgttgtgtcgtgaggcgtctcataattctctacagtgtgttcacagaagcatcatgttgaccaattaactgacactcttgtacatttggcttgtggccaagtaactcttgttgctcctgtttgaatgaaatgttgggctgctgtatcggctgaacacctaaacctgtcgcggtggaagctgccgatggatgttgctgcgatcctgtcattcgccatgatgcagcataagcattttgtgaagcttcttgtgtgaagccattgatcatagtgttctgtggcatgccttgaaggatcgaatagcaagaactaaaccaactagaggaggggtgaatggttggtatacccaaaaaccaaaaacttttagcggaaataaaagttactgtcgacttcgacggagatcggtctgaccgtagtagattagccggtctgaccaaagcgtagctgccggtctgaccggtatagatattccggttggaccgccctagaatccctgccgcacctgtcgccgccgccggtctgaccgccgcgatgccgctagtctgaccgccggtgtgtcgtcggttagaccaccgaaacccagtaaaacacaaatcgaagaactcttaaagtggatgacgactttattacttctctctgtgttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccacgaaccaaactcatactaggagtcctaaacaccttaggaaaccctctagtacaagaaagaaactttacataatcaatcgtaccaaatttggactccttccaaattcaactccgcatcccatacgcacacaataactccatcatatgtcttatggaatctccatcaaccacgtgcatcaactctagccttagtatcccgcatgatctctgaccaccacggacgtcgtcttatccccaagccgactcccggtccatcaccgcaaatactcacccgagacatcgagtcacctacacatgaaataatcaaagaaaccatattccgagaccaagctatctccaacttgattcattagtagtaaacaacagtattacatacgtatagtatccatctagatgccataatcatgaaataatcacggatatccaaataaacaacccgaaaccgaaactgacacagcgtcggccggtcagaccacgggctgcgccggtctgaccgcgcgatacacgccggtctgaccggcacacactgcccggtctgaccggtcgcatgaaataacagtacctgtgattcacctgtaaatccaatcatctccaaaaccacttcgtaaataaattccaaacaataaaaccaataatctccaatgcccaattgttcatcacaaaataataatcaaaaacacctttgattttacaatctcccccttgatgaacacattggcaaacccttttaaaatgttttgatgtttggaaaaatataaacaaaagtgataaaaagcacacttcgtacaaatgtacacatcgtgctcaaaaatccaaaagaaaacttcgccccctttttaaaagaaagaaattcccaattgaaccaaaaacaacatgctcttctcaacaactccaaaaatccatcttgcttcctccaaaactcatctcttctcccccttttgacaatgatttcatcaagcataagaattatgttcattaatgtataagagcttagcatacatattgcatatcaagtcatgtgttgcaataaaaaggagatgaacccatctataacataacaagcatgcattaaagtataaccatgaaccaaagattttacaattaagcttgaatcaacaatcaaaattcatgattttatatgatttataatgcaacatcttaacaagtacataggttgaagaataaacactaaacacatatacctattgcatttatcactctttctcaaataacgttttagcacaaaaaaacaaagagaatttttgaaccttttcttttcttgagcctttttgctcatatttttctcttttttttattccgggtacgtccctgtcatcaagactgtttccagggattcggcatccattattttgctcacatcgaatacatcattgtcgtcaagactgtttccaaggattcggtattcatttttttcatatttttttattctcttttcacaatgagcaattaaagctatttgaggaataacaattcaacaaagcatatatatatagagcatttataaatcaaaccatatgctagcatcaacattgcatattttcttaattcaagtatagaatttaagtgtcatgcatcatctcccttaaaagcaaaatctaaatctcatgaaaagactagaatacatacaagctatgctagagacaaataaaccttcaaagtattgctagcatgcacaagaaaataccatttgcataaacaaagctctattttctcaatttttctcattgtcatattatcgcttgataaaaccatgaggtacaaactccccctcaaaccatgccaaaaggatgaactatgcccaattcaccacgaagaaaagcaaagcgattagaatccaaaggcttagtgaaaatatcagcaagttgcaactttgtgtccaaaaactgcaattcaacatatcccttctcaacatgatctctcaaaaagtgaaagcgaatatcaatgtgctttgtgcgtgagtgttgaacaggattcttagcaatgttagtagcacttgtgttataaaaaaagagaggtactttctcaaaagtaagaccataatatttcaaagtagataaaagccaaagaatctgtgaacaacaactagcagcagcaacacattcaaattcagcagttgattgagcaacactagattgtttcctagaagaccatgcaatcaatgatgtaccaagaaaataacatgttccactagtacttttcctatcaattctacaaccaccaaaatcagcatcggaatatccacttaagcatatagaagatgaagtagaataccaaattccaaactcaagtgtatgattcaaatactcattattcggttgaccgcttgacaatgtgaagcacgaggagaagcttgaaagcgtgcgcacaaacacacagcaaattgtatgtttggcctagaagcagttagatacaacaaagatccaatcatacttctatattccttttgatcaacagcttcaccatcttcatctggatccaacacagctgtagaaccaattggtgttgaaattggcttgcaattctccatcttaaaccgtctcaaaagatccttcgtatacttcatttgatgcacaaaagtaccttgaggtgtttgcttaatttgcaatcccaaaaagtacgataactcatccatcatgctcatctcaaattccccacacatagtctcagcaaaatctacaactaaagcgtgagttgaacaaccaaagatgatatcatccacataaatctaaacgaacagttgattatcaccatgcttaagaacaaaaagcgttttgtcaacctttcccattataaaacctttcgcaagcaaaaagttcttaagcctatcataccatgccctaggagcttgtttcaaaccatacaaagctttagacaatttaaaaacatggttgggaaaatcaggatttttaaaacctggtggttctttggcataaacttcctcctgtataaaacaatttagaaaagcacttttaacatccatttgatacaatttaaaaccttttgaagcagcaagagccaacaaaagtctaattgcctcaattctagcaataggagcaaaagtttcatcaaaatccaaaccctccacctgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcattaatccacgattcatcagttaatgcatgtgaaacatctttgggttcaaaagaagcaacaaatgcggaatttgcataaacatcatgagtcgttaccttagaccttgtagtccgctcacctatattaccaatgatttgttctggtggatgtcgtcgttgaatgtgcaaaggagcagtgacttctgaagttgatccacgttctgtaccagtactggtcgaagtagtaatctccggaggaccatctcgatcagcatcaacagaaccctcagccgacgaccctggccggtctgaccgcacgtcctgcgccagtctgaccggaggtgtgccggcggtctgaccggcctggcgcccggtctgaccggccgagccaacctcgtcgccgtcgtcgttgtcgtcgtcgctctcgtcttcaaaaatacgaccatcctccccctgaacctgtgacagtgtacctgcaatatcgggtctagtgcctggactagcctcatcaaaagaaacttcgcaagtctcaacgattttgttagtatccaaaataagtacacgatagccacgagtatgtgcggggtaaccaagaacaaatccgtcggtagaacgtgcctcaaacttatccaaatttccagatttcaagacaaagcatttgcaaccaaaaacacgcaaatgttaaactttgggttgatgaccaaatcgaagttcataagaagtttttccaagtttagatcgcaagaaaactcgatttgaaatataacatgcagtgttaatagcctcagcccaaaattttctaggagttttatattcatccaacatcgttctagctatctcaaccaaaacacggtttttcctttcaacaacaccgttttgttgaggaacacgaggagaagaaaattcatgttcaagacctctttcattgcaaaattgtttaaaagaagcatttttaaattcaccaccattatcacttcgaattcttttcaaagaaccaggaaattcaagatccgatcgaagaaacaaaccacgaaagcgttgaaaagtttcgtccttagttgccataaagaaaacccaagaattgcacatgttcagtaccacagatatctctggctgacaccaggcaagctctgacagagactaggaatgactggaatgactaggatagctgctgagtgagttaccgagacataaagaggatagctaatgactgttcttgattaatgcctggtaaagggtgtccaaggtactgcttctgaaaatactaggtgaaaccccgtgcattgctgcaggaatttagtatgataacaataaaaaaaataacacgtaaaatagctagataacatcagattaagtaaattaatgtggtttatgataatttaaatttaaatagtatgtagaatggtgattcaaacgtaaagagtaaggtggtatgactttatggaagaagaaaagtagagagatagtttggaccatagattaatatctaaaggctaaaaacaattgatgtgatatgacttaattagagaaaaaaaggagaaagataatttggaccctagattaatcatttaagaactaactaagtgaggatgaactatataagtacttatatataggatatcataaaacataataaagatatacattgaaacattatatgaattatgttggatgataatttaacatgtttatatttgaaaagctcttaaattataaaaactataaagatatagcatgtttgcatgatgtttaaatgtgatgattattagtggatgatgatgtgacatcttgttaatggatgatgatgtggcatctttgcatgttaagtttaaagagttagtgggggataactttatagtaagatagaataccatatgtatgttgaatatcacggggacaagaaggaacactatttttgaatatcgtaacaagcacagagaagcactacaagcatcatgctaccaataaaattgacgcagaggtgagctattccatttctgaacaggtaaaaaaatgcaggtatatggaagcaatttaggaggtgaactactcattttcagacaaatactagttaaggtgaccaataatttggattagcagaaaagagctcataagcatcgttatgatacatggtaattaaaagatcatcgaaaaaaacattgaaaaacaatagccttatattatggtacatgggaagggacgaaggtggaatgagtttggagaaatttatactacctctgtcccagaatataagtatttttagagttagacacggttattaagaacgtagatagaagtgaatgatggagggttgtgattggttgagtagtggcggcttgtttggcaacttcaaggaaggggattgggagtttacacgagggatttgatggtgagattaagatgggaatttgatttttcatcccagtatcttatttggtagaggtggtgaaaattgatagggagtttagttggagattaggtcattaatgaaaatggatggctgagatttgtttaggcgaagtaaatgaggaattgcctcccaattacctgcccctacccaggtattaaaaaggagggagttcatttctcaatttcccatccccatcccaccaaaattcccatatcccccaaccaaataaaacagttaatagcctcatccctctaaactcccaatccctcctaaaaactccctccaaccaagcaggcggtggaggtagttgggaaaggtgaatggtggagggttgtgattggttgggaatagaatattggtggagaagttgttatattttgggacaaatcttgaggactaaaagtagttatattttgggacggagggagtagtaaataaccaaacttagtagtataatacaaaagaaaacgattagaaattgtaattgtacttaatgaaataaacttataggtggattggtttcctagttaataacttggtactatatcacgtaaaccattgtcacagttcactagtaattttttttaaaaaaaatgaatttttgagaagagaaaaaaacagagctccagatacgagtcgagcttggtgacggttttttttccctagatggtggctgaatgggcgatcgatgagacacaaaggctatttgggttggaaccctccacacgcaaaacggagtaacaaattaaagcatggttaattaaatataacttaaaaaacttgaaaaatgagttaatatggttttttaccgtaactttttctatagaacatttctaaaaaaaaggaaaacaagggaatgatggaggttgggaaaccaccaccaaattcactaggcgagttctccatgattttttttttaatccagaaaaagtgagaagagggaggggatgatgaagaacagaagaagaacttggaggagtggataccacataccggactggagccaagtcgccggagccgccgtccgtagttttctatgcgtgcaacttcgctcccggatcgattgcttacgtgatttggtcagattggatgaactctctggggcacctccttcggagttcggagcatgaaggaaggaaggaagaactctaaagaacccaacaagggagatgatgatgggataacaggggaggggggtcgtccctccctcccttcccccctgaaaattttaaacacatccagtgggctccgctacaggggtggctgctgcgcgaccgatcgctggcgccggaggccagcgatcagaaatcacgcccgcacgcggtttcctcgtgtaaaaaaaagcaacgctgcgttacgcaattagtcgtgggttcttcgtaaatttaaaatcaatttaaaaataagtgtgaaaaaaataaaaaatatattacactaaaaactattcatgtacatagactttatatatatatatatatatatatatatatatatatatatatatatatatatatatatatatatatatatatatatatatatatatatatatatatatatatatatatatatatatatatatatatatacacacacacacacatatatacattgctaactttgtacatataaactatgtgtatataaatattttatataaaatatatttaaatttgaattcaaatttaaatcgagtatataaactttcatagtataaactttaaccgcacaaaaattttagatgtgtaaacttaaaatgtataaacttactaaaataggaaattaatacggtggcaaaaaaaaaagaaagcaacgtgggaactgggaagagaggcccaccaactgatcgcttaaaatatattaaaatttgaattcaaatttaaatcgagtatataaattttcatagtataaactttatatatataaacatatataaactttaacagtaaaaactttagatgtgtaaacttaaaatgtataaacttactaaaatagaaaagcaatgcggtgaaaaaaaaagaaagcaacgtgggaactggaaagagaggcccaccaaccgatcgctatccactccctcacgcgagcaatcgctcattaggattctcgctccgctactatactactattttattatatacaagtattggttcctgtcttttccattaaaaatgctagatggcggccggaaaggctagtggcttgtaagttcagtgatgttgatccaatgggctgcaccaacgtatcctgcgtgaggctggattttttttacattttaatcctttttaaaaacttacctaaaaaaacttatttcaagaatggaattttttttccgcccatgactctagtgtttggaaatcctgttgggcgggtgatcgctcccatcgatcacccccttcccctctcctatagtatatactcctccctcctctccccccttcctcctccccttcttctctttctactacagtacaccacacaaaattttttaaaaaacaaaagttagaaaaatctatgtatagaaatactatatataaaaaatttgaattcaaattcaaatttgaattgggcatgtaaacttttgacttataaactttggatctataaactttaggtgtataaactttagatgtatagaaatactatatatatatatatatatatatatatatatatatatatatatatatataatatttgaattcaaatttaaatttgaatttgaatataattcaaattcaaatttgaatcggatatttgaattcaaattcaaatttaaatcggatataattcaaattgaaatttgaatcggatatataaacttttaacttataaactttaggtctataaactttaggtctataaaactttaggtgtataaactttagatgtatagaaatactatatataaaaaaatatttgaattcaaattcaaatttgaatcgatatataaacttttgacttataaactttgggtctccaaacttcagatgtgtaaacttgaggtgtataaacttgaggtgtataaatttactaaaatagaaaagtaatacggtgccaaaaaaggaaaccaaggagggaggggggagggggggtancnaatntgatcgctacccccattagcgggcgatcaatcgcccattagggctcccctctagtgttgggggcttatttttataaaacatttacattttaaccctttttagaattctagttacatatgggtcctcgatgctagtgtcgtttgttaagtttttccagagatttatttgtaaaataaattttttaaagggctaaaatataaaagaattagctccgggagatgaccagtcttctcataattttgcaaagtactcccttcgataagacatttttccatagtaacaaatcttttagtttaaccaagtttatagaaaatttagaaatatccacagcaccaaattagtttcattgaatatattttgatagtatgtctcttttgtgttgaaatgttgatacatctttttataaacttaaaatgtttgactagaaaaaagtcaaagcatcttataacactcttttgtgtcgaaaatgttgctgaatcttttataaacttaaaatgtttgactagaaaaaaatcaaagcgtcttataacatgaaacggaaagaaatacataccccaaaagcccatgtatgtaaaaaaggaaaa

SEQ ID NO: 22637 - DNA, 11842 bp, Oryza sativa
  unsure (1)..(11842): unsure at all n locations
nnnnnnnnnnnnnnnnnnnnnnnnnnnnnnnnnnnnnnnnnnnnnnnnnnnnnnntcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatagaattttttttgcaaaaacacaccgtttagctgtttgaaaagcgtgcgcgcgaaaaacgagggagatgagttgagaaagttttggaaagaactcagcttagtctcatttcagttagtagttctttagtttgtaagcccagctcaacagaaagtaattagaatgtttagtctttcagggactagttgatttagaatttttcagccaatcgtagttggttattttgcacgcagattaagggagactataagcccagaaaagctgatgaagtttgcagcgcaaaacctctgccccagctcttcttgttctgctttcatctttcgtcaggtactgtagctgttcgacaacattcacaacagagctatggtagaaagagtgagttcaggatttaggtggtgtttggatccagggacttaactttagtccctatatttagacactaatttaaagtattaaatatagactacttacaaaactaattatataaatgaaaactaattcgcgagacaaattttttaatcctagttaatccataattagagaatgtttactgtagcatcacatagactaataataaattaattaggctcaatagattcgtcttgcgaattagtctaagattatagatgggttttattaatagtctacgtttaatatttataattagtgcccaaacatccgatgagataggaatttaaaaagttttagtcccctctaaacagggtctaaagtctgaagggcgatttcggacacactacacaactgtaccagtacaaacatatatatatatatatatatatatatatatatatatatatatatatatatatatatatatatatatatatatatatatacacacacacaccaacgtggatctatgcatcatatgcatttagggtacttgctctaataagctccatacatgacaaaaaatagcaatagtgcgactggatggactccagatgcacaatatatcttaatagaaactctttgcatttagcataatagatgtcactgagtgacatctattatgctagtgacatctattatgctaaatgcaaagagtttctattaagatagagagactccagatgctcaagagcaagcaaggtaagatcaagctcgaggacgtggccggtttggttggtgcagaagtgcagatgacgcttttccaccggcagcagcagtctgattgcctggctgtaggttgccatcaagcgaagaagttacaagtgtcattgacgacggcttgcagagaagcaggccagggttgccatgagcagcaagaacttggcagctgtgctatggctgcgttatttggctctgtttaggggagctttagattctgagaagcagctatttggtagccagcttttaaaaatctggaaaaactctgaaacccagtttctccagcttctggtttcttagtttatttttcagaatctgtaactacagattctcagaagctgtggactgtttggggcagcttctagcagaagcagcttttgagaaaagctgcagctgggagaagctctcccaaacagggcatttgctggagttcctaactcctcaccctcgttttccgcgcgcacgctttttaaactactaaacggtatgttttttttaaaaaaaaatacgaaagttgcttaaaaaatgatgttgatctatttttttaaaaaatagctaatagtacttaatcaataacatgttaatgcgaacattgttttacgtgccgggaggaggaacacgacctatctatggtggtagtgagctagactaagatatccatactgttctttttttttctttcgtaggagggtaaaagctttgcctcatatatatctattattatatactaaaagtccataaaactttatacaaacactctcaagccgtcacgtggtacctctacaatcgcttctagaccgccacgtggcaatatctaatctcaccgttgattttcatttaaatcggtggacccgataatttagaccattatattagattagttgtattttgacaccctaataaatcagaaaaaatccttaaaaactaaactcccttcgcccaaccctcctggctgtccccacacgtgcctacgtacgtagcaggtacgtttgcctccatgtgcacaatccagttcctcccccattctctatttttttttctaattagatcaatatcataatttctattctattctttctactattattattattattattatataaaagtctattaaacttcctgcaaacgctcttataccgccacgtggcgctctaaaaacactctcaagctgccacatagcactgcaataaaatagataaaatcttagaaattctgagaaaaaaaacctaaccctcgatttttatttaagttggtagaccattagtttacaccgttagaatagatccattataaataaatagtaatctatcccttctaacttaccatgtaatacttacctaaaaaatattggcagaaataagccaagaaggcatacgtgcgtacagagttaaccactacaaacgagaaaagaagaaatgatatacagcataaaagaaaaaaaaacatactgcatatatacgtactacgtactactggaaaaaaaacattgtttttcaaactggattttcacttgctctgtattttttatgacggcgttaaatatttagttaaactaccgaaagaaaacaatgatttaaattagattttctattatactttctttggattttttttaattttagtgaaggtggtagtataagaaaaatatattacttcataaaacatgcacaccccaaaatagatctataatataatataaaatatcaaatgaacgtatcatctatactagcgtaaaaaaaggaggagttttgccttccaatcctacaggtgaaatcaaatccaacgacccgtgatcaccttacaatccaatggctcagatcactccccaacgtcccacgcggccacgcaacgtcccttgcgaactctagcgtcttcctctcaagcgccgccgcagtcgtgttgcctcctgatcatccgccgccagatcgccgtctttgctgtcctcttaggtgcagccgctgcgcacacccacggtgcgcacctcccttccccggttccccagcccagtgctgcccccctcccttcaccgtgcaaaaccctaagcgccgccactacaagcaggtacctttgccgccaggagatcgccctcatgtcacctcgctgccgtctcaccagatcatcgacgcaccgcctcgccataccggtccggcgtcgactctgcacacgcttcaggtctaccacgacaactctttcaaggtagtcccagcatattgaaggtagtaccattatgaactttctcatgccatggctaactatcggcctatcattgtagcattatatatatctatatatgttggtgttcacttacaatttcatgcctctttgataatcttggtaatattctggtcatatctccacctgcgcaaaatttccaaatcctgatggtcaattggttaccatgcactatatatgaatcgatatggaatgatgcatgctttattgttgcagttaatttcaacagagtaaaacggaaggagtgatggattctctacgccttgcaaagttgcaagtgcaatatgaaatgctggggatacgacatttcagattcatgcttcaagtgatcaccatatgctgataagctgagagtatgctcaaatgatcagccagaccttctcttagaggtaattcaatcatggatactttctatttttctctgcaagttcacttgcaatatattagtaagcaaattatatatattgcaaagtataggagccattgtcatttttgttatatatggcttccatcaccccattgattactggccaagacatggtatatgttttttccatgtagattgagagggaaaatacattgtgactcatgatgtttttaaggtccaaattaacatttcaaattatactgtggcttctgaccctgtagatcaaaattattgcagttgcattatgccattagatgatttcagaaattcctgaacattgcataattcactcaattgacttaacgttgcctctgctttagcttgtccatgccatgctttgtttggatagctccaaagatatatttgctattgatcagaatcaaaataaaactcacaaagtttagagcttgtatgatatatgggagtcctttgtttatatctctcgaatgttcactctgatataatcatgcaaattggagggtatgtgtgtaagcgccagttcgattattgtatttacccaaaaataatgattgctgtatacttgcatattaggttgtgcaatgcatactctttcagatgttgtactgcaactgcacaaatcttgatctttttttgtccctgtattttcaccaggtttcacttgatgaggaaatgagtttatagatgtgtagagaatctgaaaaagatatttgggaagagatggtaggtgcatttaaaacaatggcaaggagccaaggaggtaatttctgtcgtgcgttatgaattagaattagcgatctgtactactgtctacactgcaggcacgttttccatttcttgatgagaatgtgatcaaaacgactttattggaaataccaggttcagaggttgcttaacttgatgaacctattggaaagggtgacaaagatttcagcaggtttttacttgttttgagcttaatccatatgggaactgttacagtaaactgaaattcgcatttgtaattcacatgtaaaccattgtcatgacagtgaaactactggccattttgctggtatagtgatattagggccatacatgaattatagttcagtctttttttataaactttggcgatgaagtttagatctcttcctgttactgtattgaagctacaatcatttcaaaaattttggatctcaattctttttctgatggtagcagtatacatgtcattttgctggtttttttttcttttttttttttttgctttaaggggatcagggcaggacagaaggaacactatgaccatgtccccatggcccatgtccatgtacgcatcaagctcctaagtgataatctgattgcctgctgatcccaggcgccggtggaatcaaccttgacccatcaatgatggtcatcccccattgacgatcacatggtccacagagatcatggtgtcttggacaccatcattatttctgacggtttaagctttgtctccacaattttttatctctgtatttgcttctgatggtttatacttcagagttcggaactgaatgttcatactctagatgatcatgtacttgaaattttgcacatttggtactgaatctgcactaaagtgggtttcttgatttggttaggtacattgtataagctaggttcgcattttgtacaattgattaaagaatatggtttgtctatttgcgtagcttcaaatgaatgatgtttaacgctattctgtctgtaaatctacagagcaatatatttgattgaatttagtttagccttttcgtgcattgcacgtgcattgttactggccatccatggaattaaatgtgttgtagaaactggcaagtgtcaattcagagtgaccatttaggattccatggtgtgcatgctttcttgtggcatactggtcttaggagttcaaatagagttttagtgcatagattaaagtgagataaaagtttatgcctgaatatataatttggtcatcttaattcattttcaggaatgttaatatgtatttatgtttccttttttctcataaaataaaactcaccgcagagaatgtatggagcataaatatgttctttctaacagaagttttgagtacttatttttgtgcagctttcttaaactagctagccctagaatgatcctgtttgttgaatcggctgtaaagatggagggcatctaggtaaaagatgaaaaatttatcaaatgcatcgtctactctgattgtatattcgtaaactattgtcctttctagggagtaatttgggtaaattcagctgagggaataggaaaattctccatttccttcaaattattatgttttacggcaatgagaaaataagatcaattgttattctcctgtaagaaattaatttgttcttctgtaagaaaagaatgctccgatagttattctctttactacttactatatcacttctagctgacaatcatttaaatttagatcacaaatgtttgtttacggaagtagcagcagcgcaatgtatgaattttagttggcaatttcgtaccttttgcgaatattttttttacctttgttggtcagaaaattgtaattgaacacaagattttatagatttcactgaccaaattgtcatcttaggataacctataaaattttgttctccattcgtaattgtttgttagttatatattgccaacatgtgccttgcacgtgcacgataactagtttcacactacaattgttgagtatagatagattttatttgcatcaatgggcctacattgatagttcaagatgaaataatgagtaattaaaaaaattactcaggacatttgtcataaacacctataaaaaaatgtattgtttaaaaatatatcacatttttttctcgcaaaataaagtcaggattttagccgttaatgactcaatctatgcttttgatttgtacatattttttaagtgtataagtaataaatgtaaggttgatttctaaagtacttattggattggtctccgaaccattaaactgttggtgttttacaaatactttctatacatatatatatatatatatatatatatatatatatatatatatatatatatatatatatatatatatatgtttgtaatatttaatacttaattaatcttgcgttgatgacctacatcgtttttcatgccttgcctaagttcaaccaattagatcgaatgtagcctaagtaggagatagattagattatttactaaaaaatttaaaattaaagaatcaagttaactacattattaaaagattctgcctaagctcaaccaattagatcgaatgtagcctaagtaggagataaattagattatttactataaaatttaaaattaaagaatcaagttaacttcattattaaaagattcattactttggatcatatatattttacggactagcttttgttcactaattcatacatttttaagaaaaaagcaaataagttttgacgtctttctcgctatttcttagatattaaactaaaatagaaacaatcaataatattggatttttttttaagaaacacgacacgcgcacagcctgctcctttgagtacctctaaaagactgagccaacacattttgagaatgacgatgtcaccacaggcgtctcgctgttgacgggtacgccacctaccattgaaagaatatttagccgtaaatgcgagcacccgtatcaagtctaggacttaaaccaggtagacaagttacaccacaagaaacctaaccaattgatctgtgctcacttcacaataacattggataataaaacaaccataatttttaagctacataactggaatacttttatgccttttaaaccggtgaacaatttgttataactgttagatctatcttatataaaagttaagcatgtatttatggtacatgatatttccaaaatattactacgcaattatatttcgtcattatcatattcatattaggttgcatggagcctctcacccaccctacatgaaatgttcataaatggatcacctctcaaactatatcaatcatattagcttctataaacccatacatttagtggagcttcatgtctcacccaattcatctttaattgaactgttatagatatgtaattaaaaaacaccttactttacttttgttgacatgttttcaaaaaaaaaatatgtttaccttattttcaaatgataaagaagattataaataattgcttatagatattacttaaatatgatataatataaaactaataggttactaacttagcaattaatgctgatgaaaataatttatgtacaaatcatggcagatgttttccgtttaatatttcgctcttatacttatctcaaacttagcataggacgcatgcccgcgcattcgcgcgggctaccttcctagttgatagaacaaacatcgtcctcccatttttgcgtgcgggcatcttaagagcactacgcgcgaaaatactctcccttcttttaccctctcaacacttcaaaaatttcatcctcatatcctccctcaacctctctcacctccttatccttatcctcacctccaactgtctctcctctctcacgtggcagtaggcgggtggctcggcagcgggcgatggcgggaggagtggggccccgccgccgacaacgacgacgaggtgaccgggagcggcgccgttggccccgcgaatccgcgccgcccccgccgacgaggacgaggaggtggccggagcagaggcgaacggcggccatcgagctacagcggcaactagggtttcgattttttcgcaatttttattttcttttatggttttttattttcgcgtgcgggtgacataagcaccagcatgccaaaaaagaagtctgaatacctgatggataatttgcccgcaactataactattttctctcttgcccaggctttcattctttacacatagaacattatcgttgtgtcctactccgaactatgtcatgctcgtgcaacaacgagtcagaccagatgctacagtaaaatcgatctattaattgcgttgatccgctgtgctactcgcatgaacagtgactgatccgtgggttgccatgctgaaagctctatccagcttccaagcagccttgatatttttttcgttctaaaatttagctatttttggagttcaaatttattcaaaatataactattttctttacctgtttggctatttctttatctcaaccaatcacatcgttatttatttaattttttatctactttcttttttaaccgaccatggttttttaccagtcaattccacctatttttcagttcatctgaaaatctctaaaaacaaaatatttatattttgaaacagatgaagtaggatcattgttttgccaaaagcaagccgtatcaaggacacgcacactgtagtgcagcaatggccataaatagatatgccagcaaagcccatataccatcaaaagaaacattcatttgacatttcttagtacaacaatatgcaaatatcctgaacagtctccaaggcttagttctttcctccactttcccaacttctacctcttgattttcacacgcacgcttttaaaactaccaaacggtatgtttttttaaaaaaatattctataagaaaattgctttaaaaaatattaacttatttttcaatttttagctaatacttaactaatcatatccaaatccaccgctttgttttgcgtgttctcattggaccttacaagtgcaattctaaaagagcccaaaactcacaataacaaaggctgcaaccatctgtgcccaccttctgaaggcatatctccttttttttccccgataaatttatttaagagagttcatcttcatggacacaaatacaataacaataacatgtttaagttacactctcttcatatactttccctaaggaattatgattgccagtcttgacaatacaacatcaggttggattgcatacacacactatataagatattccagccatgccatcgcccatcgaccccttcatttatcaccatatgccatgctcatgcacgcctcgtggagtgaagatgacgacagtactctccaagagcccagatagggaataagttgcggtagttggggtaattaaagaagaggcatgcattgaaggctccaacatgttcctaattaagagcaggtacaatagcatgctataaactagttgcaaacatattttaaaaagataaataaggagagagatggacagcgggctacagatttgtagccagctgtagcacggactctaagacacagtgtgtgtatgacagatgggaccatgtattaatagtgtagtatgtaactattgaatgaatgagctattaaattagctatagatgaattggagctggtagttagctacactattaaacttgctctaacatcagcagcacaagcaacacaagagataaacctttaatggtcatataccaacattatctaaagttccaaacacatgtaacgctgaaacatcttagttcagagcaccctaggagtttggtgatttaattaggtacgttctttttcaagtctccagagcaaccacttgaacatgggattgtatgtcctaaaatccttgcacagaaggtaccatatggttgttcatttcctaactacagccaaacaaaataatctcatagaagccctatatttgtctaatgtgaatgtttgccaccctaatgtggctctgctcgctaatggaggttcccaatcggaacagtatgcacggaaaacggagcggtctattagcacgtgattaattaagttttagctattttttttcaaaaaggatcaatatgactttttttaagtaacttttgtagaaaaactttttttacaaaaaaacacaccgtttagcagtttaggaagcgtgcgcgcaaaaaacaaggcaaagagagttgggaatgagcacttacgaacagaggctatgtatggtggcttggggattcttagtttggaatatacgtgttgggctcttaggaggtgtttggatccagggactaaactttagtccctgtcatatctaatatttagccactaatttggtcagataaatggttgcagggtagggccacttcagagttcgcccctagcttgttcaagttgattgctaagaaggttgtaaaacgacatacagtggctcaagcattggatagtcaaacatggatcacatatataaaaggagttcattatgcaggtgattagggactatcttccgatctgggatttattgtgcttggggtaaacttgcaacaacatgatccactggatcagcaccgttggaggtcatcaggatttcgtttatactctagcaaatcagcatatgagattctctttgtcagggactatcagattaatttgctccatagaggaggatttggaaaagttgtcacccctgaagtgcaaacttcgtctgtggttcacggtaaacaatcgccgttggacgggcaatcgcctgtccaagcgaggattgccacacccggctgcctgccctttttgtgatcaagctgaggagattgtgcaacttattttgtcacttgcatttttagccagcgggtgtggtcattggtccttcacagattaggtttcattggcctcacggctcacgccaacccatgacacacgccatttctcaagctggtggtctatgccagtgaaagacacccacaaagaaagaa

SEQ ID NO: 22638 - DNA, 1056 bp, Oryza sativa
ctcagactaaaaaatgtttaactcaaatttgaaaactttcatctcaaaacttaaaaactttcaactcaaatcttaaaaattttcagctcaaattcaaaattttcagaaaaaaataaagatgaaagattcaatttctaaaataaaaaagagaaaaaatcggcacaaaatatttacggcctcccacgacggaaaaaaatagaaaaaggaaaaaaaaagggaagagatggctacgcgatggcgtgggtcttacatgggccaggaatgtgcgccgcttacgctaatagcgcgtacgtgctaattagcaatcgcgtcagagaagctgggtgaattaaaccccattcatgccatatgatacatcgtatatatatctttaaatttttattctgtccttcattccataaaattattgctcagactaaaatgaactcagttctccacgaacgatacaaaacataaccccagaatcccagcaaaacttaaatgcgaacttacttgttgggggaactctcctgtttccaactgcatattgattaattcttttgcagcacgatgcagtggtgctggatcccgctccatctgacatccaaatggttatagagatcattcgataaaaaggtcattcctatcagaattgaattgaaaataaacaaaacacacctgtcctgcacaaattaaagctaacattgcccaggcagtattcactgcatgagcttgatcatctttaatgtttacgtaaacctgtttggtatcataaaaaataaaaatcagtgacgaaatcttccaaatggatttataaaaatttgcaccagtccaacttcttccctcataagatttcttccaaatggaagcaactcttgttgcaaatgaaaaggaataactccaacatgcacaacagatcaaatggatgagcttgtctatgttcaagccccaaactcagcagggtgcttaggctatattcttcctcctcatttcccaactcacctctcttttttcacgcgcacatttttcaaactgctaaacggtgtatctttttgcaatagttttatatacgaaagt

SEQ ID NO: 22639 - DNA, 598 bp, Oryza sativa
  unsure (1)..(598): unsure at all n locations
nnnnnnnnnnnnnnnnnnnnnnnnnnnnnnnnnnnnnnnnnnnnnnnnnnnnnnnnnnnnnnnnnnntaatataggtgagcggactacaaggtctaaggtaacgactcatgatgtttatgcaaattccgcatttgttgcttcttttgaacccaaagatgtttcacactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaagcctagtccgtaggcaggacttttcaagtctcggaaggtttcttcaatctgcattcgcttcgaatagatattaacaagttgtttgggtgttcgaatttcaacaggtaagttagttgctagaacccatg

SEQ ID NO: 22640 - DNA, 732 bp, Oryza sativa
  unsure (1)..(732): unsure at all n locations
nnnnnnnnnnnnnnnnnnnnnnnnnnnnnnnnnnnnnnnnnnnnnnnnnncgatttagttcccccaagtctctaaatttttctaaaattgagatctacatgttaaaaatatccacatatactgttcatgcttgtttatgtgctgttttggtgtttttgcttcttttcgtttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttattataatttgactagttgagctttatgtatattggttcaactagatattagatataattgcttagccctgcttagaaacattagctcactattgggattacttatgactcactattatttaatgatggcttaatgatagttcacgatggtcaatcgtgattagttaattaattaatgtgccaactaaaacctgataatggtgggttgtgagcacatggttttgagagtcgtgctcatgacaattaaggacccgttcacgagtttcagttgtgaaacattaaccgtgccagccacaagccagcgtgggcaacgactttatttttt

SEQ ID NO: 22641 - DNA, 701 bp, Oryza sativa
  unsure (1)..(701): unsure at all n locations
tttcaacaccaatgggttctacagctgtgttggatccagatgaagatggtgaagctgttgatcaaaaggaatatagaagtatgattggatctttgttgtatctaactgcttctaggccaaacatacaatttgctgtgtgtttgtgcgcacgctttcaagcttctcctcgtgcttcacattgtcaagcggtcaaccgaataatgagtatttgaatcatacacttgagtttggaatttggtattctacttcatcttctatatgcttaagtggatattccgatgctgattttggtggttgtagaattgataggaaaagtactagtggaacatgttattttcttggtacatcattgattgcatggtcttctaggaaacaatctagtgttgctcaatcaactgctgaatttgaatgtgttgctgctgctagttgttgttcacagattctttggcttttatctactttgaaatattatggtcttacttttgagaaagtacctctctttttttataacacaagtgctactaacattgctaagaatcctgttcaacactcacgcacaaagcacattgatattcgctttcactttttgagagatcatgttgagaagggatatgttgaattgcagtttttggacacaaagttnnnnnnnnnnnnnnnnnnnnnnnnnnnnnnnnnnnnnnnnnnnnnnnnnnnnnnnnnnn

SEQ ID NO: 22642 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnncactgctaccccactcgttcaagccatgttcttcaataataatggtccgagtacatttgatgcctccgaaatcttcgacaagctgaggatcgctccggacacatactttaagaatatcaaggacgctggaaatatgggagcaagcctggcgttggcaatgtccaagcctttatacccgaagattgacattgacgccattgatggatttgcagacgggacgagcgaagaagccgcccttgacctcatcaacgatgcgcagaaagcagccgataagatagccgttgatgtagttgagagattccaggacaacgacctccggccgactggatctaataattccgatgatgagaaaactgatactgattgatgttatattgtaacaataactctgatggtgatgatgatggaggcacaatttgtacaatactgatgaatttatgctgtgcttgatatttcaaacttagctcctgatttcttaaaagtttttgtcaaacctttttgagcctaaaagccgcaaaagttattaaaaaactttcagtcctcattgactaagccagaaaataaaacaaggcaatgataaatcaagtaagcaaattgaattgataaaaatcacactccattattattatagtagcccctgactgataactcaaggaaaagtttgatgttagcagtc

SEQ ID NO: 22643 - DNA, 811 bp, Oryza sativa
tgccgaaatcttgtttcgacatcaagtctgactcataaacttttgcacagtatttaaactctgtgatgtctcctcgatgcaaagtctcacccatctacggttcagccttgctgtatgctagtccgtatctgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaatattttagaatttaaaaaaacagttaagtaattaaacaatattaatccaacgctatacaacataccctgttgtataggcccaaccattctgaacaaccatcccggctgcacagttctatcttcaaaccaggaatgtaccattccaaaccaggagctaatcaaattattaccaattatagcatcatttactatggtgagaagtgtgagactaatcacgaaagacattgttcgacccggccataaccgcgggcatggctattcgaatagt

SEQ ID NO: 22644 - DNA, 992 bp, Oryza sativa
catgcgcatgcaggtatgtgttgtgtgctcctccggcttgataataattgtcgctttggagaaggacacggtcatctacagaaaacaattttgaccaaataattcgcattataatatgtataaaagtgttaacaaatatatgattttatgattttattaaagtacttttcaccgtacttggaaaataaatattttaaaaatgatttataatcaaatattttaaagtttgatctcactctgttttaaaacgataagtattatcagcccggagggagtatatagttaatagtgttaatttgaactgaaatttatgtaatttgaaacaggatcactgttagctagcttcatttgatcgattcgatgttagtttgaccatctgagatatgatcttgttgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttggtattaatttgatttttttggctaattaatattaatattcatgttcaattatttcgagattaatttctagtgacctagtttctgtatgcagatattttctttgtatgccactggatcactggacactgtcatatcatcagaacaccggagggagatatgtcgctacatctataaccatcaggtttttatttatttatatatataggtccatcatcttaaaaaaaaatgctatatatatataggcggactcagaaatatacccatgcgcatgccttcatggctttaatagatttttattagaaaagatagttctagctccctccatccagatattgctatagtttggaacgacagttatacttaatttacttaattctacacatgcagaaagtg

SEQ ID NO: 22645 - DNA, 549 bp, Oryza sativa
attagaatccaaaggcttagtgaaaatatcagcaagttgcaactttgtgtccaaaaactgcaattcaacatatcccttctcaacatgatctctcaaaaagtgaaagcgaatatcaatgtgctttgtgcgtgagtgttgaacaggattcttagcaatgttagtagcacttgtgttataaaaaaagagaggtactttctcaaaagtaagaccataatatttcaaagtagataaaagccaaagaatctgtgaacaacaactagcagcagcaacacattcaaattcagcagttgattgagcaacactagattgtttcctagaagaccatgcaatcaatgatgtaccaagaaaataacatgttccactagtacttttcctatcaattctacaaccaccaaaatcagcatcggaatatccacttaagcatatagaagatgaagtagaataccaaattccaaactcaagtgtatgattcaaatactcattattcggttgaccgcttgacaatgtgaagcacgaggagaagcttgaaagcgtgcgcacaaacacaca

SEQ ID NO: 22646 - DNA, 626 bp, Oryza sativa
tttatggagaaataattattttgaagtgctgtaggtgttatccggttgatattctgccattatatatatgtttcctacacagacacagtatttgatacatgtccgcacagatgcgtgggctagcttcctagttttatctaatgaggaaacagaaaaaaactgtgacagatttttatctgaatgatagatatatgatggttgccagagctgggaaacagcatttataattcaagcgttttgtgctactgatcttgtaaatgagtatggttcaactgttaggagagcccacgagttcatgaaaaattcacaggttcagagtctatactttaataatttaaatttataaattaactagtgcataaggtgatccaacataaattgcatgttctttcttgaagattatgaggaatcatcctggtgaccaaagttactggcatcgccatagatcaaagggttcatggactctttcgtcagcagacaatggatgggctgtgtctgacactacagcagaagcgctgaaggtcattatgttctttcttcttcttctttttttttttactaatgcaccattgaaacaagggaggcaaataattaattaatccttgaaacggtcaaataagtactac

SEQ ID NO: 22647 - DNA, 349 bp, Oryza sativa
aaacttcctcctgtataaaacaatttagaaaagcacttttaacatccatttgatacaatttaaaaccttttgaagcagcaagagccaacaaaagtctaattgcctcaattctagcaataggagcaaaagtttcatcaaaatccaaaccctccacctgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcattaatccacgattcatcagttaa

SEQ ID NO: 22648 - DNA, 1155 bp, Oryza sativa
cgattctttctccggaatagcgcatgcgttatctttggaggctcggatggcgcatctactggagcctgattttctcctcccatgtgctatatttaagatggaagattggatagagcatctgctggggatgctcttagtctgtaactaggccttgctttattgggtttcttctctctctgtgtgtctgcctgttgaagtgtgtatactacactattggtgatggcaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaaggtaaatttgaaatataggcgaccgaccttgctttcagggcaaaaaaaaaaaaaaacaaaaaaaacaacattagaaaattctgactaatgattgaactaacaaaattatgtgtttttaagtattatgcatgtaatatcactatattcttcgtatttgaaaaatactttcatatatatgatgttaattttgtagttttttataatatattatgaaagaaatcaatgatatttaaagtagagtaaaatacaacagcggtccttaaacttattgtcaagttacacttaggtccacgaacttataaaacgcacatcgaggtctctaaacttggtttattgtatcatctcggtccaaagtctcgtttgaccgtggtcttgcctacgtggcacgccacgtggatgatgacatgaaattttttatttttttctccctccttccttctttttctctctcttcttcttttttctcccttctttttttttctctctggcggccgctgtaccgtgagctccacagccacgcctccatctccttctccatcagcctccgctccactcgccgagccgccgtgccggaggcgagcgcacaacgggagggaggacagcggcgctgacgggagggagggggacggcggcgacttggggaggatagtggcgctgaccggagggagggggacgacggcgcatagatgtcctcctcgatctcctccggggtgagcgccaccaagaacggcgcgcgcttcc

SEQ ID NO: 22649 - DNA, 5717 bp, Oryza sativa
tacattatcctatactaaaagtccattaaactttcttaaaacgatataacgctgccatgtggcaatcctcaaaacactctcaaactgacatgtggcgttaataaaatccatcccttaatttttatttaactcagtggatccaatattccaagccgttgatttggttgagattaaaacccggctccggtctgatccgcgaccttatatacgttggagctgtaggggatgatgcggtgcgctgacaggcacgtcgaccagagcagctggccggcaaggttgacgatgagcggcgcactgccgccgctgaccgagatggtgtacagcgaggtggctagggatgcaagtggatagtctcgctacccgcataaaacccgcttgctagttcaattttcacatggtagtaaaaaaacttaaagaaaaaataaaccagaagtgagataagcgggctaaaaaaaccgcttatccgccccgcttacatccctagaggtggcggcgtccttgccgaggcgcgtaatgatgggcttggacggcggcgggcggcaatcgatggccgccattgcgctcggaggtgacagtgagcacacgtgcgctgctgcagcgtaacgacgtcattcttgctgctggacttggagacaaaacggtggtggcttgaatggctttgatcaccgtcggcgacagggatggaagtggaagtgtgtgtgtttttttttcatttttggtcaattacctaattggagaaaataccataaaaaaagtttttacttttcactttaattggaacaaacattgcctattctagccatcaccattttttaagtgtttgcatactaatatccttcaatctattctataccatataccgtcgcattatgaatttctccacatattattacatatataatccaaattaagacaataagtagttggttaatttaaaagttatatttattactattgtatttatattttaggactttaaataaaaactacaaattaagtatataaaaaaacaaggtatgttgatctcttttctttattcactcacacacacacacacatatatatatatatatatatatataaatgtaaaaattacgtgagtatatgaaccaattagaaggaggggcagctctatggtataaataaaacacatttattgataataattttttaggatttgttacaaaatagagcatctaaacattcaacttaaaaggaaaagcaccttattttaaatttgcacttaatttgttagacatttgttttaaacaaactaagtcaacctcctttcaagataatgaaaaatattataattaatttcttataggtatgaagtaaatactggatagtttaaagctaacaaacaacttgacaatttataccagcaatgttgatgaagaaaatttatggagaaataattattttgaagtgctgtaggtgttatccggttgatattctgccattatatatatgtttcctacacagacacagtatttgatacatgtccgcacagatgcgtgggctagcttcctagttttatctaatgaggaaacagaaaaaaactgtgacagatttttatctgaatgatagatatatgatggttgccagagctgggaaacagcatttataattcaagcgttttgtgctactgatcttgtaaatgagtatggttcaactgttaggagagcccacgagttcatgaaaaattcacaggttcagagtctatactttaataatttaaatttataaattaactagtgcataaggtgatccaacataaattgcatgttctttcttgaagattatgaggaatcatcctggtgaccaaagttactggcatcgccatagatcaaagggttcatggactctttcgtcagcagacaatggatgggctgtgtctgacactacagcagaagcgctgaaggtcattatgttctttcttcttcttctttttttttttactaatgcaccattgaaacaagggaggcaaataattaattaatccttgaaacggtcaaataagtactactccctccatcctagaatataaaaagttttagagttggacacagttattaagaaagtaggtagaagtgaatggtggagggttgtaattggatgaatagtggagataggtgggaaaagtgaatggtggagtgttgtgattggttgggaaaagaatgttggtggagaagttgttatattttagaacaaatcctaatggttaaaagttgttatattttgggacggaggttgtactatcgtattaacctagtcttaatcagtgatagcacacccaagaagctcatgcttatacaaaaaattgatcacgatctgttgccagttctgcataaatttttattttgtctactcttgaaatcttacataatctcatttccaggctgtactgttactggaaaagatctctagcaacgtggtcggggatccaattgaaatagaaaggctgcatgatgctgttgattgcctcctatctttcgtggtatggaattatttaagcacagctattaaacatgatcttgtagtttccttgcagactagccccaattcattattatgtgaaaaattatggttttgtttactgttattagttgtactaagcgaagataggttaaaagaatcttacacaccaaacaatggggtgtgatatgctaatagccttttctggaactcagtatgagtgcagctgtgaaacccaaatccaagctccaattgaccttaccagcctgggagttctaaaccaaattcacaaggggattaaggctgcgatgattgtggcatgaatggaaagacccgacaaaaccgtgggtgggattggagatgccttgcaacgaaattgacagggatctcttcgccgcatcaacaaaaataactgtcggtgatgagaacacgacacgcttctaggactctgcatggatcgatgggcgcagaccaaaagacctcatgccgctggtctacgcgatttccaaaaacaaaggaaagtccctacgccaagaaaaggaggatgatgcctgggtacaagatctgaccctcgaagcaaactcacctatcatagtcaacctcgttgactagctagttaccctgtgggaagcggttcagaatgtgcacttagacaatgaagaaccggaccagactgcttggaaattcacaagtaacgggcgttacatggcctcctcggcctaccatgcgtgcagtgctgtggggcgcctagcccaagtctcaattccttgatttggaaagtttgggcaccagggaaatgcaaattccatacttggctcatcatccagaatagagtctggacatccaaccggcttgcgatcaggggttggcaaaacaacggccaatgccctctctgccgttgtgaagttgagacggccttgtatcttatcgccacgtgtagatacaccaagaggatttggcatttcgttgctagatgggtgggctatcagcaaatggagccggcccaatgggaggaagcccagtcagtccaacagcggtaggagaacctagcaaatatgcccaatgtcccaaaaaagggacttcaatccctcatcctgctaattgtctggaaaatttggaaagagagaaatcggcggattttcgaccacaaataggtggcaacgagcttcctcctaacgaaaatcaaagaagaggctagcctttgggctctagcaggggctaaacgattgcgcgagttcgtcccgcattttgtatagcttacggtgacctctctcttttttcgctttacccttaggggttgtattttctcctgctctattcaatgaaaaggcattctcgtgctgttttccgtttaaaaaaaatccaagctcataacctacgcaacttgttgccaactttatgtaaccaaaatgtcaaaaatcctaaaaatggtgattgtaactctgccatgcatatagttcccttctctctcgctgccatggttttaatatgtgaaaatcatctggttaatgtgttcatttctccttgcagaacaaagatggtaccctttctacatatgaatgtaaaagaacttatacttggatagaggtgagtttctgcacactaatgccctgattgatatgctttataaataacaccagcaacaactttataaataacatcacgaaaactccatgcctgtgcctacatcatgacacgatcaatctaatttatgatgttaaaataacaccagcatgattcatgcacttcaaatttgtgaaacttattcagcacatcttgtatgtttcagtacacttatattgaagaactagtcaatcaccagtatgtttcttatggccatgcgatttgtagtcctgacatgttttttttatataacctaggttctcagtccttgtgagagttttccaaacatagtggttgattatccgtaagtgctgagcgcatcattgtgcttagaaaatcctaataattaacacccttttccctttgtagaaataactcctggcgtaactgatcactttataccatatgaattggcagatttccagaatgcacctcctctgtgcttcaagctctggtgctgttcaaacaactacaccctagttaccgtattaaagagatagaaaaatgtgtcagaaacgcagcgatgtttattgagagcacacaaggcgaagatggttcatggtttgtaacaagagcaccacatatactgactttctgtctttggataatttttctcttctattttaacaatttgtaacacaataacttggttatttggcaggctaggcacttggggtgtgtgtttcacctatggggcctttctttcagtaaaagggttaattgctgctggaagaacatatgagaatagttcttccatcaggaaagcatgcgactttatattatcaaagcagctcgatactggtgggtggggagaaagttatgtctctaatattactaaggtaggttttttttttttaatctctagctcgctagatcattccttttgaatttttgtggttgaataaacatatattgctcgttttgttgcaagttttatgataattggcatataggatacatagcggtgggttgattaccatagttttttaaaggagtactcctggcctttacggaaggtattgtggagcgaacactcacaaccctagtggcttattagcgtataattaattaaatattaactatttttttaaaaaaatagattaatatgattttttaaagtaactttcgtatataaaactattgcaaaaagatacaccgtttagcagtttgaaaaatgtgcgcgtgaaaaaagagaggtgagttgggaaatgaggaggaagaatatagcctaagcaccctgctgagtttggggcttgaacatagacaagctcatccatttgatctgttgtgcatgttggagttattccttttcatttgcaacaagagttgcttccatttggaagaaatcttatgagggaagaagttggactggtgcaaatttttataaatccatttggaagatttcgtcactgatttttattttttatgataccaaacaggtttacgtaaacattaaagatgatcaagctcatgcagtgaatactgcctgggcaatgttagctttaatttgtgcaggacaggtgtgttttgtttattttcaattcaattctgataggaatgacctttttatcgaatgatctctataaccatttggatgtcagatggagcgggatcca

SEQ ID NO: 22650 - DNA, 1510 bp, Oryza sativa
  unsure (1)..(1510): unsure at all n locations
nnnnnnnnnnnnnnnnnnnnnnnnnnnnnnnnnnnnnntggggtttaattcacccagcttctctgacgcgattgctaattagcacgtacgcgctattagcgtaagcggcgcacattcctggcccatgtaagacccacgccatcgcgtagccatctcttccctttttttttcctttttctatttttttccgtcgtgggaggccgtaaatattttgtgccgattttttctcttttttattttagaaattgaatctttcatctttatttttttctgaaaattttgaatttgagctgaaaatttttaagatttgagttgaaagtttttaagttttgagatgaaagttttcaaatttgagttaaacattttttagtctgagatgaaagttttaaatttgacttgaaagttttcaaatcttgacttaaatagttgaaagtttttaagatttgagatgaaagttttcaaattttaagttgaatatttttgaatttgagatgaaagtttttaaatctgagttgaaagttttcaaaatctttagttgaaagtttttaaattcgagttgaaagttttcaaatcttgacctgaattttttcaaatctgacttgaaaattttcaaatcatgattttgaaagtttcaaaatctgattgataattttaaattttaagttgaaaatattcaaatcttgacttgaaaattttttaatctgagttcaaatctagacttgaaagtttttaaatccggaataaatatgagttggaagtttgttttagtcaactaaacaaagggaagaaacagatgcatggcaaatttttatccaaaaagaaaaaccagaaaaaaaactacgctaagcgccattagcaaagcgctaagcgctattagggcctccaaagtgcgtgccgcctcctttgccggcgcgtacgcgcagaacatgatcccccttctctgatattaactatggtcaatacatgggatggctacatcgatcaaactttacattatacttgtgtttagagataaattttgtttgttaggaggttggccagctctgtacaatcgagctatttaaagttagggattcaatttggttttgggaatctgatagatatttcccatcttctttgttctctcatcccctttctctgattagggctccctggagcaggaccttttttttaacacacggaagatatacacaacatttcattaataagaaagaagaatttacacacagggaggggagtccggaaactcccgaccctaaacactaacacacattaaaaaactaaaagacactaaacaagtccacttaaagccgcaagggctatcgacctagccaacacctcttagagcttaaaagctcctgctaagcaccaaagagcgccttcatatgctacttattaagcctcatttgacatatttggaattgaaccattgaaaacacaaccattcttgtgttttcaaatttcccatgccaccaaaattataagcgagtttagccctttctttctttct

SEQ ID NO: 22651 - DNA, 627 bp, Oryza sativa
cttctccaaagcgacaattattatcaagccggaggagcacacaacacatacctgcatgcgcatgaggagatcggcggactccgggcggcggaggcggtggtcggtgaagtcgcggcgcaccctctcgacgttggctcggtcctccggcgtgccgtggtcggggtcgaactcccacaccgctcgcccggcgaagccgttcgtcgaccgcaacaaagcgccgccgccctgggccaccttcagcctccacatgatgttcgcgatcgagcaccagctaagctagagccaaccaacgtaccggacaaggagacaatgcaaagacgacgaccagctatatccagtatatatactggctgcctttttattagagctactgtggggggcttaactacagtatttattacaataccaaactgtgccactcttcaaataacacttttggatttgttgttacatatttagcagacgggagagataagactatttcttaaatttttttctgccactttaactaacgtggcacaacacgttgacatgtcagcgtggtgtacactaatatctctatctctagcagttggactatcggtattaattactagcaaatacttcgtactactatatattgaggtg

SEQ ID NO: 22652 - DNA, 21841 bp, Oryza sativa
  unsure (1)..(21841): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttactttatttacttaccatttactttgattttctaactttattcaaattaatccaaaaacttgcgctattaattggataaatgtcttgactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactgcatccatgcatgtcaggaggtggcaaggattgccataggagagctccgcgatcgctacagtgatcagttggccgacactgagtatcgctatcatcctcgtcaaccccagggaagtgaccgtggcaactatcttgagactgaaggaattgagaatgatgctaccacaaggcatttggttgagatgctgtgggctatggatgaaagtcgtgcggagactgtgttagcggctcaagatcatgaagatcggaatcgtggtaagatttgcaagttagaggacaaggtggatcgtttggaaaaggagttagctgcgttgaagggagaagcaccgctgcagaaggccaggattcgtctcaccgcaaggaagagagctctatttgtccctcgctatcaattggcgccaaaggtccgtgtggtggagaaagaagttgccccaaccctagcagatcctccggtcatcatcataagtgaggatgaagaagaagaatccaagcgcaaccattccaaggttgagtgggtagcaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggaggtaagtgcatgcgtttgtttgcttttgagtgttaggaagttggtgagtttagtggtgtgagagttttcagtttgtaataatgaaactcagttaagatcaataaaagttcaagtaattctctgtcctaagtagtttcccccggtttctcttcttgtgccctgtccatgccagatggtgaacactcgcagcaacgggaatggcccaagtaaccataacaatgaaggaaacccaacccttgctcaagttcttgctcaacagactcagcttatgaacatgatgatgcaacaacttcagaatcagcagaaccagggaaataaccatgcacctccccagaacaagttagcagaatttcttcatgtgaggccgcctattttctctagtaccactaatcctgttgaagctggtgattggctgcatgccatagagaagaagttggatttgcttcagtgcactgatcaggagaaggtctcatttgcatcacatcagttgcatggccctgcctctgaatggtgggatcacttccgtttgaataggactaccgctgaacctatcacttggcttgagttcaccgctgcttttcggaagacgcatatatcatcgggagtggtgtctctcaagaagaaggaattcaggtcgctcacccagggatctcgctctgttacggagtacctgcacgagttcaatcgtctggctcgttatgctccggaagatgtgcgcaatgttgaagagcgccaagagaagttcttggaaggacttaatgaggagctttcttacccactcatgactggagattattctgatttccagaagttggtggataaggctattcgtcaggaagacaagtacaatcgcatggagcagaagaaacgtcggattgctcaattcaagacacaacaggggaataatcagaagccgcgtcttactttaggaccccagtccatgccacatggaggttcttcgtctgttgttcgtccgcagcgtcagttcttcaacaacaatgctggcaacaacatccgtaatcaagctccacgtccagttgcagctccagcacagcaacaacctgccaagagggagcaaggcagcaagcccgtggtgtgtttcaactgtggagatccaggacattacgctgacaagtgtccgaagccccgacgcgtgaaggttgtccctgctcagagcaacnnnnnnnnnnnnnnnnnnnnnnnnnnnnnnnnnnatgttgctgctgcagaagctcaagatgctccagatgtgattttgggtacgttccttgttaacttagttcctgcaacagtgcttttcgattcaggtgctacacattcattcttatctatgagttttgcgggaaatcatgggatggaagtagaagatcttagacgtcctttgatggttagtactccaagtaatcaagcactctctttgcaacgtagcccctctgtcagaatagaaattcaaggggtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgcgtctttaaggtcaagactgaaccaaataactttggaagagattcctatagtccgggagtatcccgatgtgttcccagatgatttacctggtatgccgcctaaaagggatatagaattcagaatagatttggcaccaggaacaactccgatccataagagaccttatcgaatggcagccaatgagttggcagaagttaagaggcaagtagatgatttgcttcagaaaggatacatcagaccgagttcatcaccatggggagctccggttatttttgtggaaaagaaagaccatacccagaggatgtgtgtggactatcgtgcactaaatgatgtgactatcaaaaataagtatccgctacccagaattgatgatttgtttgatcagcttaaaggtgctactgttttctccaagatagatcttcgatcaggatatcaccagttgaggatcaaagaggaagatatacctaagacagtttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcccgaaccaaagaggagcatgaagaacatcttcgccttgcattagagaagctacgagaacatcaactgtatgctaagtttagcaagtgtgaattttggttgtctgaagtgaagttccttggtcacgtcatctcagccggaggagttgccgttgatcctagtaatgtggaatccgtaaccaactggaagcaaccgaagacagttttagagatccgcagtttcttaggcctcgcaggttattatcggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgaaccaaagaagggtttccaagtgtattgcgatgcatccaaacttgggttaggttgtgtactgatgcaagatgggaagatggttgcctatgcatctcgtcagttacgtccgcatgagaagaactaccctactcatgatcttgaattagctgcagtagttcatgcgttgaaaatttggcgtcattatcttttcggtactcgtacagaggtgtacaccgatcacaagagtttaaagtatatctttactcagccggatctaaacatgagacaacggagatggttggaattaattaaggattatgacatgggaattcattatcacccaggaaaggctaatgttgtagcagacgctcttagcagaaaaggctattgcaatgctacggaaggacgacagttgccattggaattatgcaaggaatttgaaagattaaatttgggaattgtcagtagaggttttgttgcagccttagaagcgaagcccactctaattgatcaagttagagaagcccaaattaatgatcctgatattcaagaaatcaagaagaatatgagaagaggaaaagctattggtttcttggaggatgagcacggaactgtatggttgggtgagagaatctgtgtccccgacaacaaagatttaaaagatgcaattctgaaagaagctcatgacaccttatattccattcaccctggtagtaccaagatgtaccaggatctcaaggaaagattttggtgggcaagtatgaagcgtgaaatcgcagaatacgtagcagtatgtgatgtttgtcagcgagtcaaggtagaacatcagaaacctgccggtttgttgcgattcctgaatggaaatgggaagaaatcggtttggattttatcactggtttacccagaacgtcatcaggccatgattctatttgggtgatagtcgacagacttaccaaagtggctcattttattccggtaaaaacaacctattccggaagtcgcttagcggaattgtatatggcaaggattgtgtgtttgcacggtgtccctaagaaaatagtgtctgatcaaggcagtcaatttacctcaaatttttggaagaagcttcaggaagagatgggttctaagctgaactttagtactgcttatcatccgcagacagacggacaaaccgaaagggtgaataagattttggaagacatgttgagagcttgtgctttagatttcggtggaagttgggataagaatctaccttatgcagaattttcgtacaacaacagttgtcaagctagtcttcaaatggctccttacgaagcactgtatggtcgaaagtgccgtactccgcttttgtgggatcaaacaggagaacatcaggttttcgggacggatatcctaagggaagcagaagaaaaggtgaaaatcattcaagaaagattgcgtgtggcccagtcgcgtcataagagttatgccgacaatcgcctagagatttgagttttgaagaaggagattatgtgtatcttcgtgtcacgccgtttcgaggagttcatcgttttcataccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaggtccaagaggatctgacctatgttgagaaaccaatccgtatcttggaaatagatgagagaagaaccagaaatcgagttatccgtttttgcaaagtccagtggagtaatcactcggaagaagagtcaacttgggaacgagaagatgaattgaagtcagctcatccgcatctgttcgccagttcttccgaatctcgaggacgagattttgtttaaggggggtaggtttgtcacaccctgacaatcctaaatatataaattgttgtttaattggaatttttagaattgattttaaaagcctagaagtgaagatctaattttaattaataaattccaatataaaatgggaccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccaagttggcccagtccgccgccgcgcgcgcgcgcgtccgcccgctgacaggtggggcccacctgtcaggcccgtcgtctacctccggccgccgccgcccgaaaccctagtttcgcgccgccgccgttcccttccaaatccggccgttcctttccttctccggccgaatcaaaagaggggaaatgatctccgggatctcctctaccttttctcttttggaatcatcggccaaatcggcttggaaagtgtttgattcgaggtcgaatcggatcggcttttctctctccgagcccgacctttccttctcgtcgccggtcgtcgtgggccttcgccgccgcctccgagcccctttaaaagcttccccggtgtctcctctacccgccgccaccctcgccttcgcctttcgtcgccggaagagccctagcgccgtgtgccctagcgccgccgtcgccgccgtcgctccagccgtgcgccgccgccgttccaaacgtcgccgtcgctcgggaagaccgccgtcgtggtcgccaagtcaccgccgtcctcgtccgccccttcgccgtcgccgaagatcaccggagcaccgtcgccgccgtcgacccgatctccgccgccgtttcaatctcgtcgccgtcgccgtccgttcctcttccgccgtcgctttggtcaccggtgagttcgccgcgtcgcgctctacccgatggtgccttccgttcgcgccgccgtgccgtcgttcgccggcgagcatgcaagcccgagccgcccgagccgccgccgccggtgatgacgtcaccgctgacgtcatcgtcgccctctcccgtgagccggtcgtggaccgatcgatctcggccgtccgttttggatggattgatctcggccgtccgttcgcgtgaaccgccgccgtgcgcccggtccaccgaaaccctagcccgctgacgcaataatccttcttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatatactgttcatgcttgtttatgtgctgttttggtgtttttgcttcttttcgtttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttattataatttgactagttgagctttatgtatattggttcaactagatattagatataattgcttagccctgcttagaaacattagctcactattgggattacttatgactcactattatttaatgatggcttaatgatagttcacgatggtcaatcgtgattagttaattaattaatgtgccaactaaaacctgataatggtgggttgtgagcacatggttttgagagtcgtgctcatgacaattaaggaccggttcacgagtttcagttgtgaaacattaaccgtgccagccacaagccagcgtgggcaacgactttatcttttgtatagcatggttcattgcggggcaccagactgagaagtggcggagataagcccacgggggtcgctggggagtccatgccttgtttttaagggggtgattatgatccaggaaggtgcactgcagtggattgtgttatgcaaggggtattgtcacaactcctttccgagataccgtggtggtattgaggcacatggtgacatgatgtggggttgtgtcttgtgggtacagtggtacacctctgatcagagtaaaactattcgaatagccatgcccgcggttatgggcgggtcgaacaatgtctttcgtgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgtttttttaaattctaaaatatttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagatacggactagcatacagcaaggctgaaccgtagatgggtgagactttgcatcgaggagacatcacagagtttaaatactgtgcaaaagtttatgagtcagacttgatgtcgaaacaagatttcggcaatactaaaaggggtggctatcaagctgaaaaagtagattggttcagagacaaggaattttatacaggttcaggccttcttaaccaagaagtaataccctactcctgtccggggattgatccgccgagtgtattattgatcgtatgatctgggagaaaaatcgtgtccctaaaggcacccggaccccttcccatcttaaccaagaagtaataccctactcctgtccggggattgatccgccgagtgtattattgatcgtatgatctgggagaaaaatcgtgtccctaaaggcacccggacccctccttatataggggaaggggttcgtattacaaagtacagaccatatccctaacggaataggtaattacagataaaatacaatcgtaaccgactaggatcctgggtgtttccttgacatacaagtttggtacttaacccgagtcctcttaaagatattctatccatacatggcaccccatacccagtcggactatacatgccgtgtaggtatagggtatccataatctccacagtagcccctgagacctttatagtcgacgaaacagccttctctcggaacgtaaagtgataatccgagtgcttcaatttctttcgtactgatctcccgagtaccaaaatcaaagactgtgaagggctgaaagtaaataattaggtgcatcgactagatgcacctaattaggtgtagcctccgactatgtgagtagctaaaagctaaacatattgtcaaagtacatcaaaacgtccattcgagtggtttttaaccaaatatcccaaggccaagcatatgcagcatctgataaacctcccgccgactgctttaatgtgccaaagaaatataaagaaaaacccgagtgagaagcactccaaaggtttataaatcaacacaggtgataaaagtccaagtaaaaactttcaaaagacctatcaaatgtggcataaaatttgataaaagacgagtcaaaatagcctaggctatgactcatcccataatcaaaatatgcatataacatgccgagtggatgactgtattaaaaccagtcatctcaagaaaacccaaacaacctttgcagcctaaaaaggcctacaaaattagcatcaatctcccattcattcccagctgcagttcagaccaaaatacataatccagttcacatccatggcggaagagagagaaagctttgagagccagtgggcgccctccgatgttatggaggagaacctgaaggagatggtggcgcacggcgttattccggcgaaagaaatcatcgggtggcgtccagcattcggcgaagcatttccaacccccgacacacatgaggtcgtagtattctctcatttcttctatggcgggttttcccttccgacctcaagcttcttccgaggaattttggatttctatgggatcagtttgcaccacctaaaccccaattccatagtccacatcaccaattttatccacgcttgcgaagctttcctagggattaggccatatttcgctctattccgtcgcatcttcttcctcaagccccagccaaacaaaagcaaaccatgtgtagttgggggagccggatttcaactgagggggaccttgagccaaaaatacttctccatgccattcaagacctcgaacaaaggttggcacgcaaactggttctatgtgcaaaaccctgagccagcacttctcggatactcctgtcttcccccaatatatcgcgacacctggaactcaatgcctatgggagaagaggccgcccaagcactcaacttgttggatcgcatgctaaagctaaaagaacagggtctgtagggggcgcaaatcacccggcatttcatcaagagccgactggcaccaatcaaagaaagatccagaacagcctttgagtttgatagagcatgacctgaatcgtgaagatccagactctcttgattttaaggttatgaaggagagaatgtacaaaatcttctcgaatgccatcgtggtcagctattcacacttactgccagttgtgccatacaatgccttcaacccccctccaccggtaagcgttatacaactcagcttttctcaatgcatgcttttatcttctgtaaagttgactgaaaacttggaataccatgcccaggagtttgctttgatgaagtccgatactccaattgctcaacgccgctcacctcgccggcacacctgccaagccagtggagggccgaagattcagtcggatgtccaacccaacgcttcaagaacaactaaccagccagattctcgtaagagggaatcggtgctgaccgacgatgagggccatgacgccaaaaaacccagcaaccaaaaggaaggagccgagagacagccaaagcaagctaacttaaggaagaaaacatccagtcgtccaacactaaaaataaggaagtcagccaggtatgtgtcatatcacagttgccgtcatccatcattcttcattgtagcagagctgagaacatatatcgaatttgcagaaagccatctgacatagatccttctggaaaagaacccacgctgactggctcggagactggtccttcagcggaaactgggcagctgccgaagactgcccagataataatcaaccggcgaccggcaatgtagataccagcaatgagcccctgactggaaaccagtcggcggaagctgaagccggcgctgatgaggaacctccgactagaaaccagtcgggtgcagaacataatgaagatattcctaaagtagaagctcaagctgacagccctcctaaaaaggatgcaagcgtcgatccagggaccagctctcctgttaaagtacaagggcccgctcatccccgaccggaaataatcataggtaaacacatcctccgaactcatcttgatctgacagacttttttcaattgtttcacttttattcataaatgcctaaggcccaatgatcggcgatgaagaagaagtcctccggatacagtcagctgagaattctcgcccacccattttagtcaagtggtggaatcacgacatgcaacctcaaggaatcgtgataaacaagcaaaaagaagatgaggaagtatgcttgctgaaaaaggcactcagccaggctacttgcatcgtgaatgtaagtctccttattcacagcttcaactatcctgtttcccactttgctcaaatgccgacaaattcgcattgcagagaatccatctcaggaacgaggcgaagaccgcgactcttgagaagttagttcctcatcttggaacccttgaagccaccagaaaccagctgcacgaggcaaaggagcttgccaggaaaactgagtatgatctgagggatcggatcgccgagcttcaagaatccagctttgaactgagcggttcgtcaaaaggtaaatacaatctctgtctaacttacttatgctgccatccttgtaatttcaattaacaagaagcaatacagtgcaagccgccaagatatctgaactagaaaagcagatccaaactctggagaacgacaaggctgaattggcgagacagaggaactcggctctgaaagatgttgaaggtactggtgactaatacctcttatctttatgaccactcgttgatataaatctatttatgcagatcgcaaaatcaagtctcaggctcaattcgatatcttggtcaataaaatcaaaaggcttgaaggggctagggatgaagtcgccaacactgctaccccactcgtccaagccatgttcttcaataataatggtccgagtacatttgatgcctccgaaatcttcgacaagctgaggatcgctccggacacatactttaagaatatcaaggacgctggaaatatgggagcaagcctggcgttggcaatgtccaagcctttatacccgaagattgacattgacgccattgatggatttgcagacgggacgagcgaagaagccgcccttgacctcatcaacgatgcgcagaaagcagccgataagatagccgttgatgtagttgagagattccaggacaacgacctccggccgactggatctaataattccgatgatgagaaaactgatactgattgatgttatattgtaacaataactctgatggtgatgatgatggaggcacaatttgtacaatactgatgaatttatgctgtgcttgatatttcaaacttagctcctgatttcttaaaagtttttgtcaaacctttttgagcctaaaagccgcaaaagttattaaaaaactttcagtcctcattgactaagccagaaaataaaacaaggcaatgataaatcaagtaagcaaattgaattgataaaaatcacactccattattattatagtagcccctgactgataactcaaggaaaagtttgatgttagcagtcaaagaggaagatacaaaagtaatgcctaagcataaaaacgacgaagatgttcaatattccaagagttgtcgatagtaataccgtcttcacgtttgagtcggtaagaacctggccgagtgacttcaaaaattatgaattgtccttcccacaagggagataacttgtgccgatcccatgtagtttgaatttttctcagaaccaggtcgccgactaaaaaggctcgtgatcgaacgttgcgattatgataacgacgcaacccttgcaagtaccgagccgactgaattaaggctgcttcgcgagcttcttccagtcggttaagatcatctactcggttgtctccgtagcgctccttgttgaagttacgaaaacgtaaagattcaaattccacctcactgggcaacattgcttctgctccatagactaggaaaaacggcgactggcccgtagcccgactgggagtagtgcgcaaggaccaaagtacagacggtagctgctctacccacttgccggcatagggattcagtcggtcgaaaactcgtgcttttattccttgaagtaccataccattggcatgttcgacctgtccattgctcacggggtgcgctacggaggcataacaaattttaatgccgaagtccccacaaaaactttaaatactccgcctgtgaattgagtgccgttatcagtgatgatccgattgggtacgccgaaccggtgtacaatgttgatgaagaaatctctagccttgtatgtcgtgatcgtaatgaccggtttagcttcaatttacttggaaaatttgtcaacagccacaaagaggtgagtataaccaccgactgcctttttgaacgggccgaccatgtcaagcccccaaaccgcaaacggccaagacaacaggatggtttgcaactcctgagctggtagatgagtttgtcgggtgaaaaattgacaaccctcacatgttcgcacaattttgtcggcgtcggacacagctgtgggctagaaaaaaccctgtcgataagccttgccaacgatggttcgtgcagcagcgtgattaccatagatgcctgaatgtatatcttttagcaattgccttccctcctccatagacacacagcgttgcaggattcccgatggacttttcttgtacaactcggtctcatgaataacagagtttgctgcgcctggaaatccgctcggcttcatctttatcttgagggagttctagtttggtcaaaaatcttatgaggggctctctccagtcggcttcaatcatgcttacgtcttgggtgtccgtggcttcaattgtttctttccttggcacggttggttcgtaaagatgttcaacgaacacgtcggaaggagctgcttctcgttttgaacaaaaattagccagtctgtcggctgcctcattattgtgtcgaaggacatgggtgagttcaaatccatcgaatttgtcttccaacttgcgtacctcctgccgataagcagtcatgttatcatcaaggcaggaccactctttcatgacttgattaacaaccaactgagaatctccacgaacgatcagacgccgaatgcctaaggagatcgcaatccttaatccgtgaagcagcgcctcatattctgccacgttatgggatgcagaaaaatgtatccgcaatacgtagctcaatctttctccagtcggggagagtaaaacaaccccggctccagtgcctgaaagcctcttcgacccgtcaaaatgcatggtccaatactccatcttttcctcgggcatgtcttcttggcactcagtccactcggcgacaaagtcagctaaagcttgggacttgatcgaagttcgcggcttgaaggatatatccaaggacatcaattctaaggcccactttgcgattcgtccatttgcttcgtgattatgaagtatgtccccgagtggaaacgatatgaccaccgtgaccgagtgaccttggaagtagtgagatagtttcctgacggtaattaaaacaccatataatagattttgaacctgaggatatcttgtcttggaatcagccaaaacctcgctaacgaagtagattggtcattggactttttgaacatggccttcttcttcacgctcaacaaccaggactgtgcttacaacctgggaagtcgccgacacgtataacaatagcggctcttgcggatgtggtgaagctaggactggtagagtagtgagaagttttttgaagtcttcaaaggctttctgtgctttgggtccctactggaaattgtctgttttcttcaacagcctgaagaagggcatccctgctcgccgagtcgcgaaacaaaccggctgagcgccgccatgcaaccagtctgcttttggacatctttctgggagctcggcggtttcatgttgaggatggcgttgactttctccgggttggcctgtatgcctctatgggacaccataaatccaagcagcttccctgacggtactccgaagatgcacttttcagggtttagtttcatcctgaaggtgaggatgcttgcaaagatctcttttagatccgtaatcaaatcatccttctgcttggtcttgacaactacatcatccacataagcttcaacattgcggccgatctgagttgaaaacatctctggatcatgcgttgataagttgctcctgcgttcttcaatccaaagggcatggtgatgtagcagtaggccccgaagggcgtaatgaatgcagtcttcaagcagtcggattcttttagtcggatctgatgatatcctgagtagcaatccaaaaaactgagtagctcgcagccggctgttgagtcaactacctggtcaatgcgaggtaacccaaagggatctttgggacaagatttgtttaggtcgatgtaatcaacacacatgcgccattgtcccgtcttcttccgaactaggactgggttagccagccagtcgagatggaggacttccttgataaagcctgctgctaacagcttggtcaattcctccttgatcgcatccttcctatcctgtgcaaagcggcagagtcgttgcttgcttggtttagcgtcttccttaacatgtaaagagtgctcaatcacctctctaggaataccaggcatatcagatggtttccacgtaaaaatatctttattattttgaagaaaggtgatgagcgtgttttcctattcacaatctaactcagcacctattacagcagtcttagtaggatcagagggatctagaggaattttcttggtcttggcgtcgctttctccgctctttggcatcttggttgcaggcacttctccttcgcttgctgtggacgtggccagtcggacttcttctcgggcgagggtgatctcgtgggtctgggccatctcgcagctttccttgtcgcatgtgacggcttgtttgatgtcgctccgcagggatatgactcctcgaggaccaggcatcttcatcatcatgtaggtatagtgcgggacagccataaacttggctaacgccgggcgtccgagtatagcatgatatggtgtctcgaaatcagcaacttcgaagcaaacgttttctatgcggaaattctcccgagtgccgaaagtgaccggaagagtgatctggccgagtggtgtagcagatagccttgggatgactctgtgaaagggcgtattactcggttttaattccgtgcgagggatctgcatgtcgtcaagagtcttggcgaaaaggatgttgagtgcactgccaccatcgatgagggatctgcgaagcttgacgttacgaaccattgggtctagtaccagggggtaccgccccgggtggaccactcggtcaggatgatccgagcggtcaaacttgattgttgtctctgaccaccaaagatattggggcatatcgggctggacagcattgatctcccgttcagtcagcttttgctttctcttggatattcataagccaggggtccgccaaagatgtggttgagttccttgcgatggtcttgaaaaccagtcgagtcatcatcttcgtcatccttcttctttgacgtgcattgatctccgtcagtgttcttgcgtgcgttcttggcgtattgttctgcaaactatttgtagacgaagcaatctttggccgcgtgactggaatttggatgatgcggacattgggagttcatgatcttgtcaaaagtgttgacgcgggaacgtttgtcgggaggatagtgtagtagttgccacaagttcctcgggcttacgcttgcgatccttgtgattggtacttccactccccctgtagtcggcgtatctttctttggcttccaagtggtgcccgactgcttggacgcggtaatagcatcttcggctttggcatactcattggctttttcgaatatctgcttgaccatcctgggaggcttgcgcccgaacttgccgactaggtcttcgtggcaaatgcccttggtgaaggcggcgatgatgacgtcgtcggtgatgtcggagattttgttgcgttgctcagaaaagcgtcggatgtaatctcggagggattctccgggcttcttgataacgttgtagagttcaaactgggtgccaagacgttcaaaggtgccttgaaagttggtgatgaagtgttcgcgtagttccgcccatgatccgattgtgccacggggtacctgtgaagccaggaccaggcagaatccgctagggccacgggcagatagtttaccatggccttgctgtttcctcctactgtgcggatggcgagatcgtagacggtgagccaagactcagggttagtgctgccatcatatttctcgattccagtcggcttgaagccagccggccaatccactcgacgcaggtcacttgtgaaggcagctactccgtccacgtcatcgtcgtagcggtctggtgaatggtggggagcatagcctcttgccgcgcggcgctggttgatagtatcgcaaagatcgacggggcgcctgcgatgtggggagcgaggtcgttcaactcgacgctccctgtgtcgttcgggaggcgaatggacagatcgctcaccgtgacccctgctcctgcgactggatcccgcgtcggcgatgctgaggcttggttggtgatagtcttgagatcgaagagggggaactcggctgccagtcggcgtgcgggtgcttgcggagttagccgggaccgaggcggcgatcatggtcttcgtttggttcaagattttgatgacgtgctgattgagcgcgtcttccttgaggaggctgtcgaggagggtgatcgctgcaaccgcgttctgttggggagggtgcgaaaaacagtcgtcccgtcgacgtcttgttgcccaatgaggtctcgtgctcgtcgcccagattccaaggcgcgctgtcgtcgatcctcaacctcctttgcagcccgttcgcgatcttgttgttcacgctgcagtcgttctcactcttgtcgttgttgttcttccttcagtcggcgacgttcagcttcttttcgtgtgcgctcttcttccgcttctcgggcttggcgctgttttgccgtctcattgtcggccatgaatacgccgaaaaagagaggcgtgtagtcgtcctcatagctgtcgtcgaagtcgttgaagttaccataatcgtagcgatagccgaagtcatcgtactcaaggatctccgttggtcgagaactgacgtcgggagaactgaggtagccatccaattcttccgtcgagaccgtcccgagaggttggagtataacgccgacctctctagagctagattagattggagccgaagccggatcccgtctaggtcttcgggtgggagacgccttggtcgtgaagacagcagccagatcatcgggaagtctcatcaggattgggggataggacccgtcatcttgatctggtcgtgttggagtagattggatctcgtccgagtggtttgaagccaactcggtagagatgatcttggggtagacctccggccgagttcgggataccgaacggagcggagatctggcctcttcccgactggttcgaatccgagtcgaggagagaaatcttgccgaagtcgaggctgccaaaccggaacgcctgcctgggagggaatacgaagtcgtcgatgccggagacggaaccgatcgcactagtcggcgaagaacttgatgctacccctacctggtgcgccaactatcgaaacaagatttcggcaatactaaaaggggatggctatcaagctggaaaagtggatgggttcagagacaaggaattttatacaggttcaggccttcttaaccaagaagtaataccctactcctgtctggggattgatccgccgagtgtattattgatcgtatgatctgggagaaaaatcgtgtccctaaaggcacccgaacccctccttatataggggaagaggtccgtattacaaagtacagaccatatccctaacggaataggtaattacagataaaatacaatcgtaaccgactaggatcctgggtgtttccttgacatacaagtttggtacttaacccgagtcctcttaaagatattctatccatacatggcaccccatacccagtcggactatacatgccgtgtaggtatggggtatgcataatctccacacttgagttgggtgctgtttggagagggagtttgtaacagactcttcatcgtagtacacgatccgaggtgatgagggagaagtcggctgcatatatattcaattcggactttggacgtcgaaggatcaaaggaaacgagacagcgcacgaccgcaagggcactcaacgttggcatgcaggctaaaatcatagtgttggtcatcgagacagaaggcttggttgaagcgtgcaagagaggtgcgtgtaaatcggttaagtcgggccagcagggtgatcagatcgacggaccagttagactgcagagtttggacggttagaccgggttcaacggacgtgtggttcgttacaggaacttgttaacagatccaaaagaaggacaagaaggttctacagatggatagtttgcaagtgtgaaggacgagtagactggtggcgacaggctggtcaggtcgcatataaaaatatctggcggaaacaagatatatctaggattcgacgaggagttgagatatatggagttaagccagaactgaagaaaagtcccgggcaacagcgggtcaaatatcgttgatggggtcgacaatactgtttggcagtacaggatatatccaggatatgcaggtcggcatgatggggatatatggaaatctgcgtcactgaagaggaagagcgaaggctatcgtggtaattcttcaagtgattcaaggaaacggtaaattttctcaatttatcatggagctcagtctacggatgcggaaaagcgtggatgttggatttattagctcggttcataagtcgacaaggaagaaagggttctcttcaagtctggtgagtttgatttatttatttggtgatgacgtgggttatctggccatggattagatcgaatcaaatcaaagacggaagatggagttgaacatggtcttcgaggagtttatgatgtgacagctaaggaagaatccaatttcacttggcaagacgactgagatgataggtgagaaggtggagcactgttgcaggtggagtctaagaggaagaaattacagggatagcagagtatcttgaaggcggcgggtctggcgcagactcgcccggcagcttgcggtaaagctgcaaagaagataacccaagtctggaggacaggtggatcgacatggtgattctactacttctaggtggtgtatattcgccaaggtggagtttgttagaataggtgtcgaatatactagtcctatttggttacggttggacttagagttgtaataggtgttagggggtggagttagagtcgaactctgtaacccggcaactctcttaaatagagaggggggcaccacaatgtaaccatggtgactacaatgtagcgtagacacgcagggagaggatggtagcgaggccatggactcgtagcggctaggagctatattggttggggaggagcgcccataatcagagcctcgaggatataggcttcggctgaacctcgttaacaaatatcgtgtattcctgtgtcgtcatctggcatgtcttgggtgatcaatgactgaagcgatcgagaaggttagtcgtcgtttcgctatatcgactaacttttataacatatacgaaagggactctgcagtgcgtgccaccactccttgtgacgtgtgccatcccccacgtcgaagtttaggcacgcacactagtacactacttctacagactcgctagatcactggaacacgacgcccacatcgcgcgcaggcgagtgtgcacgacagactcgacaaaagagaataaacggtgtgcgagaaaagaaatgaaacgctacagatag

SEQ ID NO: 22653 - DNA, 11174 bp, Oryza sativa
  unsure (1)..(11174): unsure at all n locations
nnnnnnnnnnnnnnnnnnnnnnnnnnnnnnnnnnnnnnnnnncgactaacttttataacatatacgaaagggactctgcagtgcgtgccaccactccttgtgacgtgtgccatcccccacgtcgaagtttaggcacgcacactagtacactacttctacagactcgctagatcactggaacacgacgcccacatcgcgcgcaggcgagtgtgcacgacagactcgacaaaagagaataaacggtgtgcgagaaaagaaatgaaacgctacagatagcttcctaggataactttgagacaccggcactggattacttcaagtctaacagtcgaggctgaacacaccgaggagcttcaccttctcggagagctagctcctccaagaactcgtcacggctctcgaacctctccccaatcatgatgcgtgcgtaccatgcagatagagacgactgctgcgatccgctcggtgaaagaaattgacgtaccgcatccctggatgaagcgacagtggcgagcgcgcccctcctcctccctgacgcggcgtgccctgagcagctcgacaacgcagatctttccgacctgccgccacgctcgtcgtacggcacgacccttgctgccgatcgttcgttcagaggcgccccatcaatatcggttggtcttcacaaagccgttcggcgctaagtaccagcatcagatccttcagctgattctacaccaagccatcggctatcgtctatcggctggtacatgcttttggcacacttgagactcgagcctgcaatcgtcatcaacgtccgggtctccaattctccaacagccgattggttaacctatcggttaatcgctgctacatcgatatcttgtcagttacagtatcagactgactggcacacacgcacttcatcaaaatttaagacatgcactaagctaagcatatttccgcctttatgttgtttatcacgtcaacagacttctaataggaaaaaacatgcatttgaatcattaggaaaacctgcgtatacagaactgctggtgtttctaaaacttattttgagcttttatacgtcacagccggtagccattagcgatgaaaaaaaaaagctcagagatctagaaatgtgtaacatcctcaaattttaaattaaaatttgactgcagcatgctggcttttgattaatttagtgtgttttaaaaatttatttgattttttaattggttcaagtattacttccttagagccctactaatttaccataattattccctttattccaaactttagtgaatttgaacaaattctctcaaatctcaaactatagaatattttcttagtttactccaatattagtgaggatttgctatacttcaaaccctagtgaaactcttccaaattcatagattaaattcattcttttctaggaaaatattcaaaaattcctgaaaacactgttcattgcactgaaggtgctcgacaaaatgcccagcccagctagagcagcccaattaccacccaatcttgtgcaaagtctatgttggatccttggggaccacatcccactcaaaaaccgtggtttagttgaccttctcctccccttgcgcgcgccgccctggcgtccgacttcgccgcgcgccgagccgccgcgcgtcagcctcggggccgcttgcgcgtgcccgatcgtcttggcgcgccgtcacccgtccaacgccttcaagtcgccggtgccacaccaatcttgacgacgacaaagccgggacgacctccgccgcaaggaatcgacactcgacgccgtgcgctcccatccaagccgccgccgagtgcgattttgtttctatccggggtgaatcgcgccaatttttgccgcacggttgaattgaagatagacggtggtttcccctctcacaattcaaaccattcacccctgagccagccattttcaccctcgccgccgccgcgcgtcgcgcctggattggcgccaacacgtcgccagccaatttcaaccgcggtcaagccaatccttcgccggtaagtattcgaacgtggcctcccgccactcaaattgatcttgcccaccctctcacagcctctaccgccccagccgtatccaaagtttgagctcatccatggcgatgacggtgtccgagctcatccgctcctcctagccctataaataggaccccaatcccttccttgtccatcatcgatcatcaacaaccataaccccacaactccgaagctctgcttcgccaatcaatcccatcaaccaccatcgcccgtcggtcgaacactttgtgcgcgatcgactccacacctctccacccattctccgccctaaataccccttagaacaccttatatcaaccatgttctagcatagtgagccctaatcgaagccctgcgtcgagttttacctcgccgcaccaagccgagcaccgccgcccccgcgttgctctgttctttgccgccgcgaagtttttccggccgcaatccgccgtttcaaccgatctcggtgagttcttccgtttcaaccatctacatactacctagagtctatttttgcaatcggtttgcactatcatgccaccctctgggcttccgacgtgagcacggccgccgccaatggaggcgcttgtcggcaagtattctccgcgccttgccaaaggtcggcaagctgttggaatccatctaggcacctcatagatgctctagaatccctcccctaaccatgtctaactctcgtcacctcgatcaccatcacggcctaactgtgccaccgccgccctagccgctaggccgtccacgcatcaaattagctcctccgccgccgctcgccatcgccagagatccctagctccctctagcgccactgcaatcccaaaccctaacgccgccgaccgattttggggaacggccggaggttgaagaagagaagagagagagagagactgacaggtgggacccacacacagtgccatttcacttttatttgattttcaaaatatagatccaattccagtgaaacttggaccaatattcttctaaaatcattctctatctattgagcccctttttgctatttttgtattttattttattttctccatttttggattttatttgaattccttttgaatttgaattttatatgtttaaccctaggtcttgaggattcttctgactcactaaataatattaatcaatctcaagacatcgagcaaggcaagttactatataccttttgatcatttaagcctatattttataaattatttatttatagccttctattcaatattctattttatatgcataattcaatcatagaaacccagataatttagtattgcttattttgcttacaatctggttaaaataccttatacttaggttgggacagtacgtaagatttggttgatttccgggtggctagtactgtctcgatcgatataagttttactaggtacttatgtcgaacgaacgggtacgaccgcagtttctagaatggggacagacctagttattatgttaattagcaatatggcacctctgtatagtggttcttatttttaagtcctcgcgcaggaggcaactatagccgcgaagggcaacttttaaccattaccatgtacaggtaaatggtttgtgatactcgagtataaactatatggtataattctaaaccctgatcgagatgacgtggtgtcatacgatcagtttccccttaaatacctcgggaacgccacaactcctcttgctgctattaacattacgttcagggcatatgaggatacaagttcatggaacaggtgccacaattgttaataacttaatactgggccttgactaaagccgatgattatcagcaagtcgtggactgcaggtaaagcgtacatctgctgcagtagaatatctttgaaactattcgaatagccgtactcatggagttgagtaccaggactcatatggtaccctggttagaaatctaaaatctatatgattataaattcttgctataactcttccagaatatttattattgctttttgcaaagaaccctgctatatgctaatgcataacatatttccatgataacttgctgagtattgtgaatactcattcttgctctcataaccccttttaagatttgggtcaagaggaggacccctatgactattactacgatgaccacgataatttagagaatccctaaaggttttacctccctagtcagaatgtataaaaacttccgctgtatattaattctagttaatcaaataggtgagtacctattattgtaaaacccttagtattataaaactttaacgtatgcaatgaagaactagttatattgtatgtatcaacatctactgatccagggattgatacattaattttagtcggatcaagttgttagttttggacttcgacaaaatgatatccacggtatattcttctgtttatagaaataagtgatcaagcatacatgtgttgtttctttgttttgctgttttattagagtttcactaactcgacccacaagtatctttcagagcacggcagcacatgtgtggccatttttttttcaaagtttagcatcagtatttttatgatgcctagactgaatttatgaagacagtacatgtagatttgttgtgaaaagtacttcatctattataaatttagtaattatctttcagatcgtaaccataattcaattaacaatcattggggtaccattcaagagtaagttcacaagttctatgggtattatgagcaaattcttaatagaccttaaagtagaataacggttcaagattatgtaatcatttaattgagttagcgtctagctttcttaaagaatattgtttttaagattatgtgaattaagagaagtggcacacaaaacgggaccaaccaaaatatgtagattaattgcataccttcattggaataagactgggttgtacgtaggatgctccgagatgtagttgtggtgcagcctatcatatggcccgctcgacgatcacgacgaacaacctgactaccaggaacagcaaaaccatgtcgtggagcattcgaatgctcatattcatcttgtgtaactattgctgctgcagcgatgagttcatcgtcagatgacgatgactcatccaacagaagatgtcttaaaattaaaatgaagctcattgattgatggaagaaggattcacaacaatgtgaatggagaaaaagacagcaagcaatgtagcggtatatgtagggctgaaattttacatgttgcatggtcgttggacacaattttaatgagctagccgttggaaagctagctgttgaacacatcaaattgaaataaaaatatttcattcattgcaaatatatcaattaaaaaactactaattaaaaatatatctgttaaaatttacttattttgaaatattaacgcaataaataacaccattaaaaatttagtcgttcaaaatatagtccttacaaaataatataaatgtatggttagttgaaagatattactgaaatatagaagggtgtgatatggatgatctgtttaataagtgaaaatggatacgaaggagtaatccttttaaacggccatctatttgtgcatatggatgatcaaatttggatgaactgttggggtgctctaatacatatccgggaccgttggacacaaccacctcaatacttgctataattaataccggtagtccaatcactagatatattgtgtctttttattagtgtcacgtctgaaattcacaatcactaggactacatgtctgggaccgttggacacaaccacctcaatatatagtagtacgaagtatttgctagtaattaataccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcaggtatgtgttgtgtgctcctccggcttgataataattgtcgctttggagaaggacacggtcatctacagaaaacaattttgaccaaataattcgcattataatatgtataaaagtgttaacaaatatatgattttatgattttattaaagtacttttcaccgtacttggaaaataaatattttaaaaatgatttataatcaaatattttaaagtttgatctcactctgttttaaaacgataagtattatcagcccggagggagtatatagttaatagtgttaatttgaactgaaatttatgtaatttgaaacaggatcactgttagctagcttcatttgatcgattcgatgttagtttgaccatctgagatatgatcttgttgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttggtattaatttgatttttttggctaattaatattaatattcatgttcaattatttcgagattaatttctagtgacctagtttctgtatgcagatattttctttgtatgccactggatcactggacactgtcatatcatcagaacaccggagggagatatgtcgctacatctataaccatcaggtttttatttatttatatatataggtccatcatcttaaaaaaaaatgctatatatatataggcggactcagaaatatacccatgcgcatgccttcatggctttaatagatttttattagaaaagatagttctagctccctccatccagatattgctatagtttggaacgacagttatacttaatttacttaattctacacatgcagaaagtgctaattgatcaactcacgaataatttgctcaaacaaaacaatatgcacatatagttttgatgtacccctctaggcataaatgtttgacgcataggacaagtttcgatcaaaaacttttgaaacttaatttgactaccagttttatgttaaaatgagtttataaaatataataaatttatgatattgtggtataattttctaggtcaatctactcatataattttttttaaactaagtatttgagaaattattgtagtcagttcgaccagatcttattaatattaaatatttataattggaaggagtaataattaaatattgttgtacagaaacattgcattttttatatttacatgtgcagaacgaggacgggggatggggcatgctaatcttgggatcaagcacgatgtttgccacatgcttaaactatgtcaccctgagacttatcggcgaggagccaagcaatgagcaattagctagaggacacgcctggatcatatcacatggtggcgccacccttgttccgcaatggggaaagatatgtctgtcggtatgtatgttagattaattatcagtacatcttgccaaccaattaaggttcttatcgtttgcctatataaaattagccgccgttaaaattcaaattttaaaactagattttgaaattgattttgaagtttttttattaatttttatttttagatatacttttacatcactaatgacatatatataaaagttttacctataaattattaattttttagctaatacgctatacggcttattatatatcagtattggtacctaatatttaacaaaactttcagggcatgctaaggcacagttcgatccagcattttgattggagctgttcgtggattggaaaacgggacagattattaacgcatgattaattatgtattaactattataaatttaaaatttagatttatttgatttagaaaattctatatagaaattttaacataaaacatatcatttaactcttcggaaagcatattaacgaaaaatgaggaagttgatgaaaagaagtaagccaaagtcagttgggtgccagcatagctctacaactatttactacagttgcgtagcacggcggtagccagttcaaaccgttcagagcattatatatatagaaaccgtggcatcttctgagtatgtagtagtaagaagttaaattaattttgatcaacttaagtttggattcatcgcagataattggagtgtatgagtggtcaggaaacaaccccatcttccccgagttatggcttgctccacaattccttccgtttcatccaggcatgtattgcacagttgtactacatttatttttaaatatataacgttaacaacttttaaatataatatttaatctttaaatatgatatttaaccattcatatttttgaaaactatatgtattatttactttgttggaatttagtttatcattagaggtactctaagcatgacctattttttttatatttacacaatttttaagaagtgaataattaaatattatattaaaggtgagcaacgtcatattttaaaaaattgaaggaagcactataccaaacacagcagtatatacaacaatttaatgtcaacatgggactgaaactttaatataatatttcgttatttttgttatgaatctaaagacttgttcactttgctactatttttaaccttaccaagttttagcattactaaattttagtaaggttgtcaaaattttagcaaggttgtcaaattttggtaagattttatatgtacttattaaaatttggcaacaaattaaatgtagccattttttttaactttgtaaaaaaaattagataaggttaaaaatgatagcaaaattaacgagccataattatttatctgcaggcaaattctggggcccgacccgcgtggtgtacgtgccgatggcctatctgtacggcaagaagttcgtggggcccatcacgccaaccatactggcgctgcgagaggagatatacacggacccctaccacaccattgactgggcccaagcctgcaacgcatgctccaaggtaacaaataaatattggccttttttttttttggaagttgagggagtaaatcggactcgggctatagttgaagaatgtaatcagacactcgaacgaggaaaatgaaatgatcccttcaaaagaattgaacctgactttagaaaattttttgggtgtcacatcgaacgtttaactagatatcgaaagaggttttcggacacgaatgaaaaaactagtttcatatctcgtctggaaaccgcgagacgaatttattaagactaattaatccatcattagtacacgtgggttactgtaacacttatagctaatcatggtctaattaggctcaatagattcgtttcacgatttccatgcaaactgtgtaattagtttttcattttatctaaatttaatgctccatatgtccaaagattcaatgtaacgtttttgggaaaaaaaaatttgagaactgaacaaggccttaacaactcatccaaatttgatcctccatatgcctatatagatggccatccaaaaaagattcctcctttatattcctcctcactccaacggatcatttatattacgttctctatatcatatcatcctatattttattatcctatattttattagtatctttcaactaccatccatttatattattttttctttttttcccctttctcttacttctctctttctctttcttctccagtcctctcgagctctcctctttctctcttctccagtcctctcttctccagcggcggagcaacgcgagcggaggggcgaggggcgccgccagcggtcgggggtggagggcggtgggtacaaaaggcggtgggggcggagggcggcgcgggctgcggggcgatgcgagccgccgcgcggaggagaggcgagcagcgcaagcggctggccgacggcgggagcggaggggcggcgcgagcagcggagcgacaggagcggctggatctggccggagcgcggttcgccggcgacgacggcatggcgtgcagcgctgcgcatattctctaccttcgctcctccatgccttgatccggattggggcgggagaaccagatggatgcggcggttacgggatggcgttaggagagagaaactccaaatctgccgattctttctccggaatagcgcatgcgttatctttggaggctcggatggcgcatctactggagcctgattttctcctcccatgtgctatatttgagatggaagattggatagagcatctgctggggatgctcttagtctgtaactaggccttgctttattgggtttcttctctctctgtgtgtctgcctgttgaagtgtgtatactacactattggtgatggcaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaaggtaaatttgaaatataggcgaccgaccttgctttcagggcaaaaaaaaaaaaaaacaaaaaaaccaacattagaaaattctgactaatgattgaactaacaaaattatgtgtttttaagtattatgcatgtaatatcannnnnnnnnnnnnnnnnnnnnnnnnnnnnnnnnnnnnnnnnnnnnnnnnnnnnn

SEQ ID NO: 22654 - DNA, 993 bp, Oryza sativa
ctggggcacgtggagacggtcggcgggtccaaaaaacaagggagaaaaaaagggagaaaaaattccatgtcatcgtccatgtggcgtgccacgtagacaagctcacggtcaaacgcggttttggaccgggatgataccataaaccaagtttagggacctcgacgtgcactttggaagttcgtggacttaagtgaaacctcccgacaagtttaaggaccgctggtgtattttactctttgaagtataatgctagagagcatgtaaaaaagctaatacatcttatatattagaatggagggagtatatatgtatgtggctggaatatttcccctttatgatctatgcattatgtggcaaatgtcattataattgattgttagttttgattcccagccaagggtatgtcatacttcttctgtccttaacaatacacaggctcttaacatggtctgctgctgggtggaagatccaaattcagattcattcaagcggcatcttgcaaggatacctgatttcctgtggctttcagaagatggcatgaaggcacaggttattattaacttttgcatcttttatgcataattaagggactaattccgtgtggaagtgaggctaacatgatcaatctgtttcctgctggtactactctaagttggaaaaatatgtttcatctagaaaaattaaattgtcctataatcctattactccctctagtaaataataattgacattgggagtactaatcctaatactgccaatgtcaaatattttagcggctaaagtacaatctagtgttggtatctatctatctatctattatatactaaaagaaaaagtacgaattacccccccgaactatcacggtcgtccgaattacccccctaaccacaaaaccggacattcttcacccctagctatacaaactggacgaattacccccctcgatccaattcgtggtggttttggtctacgtggcgtacgcctggcagtcca

SEQ ID NO: 22655 - DNA, 712 bp, Oryza sativa
ggtggaatcacgacatgcacctcaaggaatcgtgataaacaagcaaaaagaagatgaggaagtatgcttgctgaaaaaggcactcagccaggctacttgcatcgtgaatgtaagtctccttattcacagcttcaactatcctgtttcccactttgctcaaatgccgacaaattcgcattgcagagaatccatctcaggaacgaggcgaagaccgcgactcttgagaagttagttcctcatcttggaacccttgaagccaccagaaaccagctgcacgaggcaaaggagcttgccaggaaaactgagtatgatctgagggatcggatcgccgagcttcaagaatccagctttgaactgagcggttcgtcaaaaggtaaatacaatctctgtctaacttacttatgctgccatccttgtaatttcaattaacaagaagcaatacagtgcaagccgccaagatatctgaactagaaaagcagatccaaactctggagaacgacaaggctgaattggcgagacagaggaactcggctctgaaagatgttgaaggtactggtgactaatacctcttatctttatgaccactccgtgatataaatccatttatgcagatcgcaaaatcaagtctcaggctcaattcaatatcttggtcaataaaaatcaaaccgcttgaaggggctagggatgaaatcgccaacactgctaccccact

SEQ ID NO: 22656 - DNA, 574 bp, Oryza sativa
gcgaatattttttttacctttgttggtcagaaaattgtaattgaacacaagattttatagatttcactgaccaaattgtcatcttaggataacctataaaattttgttctccattcgtaattgtttgttagttatatattgccaacatgtgccttgcacgtgcacgataactagtttcacactacaattgttgagtatagatagattttatttgcatcaatgggcctacattgatagttcaagatgaaataatgagtaattaaaaaaattactcaggacatttgtcataaacacctataaaaaaatgtattgtttaaaaatatatcacatttttttctcgcaaaaaaaagtcaggattttagccgttaatgactcaatctatgcttttgattgtgacatattttttaagtgtataagtaataaatgtaaggttgatttctaaagtacttattggattggtctcccaaccattaaactgttggtggtttacaaatactttctatacatatatatatatatatatatatatatatatatatatatatatatatatatatatatatatatatatatg

SEQ ID NO: 22657 - DNA, 1112 bp, Oryza sativa
  unsure (1)..(1112): unsure at all n locations
nnnnnnnnnnnnnnnnnnnnnnnnnnnnnnnnnnnnnnnnnnnnnnnnnnnnnnntttgtttgttaggaggttggccagctctgtacaatcgagctatttaaagttagggattcaatttggttttgggaatctgatagatatttcccatcttctttgttctctcatcccctttctctgattagggctccctggagcaggaccttttttttaacacacggaagatatacacaacatttcattaataagaaagaagaatttacacacagggaggggagtccggaaactcccgaccctaaacactaacacacattaaaaaactaaaagacactaaacaagtccacttaaagccgcaagggctatcgacctagccaacacctcttagagcttaaaagctcctgctaagcaccaaagagcgccttcatatgctacttattgaagcctcatttgacatatttggaattgaaccattgaaaacacaaccattcttgtgttttcaaatttcccatgccaccaaaattataagcgagtttagccctttctttctttctttttttctttctttgtgggtgtctttcactggcatagaccaccagcttgagaaatggcgtgtgtcatgggttggcgtgagccgtgaggccaatgaaacctaatctgtgaaggaccaatgaccacacccgctggctaaaaatgcaagtgacaaaataagttgcacaatctcctcagcttgatcacaaaaagggcaggcagccgggtgtggcaatcctcgcttggacaggcgattgcccgtccaacggcgattgtttaccgtgaaccacagacgaagtttgcacttcaggggtgacaacttttccaaatcctcctctatggagcaaattaatctgatagtccctgacaaagagaatctcatatgctgatttgctagagtataaacgaaatcctgatgacctccaacggtgctgatccagtggatcatgttgttgcaagtttaccccaagcacaataaatcccagannnnnnnnnnnnnnnnnnnnnnnnnnnnnnnnnnnnnnnntatatatgtgatccatgtttgactatccaatgcttgagccactgtatgtcgtttacaacc

SEQ ID NO: 22658 - DNA, 677 bp, Oryza sativa
tcacaatctaactcagcacctataaaacaagtcttagtaggatcagagggatctagagaaattttcttggtcttggcgtcgctttctccgctctttggcatcttggttgcaggcacttctctttcgcttgctgtgaacgtggccagtcgaacttcttctcgggcgagggtgatctcgtgggtctgggccatctcgcagctttccttgtcgcatgtgacggcttgtttgatgtcgctccgcagggatatgactcctcgaggaccaggcatcttcatcatcatgtaggtatagtgcgggacagccataaacttggctaacgccgggcgtccgagtatagcatgatatggtgtctcgaaatcagcaacttcgaagcaaacgttttctatgcggaaattctcccgagtgccgaaagtgaccggaagagtgatctggccgagtggtgtagcagatagccttgggatgactctgtgaaagggcgtattactcggttttaattccgtgcgagggatctgcatgtcgtcaagagtcttggcgaaaaggatgttgagtgccctccaccatcgatgagggatccgcgaagcttgacgttacgaaccattgggtctagtaccagggggtaccgccccgggtggaccaatcggtcaggatgatccgagcggtcaaacttgattgttgtc

SEQ ID NO: 22659 - DNA, 328 bp, Oryza sativa
cgagctcggtaccctggttcattcctggtttggagatagaactgtgcagccgggatggttgttcagaatggttgggcctatacaacagggtatgttgtatagcgttggattaatattgtttaattacttaactgtttttttaaattctaaaatatttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacagtgaagctgatggtgtggaggattaggtgtagcc

SEQ ID NO: 22660 - DNA, 576 bp, Oryza sativa
  unsure (1)..(576): unsure at all n locations
cgagctcggtacccatgcatttttaattcgagatgtgcactagcaaggaagaaatctttcatccagtgattcttgatatttaagttgttcaaaatgtcactgctagtgcagagagattgtaactctaaccaagcactccagttccaagggtagctgttgacagattccaccagaactgttctagctagagcttcactgcctttatcacgtagaacaatgccatacaagtacaaacaaaatgaatcaatagcaccagttctccgatgtgttgcgagctctctctccaatgcaactagttcctgattaacagcattgcttttgcccagagatccctcaagctcgactgtttcttcctctttccgtttctctccagcctaaattgtagagaaaagaactatgatcaccaagcatgtcaaatttcaaaatgctaattaaactatgaagcaaatgggagacagtttctagtatttagaagattagataacctgtagaggaaaagataaatcatttaatagaatccttccatggataagaannnnnnnnnnnnnnnnnnnnnnnnnnnnnnnnnnnnnnnnn

SEQ ID NO: 22661 - DNA, 727 bp, Oryza sativa
tttcgtcgacaaccgagtacataacatctaactcatctgcacaaggagctttatagcaaagatcatatgcaatagcaggttgttaaattagcaaactgctaaaacttttgcgtagatttagcatggctagtcgcacatgtcccacaaaaccacgtgagtttccgtcagcatgggctgcaagtgggttacgatctcttttttccggtgctaccacctagcgataaatcaactgctcgtatttctctctcttcttctctcaatcttctacctagaattgaggtaatgtggatcaatttatcacccgctgactcatctttattgtatctgctattaaacttctcgaatgaaattggataaaattctggatactcgtggcacgtttttaaaccgctaaacggtgcgtttcgtgaaaaaaaaattcctatatgaaagtggttctaaaacgtcaaattaatttgtttttcaagtttgtaataattaaaacttaattaatcatacattaataccaccttattttacgtaaaacacttaatctttatcttcaggagaaaataacaccacccgagggcatgcctttacattttcagcagcacttaaaacaaaatataccatcgatgcaaccattatatatttaaaaataaatctatttgattttatatggtttgaggagaaatagttgattcggtaagcctattgcctaattgcacaaacgacgacgagcagcagc

SEQ ID NO: 22662 - DNA, 962 bp, Oryza sativa
tttttatctgaactacttctgttttcaactggttttcatgaaaattgaaaacaactccagagcagttttcgatcagctaatgattttgtgaactccacatcaaaccgatactattagttcatatatctaaagaagttcaaagtattgctgccaatattaagtaatttttctattgcaataagaaataaaaagtttatcaacatgtgcaagtagattttgaatagatagatcttcatgaaacgtcagtatatgtcaccaatagggcgatcggcatgaaaccaacgagtattactcacaacggtttataactaataaaacgatcaaagagtcccattggttgtcctaataaactaaaaccaaagcaaaattttaaattttcaaacttaattttgaagtttattttaagatattttcaacgtggtatctttttcagcgttggtttttaagtcgttaaaaacacatatataaaatttttacctacaaattaataattattctctaataagctgttttgacttattattactactattataaaaactgaagatgtttttggcggtatttgagtatgtcatccgtgtatgagtcaagttcgtaagattaaaataaacttcacttgttacaaccgcatgaatattttttttagttaagtaatatatgggcaaccgatgaggagccaaatatatctcttaagatattaaggtgaaaaactagtactccttaccaaacatgcaaggtgcaggtgcaagcaaaggtgattttaccaaccttctggttggaccgatcgttggctgttcgcgcttcccttgctgatgaggccgaacagtttttccccccgcgaggtcgcggactcgcgacagcccgtcgtcccggcccgccccggcgcaggtgattgacaaatgggtcccacacggacatcctaccccacctggcaccatctaacggacgaatcccccctccca

SEQ ID NO: 22663 - DNA, 373 bp, Oryza sativa
  unsure (1)..(373): unsure at all n locations
nnnnnnnnnnnnnnnnnnnnnnnnnnnnnnnnnnnnnnnnnntccctcccttcctcccctcccgtcccgcatgtgttgtgtgatgtgtctcgtctccgccaccaccgccgtcccggtccaaccgcgaggcgcgatagaaataggataccttccacttcccggccccgccgccgttcctgcccctaaccgccgctgccaatttcaacggggcagaatcaccgatttgccgtcacgtccacactccaccacagcgcgtactgcgcactactgggctacctacctgctccgcgaccccaacctccaaaagcaaaaggcaaaaaggccagggcaatcaacagagtgaagctggactgtaagccatcacagggtaccg

SEQ ID NO: 22664 - DNA, 1252 bp, Oryza sativa
ctgcccttcatccaaactgtatcaagataatccttctatggctcaaactacatgggttctcttcccctattgaacctggggttaattggatccatgccattgcaaatttgcctattcagaaaaaaaccattacaattcgtctatttatagccgtgccattgaaattttacaaaattagaaccgtgacactgccgtcatgttttccatccatctcctttcttttccgtcttcttccttctttctcccgtcttcttctctatgagcaggagcagattttttcgcaaacaggaggagatgctttctgtgaaaacaaattacattcgcaagctgaattacagaggaacggacttgtttgttctgctgatcaggcagccttgggcagccggatagttgtggccgccgacggcagtgacggcctggccgccggcggggacagggatgggcacgacgccatgcgtgagcatggactggtagatctctacgagcaccttctcgccgtactccttgagctgccgcggccgcacgaaggaatactggcccgcggtgcagtagggcgtgccggcgacgacgccagccacagcatggccgagacgtaggcgtcgtggaggagcacgagccactgcagcgacgacagcacggggagcaccctcctccctagggctgtgctgcacgtgccacccatggctccgcgtgtggcgagggccctcctgctgctactgcgtcggcgcgacgctgtgacgcactcctccgagctccgcaatggggagcgtcgctggcggcggcggcgtcgaggcggtagtagccggcgatctgggttccttggtttgctctcttcgccggcgatctagagaggagagagaagactggataaagaagatgaaaaatcaaggagatggatggaaaacatgacggtagtggcacgattctaattttgtaaaatttcagtggcacggctacgaatagacgaattgtaatggcatttttctgactagacaaatatgcaatggcatgccatggatccaattaacccttgaatctgtgccttacctgaatctcgagttggcaaggttggcatctcccttcacctttttttttttcaatgggattctaaggttatataagcattttgcatgtgttttattgtattgtttatccaatttctcgttccattctactcataagatagattcttgcagtatttcatcataaaaactaatgtcttgatgtgcaaagctggatctacatgaattca

SEQ ID NO: 22665 - DNA, 257 bp, Oryza sativa
gaagggctcagatcctctgagcttcaagtttgtcgaacatcataaggcatcattttcttttcttttctttcttcattttaccttcatgttattatatctgagcatgatcttccgatttccgcagacacaagcatttacttttatatcgtcacatgacgaaagtgtctggaacttggacggagaacttcttcaggcctgtgaggtatctgttcaagctttccgaggccttgtcaacctctttgcgtcaggacccgagg

SEQ ID NO: 22666 - DNA, 766 bp, Oryza sativa
  unsure (1)..(766): unsure at all n locations
tttgtcgcatttgatccttcctttgttaattgctataccatgtccccttgtaaccacccagttgcgcctcgatactcgtgcactctgtgcaagtatcgacggtcgccttcaaacttaaaatctgagtaacaacttgggtaaaactggagttttacaaaagacttggaaaacccgacacctgggtcggtgcttgcgaactaaatggattttccaaagccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtcccccggcgtggctgatccccacgggctgggtgacccgggttagtaatgtcatgtgggtaaagtgtaccccctctgcagaggttaacaaactgttcgaacagccgtgcccacggacatgggcggatgtgaggtgattcctagcgtagttttgtttgtctactgcttgtgaaatnnnnnnnnnnnnnnnnnnnnnnnnnnnnnnnnnnnnnnnnnnnnnnnnnnnnnnnn

SEQ ID NO: 22667 - DNA, 19513 bp, Oryza sativa
gaattgaactcgacgatagatcgggaattgagatcttgagatggcacggacactagacaacaatcaaagaaacaaatttcgcaattagggtttttcggagataattttcccgctaggcgccacgacggaacgggcgctacaggatccatgttaaaaattcccacaattaccacgttctacgctgactgcatgtgccaactgctaccggcaacaaataattcttttctcagttgagttcaactacagtttagacttcgatttttcctctgacatgtgccacagtaaagtatatcaatctcatcgtttggctgtcacaaacggaaaataatttgtgaataaaacttttatatacgtgttcttattgatgtaaaagtaaaaactgaaaaataaactttgataaaaaaacctaaaatcagttttaaatttaaaattaaaaatttaaattttggttgataagtataaggataagcgacaaggcaaggcagtatattccgttctcatttttcatagaatcgattgtagactcactggagcagctattagaaaatgcagctagcttatcaacgggcaccagcaccaccaccttagtcctgccgtcgctatccgcccgtggctggcgccgtaagctgtatcagccacccaagaggcaggcaggaaatatggattatggaataagcgtggaaacgagagtaaccccgaaggcgactgatcggcgatcggtcgatcgatcgggcgagaggaggagagagaccggttgtccattgtggtttctgtcgcgacgaagcatccaagaaagagggagataggcatcgatcatccatcggcatgcgtccgcacgaggtcgtccggcccccatgcccgcgacctcacgctcaatttttcctccacgaatggtcagcacaacacgtgaggatttgtcgaaaagtctatccagaaccctttttttttcattttccttcgtttattgatcggatggatagcgacagcagtttgttcttcctcctctggtcataactcattaatctctctatataggttttggtttgatcattcgttggatccagggggcaggttcagtgcacccagagaatggttgggcccaggcgcagctgggaatccgtttcggtgtccagacggggcaacgcaaaggcaaacatcttcttctgtctttctttctcctttccttttttttttttttaagaaaggaacatctgaactcttcataaactgacaaagttcttcttcgcaattcatccattcagatactattagcgtagtgcaatcaatcgatattgaggtgcaattcgaagttctcaaaaaaaaaaaggtgcaatttgaattactagtaggtgctgagatgcaatgtcaacccctctgaacgtacgacgttgtaaacttctaaactttaatggagaagagcagcgatgacgatctctctctagaagagtccacacctcaagttttactggtggtattaactggcaactggcaagcaggtagtagtactattcaatgacaacgatgctgtcgcgtgtaaatccacgtggcatggtaattttccatgaaatggtagtttgagcatgtggggaagcgtacgagctcaaatcaaattaggaaatcaccctgaagtttcacctgtcgcccctccctctcgattgcgactagattgccgctggtttttcttcaaccgtggagcattgacgggtggagtccggcgagtcatagacgaagaattgaatcactttagattcggtaatctaaagtgaaacaaattcgctttcttgccctctctcgcgtggcggtgtgtcaaacctggaaagtccagtggaaagaatttcgtgcgtgcacacattttaatcgcgttcgtatatgttctgtgagaatagtttcgtccgtcttgttttctcctgcgtcacaattgtcccgtattatctcatacttcatcagtgaataatttcatgagtattgttgactgtagtatatacattagacagggtataagctactaaagaggtgccccgtacgagaaaatctaaaactaattaacacttaactcaaaagctataaaatcatttgtcatgtagttagatgctgacgtttaggctacagtgttgcacccaatccaatcgcaaaacaatttagaaaccattaattaaatcacgtgggggataataacgcaggaaagttcaacgaaaccagaagcgagacgacaaaagacgacgcactcccactctactatatattctggcgcgaacccgactccctccacaattccgctagtccgagtcaaaacaaaatcaaattcaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggctaggccgtggcggtggcgtcaagggggaagcactaccgcggggtgaggcagcgcccgtggggcaagttcgcggcggagatcagggacccggccaagaacggcgcgcgcgtgtggctcggcacgttcgactccgccgaggaggccgccgtggcgtcggaccgcgccgcctaccgcatgcgcggctcccgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaatagaagaagttcatgaacagagcaatgcactgctccaagaaatgtgacgagttccaggcaatcacgccattgttcttggatgattgcgcagcaccagaaaaaagggaaaaaaaagattgtttgtgaaatgtggtgaggttttgtaagacttgcacaaaatttgagaaaaagaaaaagatcaatacatataaaatcttactagaaaaaagactttctcaaaccgtttctagaagggagaatactctttggtctttggtataacagtcgcacaatcggacattcctttcaaactatagcaggttgctgttttatcgtttagcgaacgtcagatctcattaggctgcgttagagtgagcgagggtgaaacggaaaaaattttcattcttttttcgttttgtggatcttcttctcttttcacttccattcaaacacaccctaatttcaaccatactatgcaaattttattttgaatcaccatttattatatttcaccttctgttattttttaaccaatgttttcaccaaagactagataaatttgtcctttttcactttggactatccaattctcttttaagcatgtgaacgatctcgtcaattcttactcgtcaatgaacttttacaactatatgtaaaatcatttatttagcatatgacaaattgaatgaaataaataaaagaattaaaggtggtctaaaatatcgtatagataaaaaataactgatttaaagtgaaaacatttattaaagggtgatagaaagcgaaacatcaataataaaaagtgatcaaagtaaagtttactcttaattgcaaagagaaggcgcaacaaattctaaatgagacaattgcgaatctccatcatgatgtaacaaacattacatatatcaaaggttgcaaatgaattgtcagttgcaataattaattactaccaagtgagattcagtccaggcttactggggaagtaggtgctagaagttcagagcgttcatctcactggtgcattgatgcaaaaattaaatttatgaaaccatgtttgaccgaaatggaagatagcttgtttgactgataaaccatgggatgagagaggagaggaggtacccattgaaactgaagattttgttggggtcaacagatggagacctgaacctgaacaacaaaatcaaatcgaattagctaatcctacatgtcatagcccttaattaagttaattgcaaaacggtcggcacgtgcaatactggcacgcactagcggattaaccattttttttgaacgcagcgaattaactaatcacccagttgctgactaaaagccgtcgttcggtgcgatctggatggttggtggagcaagagggcaagttgatgagcacaaaggactgaagatattctttgtaattacgccgtataaaatatgattgacaagaaagcggccaaatgcaaggtgtttaaagaactagcccttgtgcttatccatgataatggagtgtcattaacagtttgatgtaataggattgcgtggatttgatcccagtcgtaatcaggtgtcgggcaatatgcccactgcccataacaagttcaaggtgtcgagtaggaacggattaattctctggcttaactgtatgtcagttgcagttgagtaggatctcccttggtgtcgagtagtattgtagtaagacatttttctttgagaaaattttaaaaaataccattaactaatactcaaatccaaaaaatgctatcgatgaatgcgagtttcataaaatgtcatcgcaagaacgattctctcataaataccatcgatgttagggtttcattcatcacacgccgttcaatgtattgttcatcctatagtacttaatgaatgtctgctaaaggagctctaacgacgattgcatttctgggacaaagttacttgtattttgatatttcatgaaactcgtacttattaatagcattttttttaaattaaacgtttgttaatgttattttttggattttttttctttttctttcaccggctacttatgagtttcatagtgctagtgcaatatgactctcacctaaaatcatgcactaacctggtgatgaaaaattgccgaaaaacaatgtatatttatactcggataaacatttagaggccgggtttggatactttgccccacaaacgtgtagaggccgggtttgataatcctttatctaaaaaaaattatactcggataaacagggaaaatgctttggatactttgccccttctcttaagcaagagggtgcagttgcacattggatttggatctcttccaaatttccaagttcacaacagagattactctcgccatcaacctagctagccggtcttagctagttggtgacgcatcaaagtgatggcgacaagtgatgaccagtccatggtggtgcgcacgtgcggggagccgaggccgaggagcaattgattggatatactccctccgtcttaaaaaaaaaaaagcaaactctggatttctgtgtccaactttgactgtccgttttatataaaatttttttataattagtatttttattgttgttagatgataaaccataattaatattttatgcgtgacttgtctttttaatttttttataattttttcaaataagacggacggtcaaacgttagacacgaaaatcagggtttgtctttttcttttttttttgacggagggagtactgatgatcacgaccattgacgggtgctctttgtcatgaggccagccagtaggatccagacacgtggataccctacactcccgtcttgttcccaactagagagaaccaaccggggcaaagaagcaggcagcaatttcaccaaacgttccaaacccaaatcgatcaccaaacgcccaaacccttgtgggcttgttgctgcgctgcacgaggtgttggcttgtttgccgcgcttgggttggtttgtgaattgtgatgattttgcggcttaatgcttctggaaaaagaagcttttccaggtccatttcagtttcagcggtggcatggctagctagctttccagggcagcaaaccgcaaatacggagtagaactgtagaagtgagtaggcgtaatccgtggccagcaatatccgagtcagccgcgcgtaatgagtgcgtggcagggcgcaggacacgcacagcaggcagatcgacgagggtcgaaaaaggacaagtcaagaagcaccagagtgactgggtataaactggatctaaaaaggttgagatgaaatttaatactccctccatcccaaaatataaatattattagcatagttacaatttaaacatttataactttaatcattaatagaaaaaaataaaaaatatcaaacatgtaaaattgatttacattgatgttactagatttatcattaaacaaactatcataatatgtaactctttttatttaaaacatattatttttatagatattgttggtcaaagtagcatctcgtagaccgtgtcagggtataaaaatacttatatttttggacggagggaataggtttttgagctaaaaatatttgagagctaaggtgatttgtgaaagggctcataggctctaaccagttggatggtgtcaaaacttatatatatgtaaaaaaaaagtttgctaattggaagtgattttactttctttttgaaacataaacattcatcaataatgacagatttagtggacaagccctagttgtcagagttagctcctttcaaggtgaaaggtatatatgggcatgtttgaattgaggtcaattgacctaccaatttatttgtttgttttgaattgtacttgctagctatttggattgagaccaaatcttgctaattcagtaaagttgaaaattttggtagtaccaaattttgtctaagtttcaaacactacaaaattttaacaggacttcaaaccaaaacaaacctatatgggctgatgggcttttgattcagaatcgcgaagcgactggtgtagtttagaattttagacaacacatcacacagcgttggatgggagagatatgtttaggaccagagagtatttcacgattcttgagaagaatatgaaaaaacatcttcaccatctccccaaatagaactgagtacgcgaccatcacctagcaggctagcacgatttagaaccatcttcatttagagaactttttataagttatttgctcgctttctattaatccatatgagctactttattttgtctatattcttttttttaatggaaaacatcacagtagtgccttttcattgaatagagcagaagaaaatacaacccctaagggtaaagaaaagaaactttgagctacacactatacaatgtgcgggacgagttcacgcaatcttttagcccccgctagagcccatagactagcctcctccttgattcgtgttagaagaaagcctattgccgcctctttgtggtcgaagatctgccagttcctctccttccagatttctcagacgactagcaggatgagaaatcggaggcccttttttggacgtcgggtgtatttgccaagctctcccaccattggtggactgaccggggttcctcccactcagtcggctccaattgttgatagcccatccaagtagcaactaggtgccaaattctctttctgtatctgcacttgaagacgaggtgcagtcccgtctcagcttcagaacggcagagagggcaatgtccatttttttgccagcctcttgttgcaagccggtcagatgtctagactctattttggataataagccatgcatgaaatttatatttccccggcgcccagactttccagatcagggagtttagacttgagtttggcacccctaaacactgtgcatgataggccgaggaagctgtgtagtgcccattacttgtgaatctccaggcaatctggtccggttcttcactgtctagttgcacattccgaaccgcttcccacaaacggaccagttgctcgacgaggttgattgtgataggcgaggccgcatcgagggtcaggtcattcacctaggcgtcaccctctttcccttggcgcagggattttcttctatttttggagatcccatagacaagtggcatgagatcttttggtctttgcccatcaatccatgcagagtcctagaagcgtgccgtattcctatctccgacggttatctttgtcgaagcagcaaaaaagtccttgtctaatccatcacaaggcatctccagtcccacccacggtttggttgggtccttccattaatatcataacaatcgcaatctcaaggcccttgtgaacttgtccaagtttaggactcccaagccccccccccccggctgatcggcaggcccgtctttgtccaattgactttacatcccccccccaatcgtcaagttagaacatgctattatttcacaaatggacctcaggttggtgcgcaccaacatcgacatataatgtgttggaaataaggagacttgtatggacctgtaacgcacatatgataactttagccatctgcgttgctaatgtataactctatagaggttgatgctagagctattggtgttaacttcttgtacgttgatgccacctttaggtttatgaaaactaaatatgtagatttatgctgctgtgttctgttgtcgacctcttccctatatgcaggccaatcaccataatagctacactaccaagaaggttgacactaacgatttataggtagactctctggttttgatgtcaatgtgaggtccaaacttggaatatattttgtagaattactttttgcaaaggaccaagatgcaaaaatgtcgctcaattcagcaacaatcaaactctactaaagacaagcgtcggtcgtgctcacgtacgcacaacccactaacccatcttcttcctcgctcatccatttcctcggaccaactcggcacggcattatcctctgcgctccgaaccacattaatcacctaccatggattcaggggcgaagccactttgggcggcctgggtgcccaggcaccccccagattcctaaaatttcttagagatgaacaaattttggccctttaggcacccctacagcccaataggaggcacccccaccagaccttgaatcccacgatgccacttattcagcccacgacgcatcagctgcccaactctttttctcctcacgacgacttcgcgagacgcgccgtatacgccgacgcagcgacgcatcgactgcctgcccttcctcccgactcccgagtcgcgacgccgacgcccggagcgagccgctgcccacgaagacaggactgcacgaagacgaagccgctgcccacgaagacgcatcagctgcgcgtgcgacgatcgtggctgcctgcctgcctgcctgcctcgccggcgttcgacttcgacgatcgacgttcatctgatcatctcgccgatctcgtcctcgtcagcgtcaaagactcaaagagccgctgcctgctgctcgactaactagagtgagtgttcgtcctctgtcctcaaggatcatctcgccgatctcgtcctcaattaattttttctcttttgtgaactgcaatttatttatacaaaataatgaattataggtagccatggagaggttttataaacctaaacggaaagctcaagatatgatcgatggtaacggaacttcatgtccggaagagatcaattgggatgaggagattaaatatgatcccggattgaggaaagaaattgatgcttaccatcctaaccacagagaaaaggtgagaagaaaatacttggagaatggaccttgtcagcctcgcacatttgattttcctattacacaacttggggggaaagagaaacctagaagatttaatccagaatggtttgatgagttctcttggcttgaatacagtaaggaaaaggatagagcatattgcttttattgtttcttgtttagagaaaagaaagatccaggatatgatgcatttgttgtcaacggttggaatgggtatcataggaaagaaaggctaagatcacatgttggtgaggttggtggtttacactataatgcaatgaagaaatgtgatgctttgagaaatagaaagcaacacatagatgttgcttataatcagataagtgaagttgctaagaaggcctattttattcggttgaatggttccattgatacagctagagtattgttgaagcaaggattgccttttcgtggccatgatgagtcaaaagaatcctacaatagagggaattttaaggagttctatgattgcttagcagaacatgatccaattttacacaaagccgtgactacaaatgctgcaaagaatagttgtttgtatgctcctgaaattcagagggacattgctgaatgttttgcaaatgagattgtacagtctatcctggatgatcttggggatgatttcttttgcttgctagttgatgagtcaagagatgtttcttgcaaagaacaaatggctgtggtcttgaggtatgttgacaaatttgggatggtgaaagagagcttcgttggccttgtccatgtgactgaaacaagttctgcccacctcaagtcagccattgattctcttcttgcaaagtttaaactaagtttaaagcaatgtcgaggccaaggatatgatggtgctagcaacatgcgaggtgagttcaatgggttgcagtcattgatcatgagagatagcaaatcagcttattatgtgcattgctttgctcatcaacttcaattagttattgtggcaaccgtgagaaaacataagggcgttagcaattttttaaatatgatttctatcttattaaatgtggtgggtgggtcagctaagagaagggacatgattagagatatcaatcatgaacaagtgcagcaagcattaggttgtgggcaacttgagaccgggacagggttaaatcaagagcaatgtcttcaaagacctggagatactagatggagttctcattataaaactctgaaaagtttgcttaatatgttccctacaatagttcaagtgctcaaggttgttgagaaggatgacagagattggaaaaatagagatcaagcatcaaatcttttggtatacttccaatcttttgactttgtattttatttgcacctcatgttgactacattagctgccacaaatacattgtcgcaagcattgcaacgcaaggatcaagacattgtaaatgccattggatgtctgaaatcaactaaactccatttggatgatcttagaacaaatggttgggaaaagttattagatgatgtgaatcagttttgtgacttgtatgaaattgatatgatggaaatggaaagtacatatgttgatcccagacaacctaggaaaaaatcaggaattacaaacaagcatcactatgcagtggattgctttaatgatgttattgattggttggttcaagagcttgatagccgttttagtgagacaaccactcaattgcttgtttgctcagccgctttcaacccaagagactcatttcatgctttcgatggagagacttttatgagcttagcaaaactatatcctgatgatttcaacaatgatgatctgagggaccttagacatgaccttcgcctttacattggtgatgtgagagaagacaacgaattctccaacataaacactattgctgagctatctcaaaagatggtacagacaggaaaacatcaagtgtatagattggtctatcgacttttgaagcttgtgctagtattgcctgtcgctacagcaacagttgagagatgtttttcgggcatgaagattgtaaaaacaagcttggctaatcgtatgggtgatcaacaattgagtcatagacttatttgctatatagagaaagaggaaatgaaaaaagttagcaatgaggctgtggttcatcgtttcatgaccatggaaggaaaagggcgcaaatatgatctctaagaagtaacacaaatgcaatgcacctactttcgattgataattgtacatttttttttgctaaatgattgacctatttgttctctttttttaggatccatcacatattttgttataagggacatctttgtgcaccacaatcatcaatggtgtattcttttattaatagtgagtattattgtccattcccctactagtttactaatattttcacgaaagtcactttgccattactgaaagtttaattttgatgttaaaaattatgtgttagctatactatttgcttgaacatcacaaaagacattatagtcttgataaagttaggcaccccccacccatttgctctagcttcgccactgcatggatttgcttcgtgtctcagtaaacaccaaccgccacgcacccacaccaagtcaccaactcctcctcggtcctcgccttttctcctcctggcgaaagagctgccttatctagcttccacttccctcgtcgtcattcgtcaacccggccgaccagaagcattccagaagctaattgagcaagcagtgatagagaacaaaacagcggcaaaagattgcaaaaaatcgctttagaaacatagcattaccgcgataattcatccgtgtgtgtgtggattcaaatgccagcctttgtgaaaggtgcggcgccacgcaattcaagcctttttttcacaaagcagacgcactgagacgcgaaagccgggggacagaaggggaacagtggaaggtgacaccgggacacgtacgcaggtccgcgggagctagggataagcgtcgccgtgtttctgtacgtacgtacgtagatccttcgcgcgggtgagtcagtcggtcgatcggtgatgagatcctctcctttttccagttttttctcgacgagccgagccgacagcccacgattcagttcgcaaaggtatcagcgattcagcgtcgacgagacgatgactcggcgagcgaggccgacgaccagtgactgcatggagtgtacactgcaaatggaaatcgggctctttactactcctacctatggtcgaatgatttataactggaataaaaactgagttagccacgtggccgcatggaagcaggcatgagttaacggaatccctaaaatgcatgtgtcgcgttctagttcgtatctacgcacctgaatatgcgacatgctccttcctcctccttttcccaccgccctttcctatcattcgatcttcttttgcctttcttttgttcgttctccattgtgctgtgtccataaacaacaacgcgacgcggccattccgacgagagcgccgataccgataagtacgtgccatctttgacgccacactacactacacctagctcgcctaaaacctatacttagcttaattagcttccctcttgctccatcaaatcacctcccatatttagtcccacatcgaccgcgcaactccactccatccgacctaagactcgatcgatcgggagtgtcgcgcttgcttcccacgccggccgacgaacagaaggaaaccggcagtgatatatatatgggcgccgtagcgtcgcgcgggcaggaggacgccgcgcgggtggccgcggggcgggagcacatgaagcggtgcagggagaggcggcggctgatgcgggaggcggtgcggctgcggcgccacctcgcggcctcgcacgccgcgtacctccggtcgctcacccacgccgcgtccgcgctctcccgcttcgcggtcggcgagccgctcccggtgtccgaccacgccccgcccgccgtgatcgtccaccgccccgtcgtcgcgccctccacgccgccgccgctcctccgctccatcgagcagcagcagcagctgcggcggcgcgcgcaggagttggaggaggaggtcggcgctgctgttgatgatcatcttgttggcggcggggccggggtgccgtcggtcacgcgagaggaaggcggcggtgatgaggagctgaggatggtggtgaggcaccgtagcctcgcggaggtcgcggcggggttggaggagtacttcctcaaggccagcgtcgccggcgacgccgtgtcgagccacctcgaggccagcaacgacgagttcaagcgtaagccactagcaactctacttaattcgcacattcacatttactgtacatgtggccactgcctcactggccaatacaaaggtgtgacattatgatcagttgatcacttaaaagtaaacactgacagagagcatgagttgcagagcagaaagttttcttgccactgatcaccaccaaatgaattgattttgttgcaggtggaccgcacagcatcttgggcgcgctttgctgcctgtcggcgccgtcggttgcgcacgaccgcgtcgacagcatcaatggcgagcagaggcatagctccaacttgcagcagctgctggcctgggagaagaagctgtatcgagaggtcaaggtaatgacaaaataccaaaaaacacatggtcgaatcaaaactactagccgtcataccgtacgtattaccgtgcgtgttgtaacttgtatggccagtagagtgatttgacgttgcaatgcaggcgagagagcggctgcaggtccagcacgacaagaagaaggcggagctgagtgaccaggagtacagcaggaagatcgacgtggacgtcctgaagctcaaggccgcgtgggagaaggcgcgcgcgcagctcacgacggcctcgcaggccgtggccgcgacctccgcgtccatcgcggagctccgcgacacgcacctggcgcgccagctgctggggctctgccacgccacgctcgacatgtggagggcgatgcggcagcaccacgaggcgcagggcctgatcgcgcagcagctgcgcgggctcagcagccggacgtccatggaccccacgacggagatccactacgagaccacgcgggcgctcgaggtcgccatgtcgtcatggtgcgccgccctgggccacctggccaagcaccagcgcgactacgtccacgcgctgcacggctggctcaagctgacgctgcaggaggcgccggccgtcgtcgacggcgccgaggcggtggcctcccccgtcgccgccgagctcgccgccttcgtcgagcggtgggggcaggcgctcgaccgcgtgcactgcgccgacgtgctcaagtcgatcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtagttagctacacatagacacagttcattcgtttgagtcggccatctccatttcctttttccattttacttatctatacgaccatacagtatacactatacaccaaagatatactccgtatacacgaaaccctgctaggatgtaggaatgtataaagactaaataaaaatcaaggccctactgagtttttacttttgaccactagatagggcttgggacctttggaaagggggggggggcatacgggttttattttagggaaaattgaaaccatgccattataatttggataagcttgacattgtgatccgttcatcttgcatcgatgtataaaaacgacaaggaaatcatgtataaatcgctctagtaactaagtactccattcaaaaccaaaacaggaagattttaaatctgtgataacctctcgattgacaaaacgtgaatacatcatccaaacacattggtctatgatctaaaacccctgcaaagagcaagcaaactacttttattcaactgtagttcctcatttttcccccttcggtagtatgcctatggaaatgaaaaaggtctaacgctcatttatcttacacaactttcgaaagagccatgacgttgaagttcattgagtcagggttggacgcaattctggctttgatgacttttgcagcatcctgagaagaaatcaaagcaaattaaacttcactcatggttaaatatcaaaagaagaagaagaagaaattagaaaatacaccctaaatccatggatcataagcattccgaatgtaaaaatgctaaaagttaagttcagtgcatatacattttagcttgtgcccccctaagcaaatataatgtataagttccatttgacaaataattacgattattcatttcacaaaaaaaactgcttgcactaaaataagggtagaaatagaatgtacaagaatcatttcaaaacaataggtgataaacaagcaagatacaagaaaaatgcaaaatttgagacctgtaacaaagtatctggtgatgaagggccatgacatattggttgcgattttcgtccatcaagctcataaagttcacctgttgcatgccaaaaaataaaatgttgggaacagattattgatagttgaaactaggatttgttttttgagtaaaggcagtcggatacccaccatcaacacaagagaaacatacaaagtgctcgttcacctcaacattagcctgcaaaggaaagatgattaggatggcagcaacattaaggactatatcatggatatgggcaattagtaacatttcttatcttctcccttttcttttggctaaaggaggttggtccacaagtgcacttatgtggtactgtggtagcatatttggttattcattgtaattgtgatttaaagcaatcctgttataacttataagaacatccctcgtaagttcaattctgcaatatgagcttgtaaaccgagggcaggaagactctagtataatggcatcctaccagcagcatttaccatctcaaggagttattcgaattaaaacagtaagaaattatgatggcaagagataaatttatctaatctactcaacatgatgttgtttaaaactgtattacaaaagtgaacatatagaaaaggggcatgcgagtggttacatcagtgtcgccagccgaagcagcaacggaatgagcatcctccatctcatcatcctcctcaagaaaggcagcacgctgaagacaacaagaactgttcatattaggataacaaaaaagtttattagtgattaacacaatgaatttaacatacagacattacctggactggatccatatcaacagtttgtttataaaatctatcaaaataggatccctcaactgcaaagaagaaagcagacatcagatcttgttacaaataaaaacagtaagaataagactaaacaaattaggtcatacatccatgtttaagccaacaaattaaagggcagcccaataaccataaattgattaagcatgccaaatttctcctagacatgctggttgtctaatatcaatgtccttgtaccattttttcacatcatcgcatcaaagatgtgtacatttcagtaagaaagcaaaatggggaacactatgaagtatcacaaatcaagcaactatattttgctgaagaaggagactgagaagtgaggacagaatagacatggataccttttcttttagaacaacaggcatggatacttgctttttactgttcaagcaaactaacataattggatgaatatgaatcccttgagcaaccttttaaaatatctattggattatttctatctgatagtttttccttatttactactatatagagagcactttaggacagttaatgactcaatattaactaaccggaggtactagctaagcgtggatacaaagctaaagtaattacccagcttgagtttggatgcagcattccctattgcatggataacaccaactgttccgcatgcgttgccaacagtctgctttgtaaagtataccctcttgctcaaatcctgcatatcaaggtattgggttaagaaaatgaagggtatataaagttccaagtaataaataatttaaaatgtgcacatttcaaactggtaaacttcaaattggcatcgtgcattgagtgaaagtagatatccaacatatcatatacgtcaacactcaacccatttaatatgccagatgaaggaaacagaaaccaacaccctaaaaaagggaaagcaggctagtatttctcaattagaatatgaatatggaacaatattaatgaaccaaaaactgaatgcagtacataccataaaagtctcctagtaaaatgaaagctgaaccatagtttcacagtgagtgcaattttttatgcactccctaagaaaaataatggtcaggacaaggaacatgcacaacaatcaggccatcagacaatctatacaatcatcacagttttactataaattctgccacatcttgtatatgtgacaaaatgctttttctgcaaataaaacagcatcttaaccagttgtggaacatctaacttgactcatgactatggtgaagtgactctacatcaggtcatctgcagtagttgtagagtcatactgtacaaattaagatgcagtagttgtagaatcacttgcatgaggattgaacttccacatcaagatataacatgagaattggaactgcagtacatccatagcagcatgtcaattgacaattgatttatagttcaaaaagaaacataaattaggcaattgatctaaaattgattgggcacacagatttaagtgatacagtgtagcatatcatgtttacaaattccaagttacaaaggatagttaagtccattgaccatttgcatgcatcctcattttttttacatagcacagtagttgtatctataagtactgcaagagaatcaatactacagcaaatccattacaaaaatagaaaggaggagaggaccatgtttactgcagagagtagccacacacccaggtgttctgtattgttagtaaaaggctaaaagcacattgatgcaacctataatgtaaaagaaatttcac

SEQ ID NO: 22668 - DNA, 1261 bp, Oryza sativa
  unsure (1)..(1261): unsure at all n locations
nnnnnnnnnnnnnnnnnnnnnnnnnnnnnnnnnntcccatattcatattgatgttaatgaatctagatagatatatatgtctagattcattaacatcaatatgaatgtgggaaatgctagaatgacttacattgtgaaacggagggagtattcaaaaacagccatctctggagttcacttgatggtactgagagaagaaggcactcttgcatttcatgatatagtaatactgaggttcaatgtcctgggtacctcagaactaacacatctagttcagcaaattctacaatagtagattcaactagcaaaatttccagtacagtaatagtgcaatcctgtgtggatagagtgaaatatcacaaatcaaacaagcatacaaattcatacacaacattcagtaaaagagaacaactacttaaaactttacaaacagaggtcaccgaaaccaatatatcactacacaacattaattttacagagtaataaaatgtatgcataaaaaagaaggccaaacaccaatcaaactgtgaaagacctatctgaatcctgatcccgtgcagtaactttaactggaataacaaatccaatccacaaaacagtctaactcaattgctcaaaccgaggacaattccgtaacaaatccgatgcacaatttgtagttcagtgcatgtacaccacaatgtatcaaaccgaggcaagactatcgagcacattggatgcgctatgcggcaaaaacaaaacagatgggtacagccgtaccttgtccccagccgtggaagtggcagcagcgcctgattcctcctcgtcgtcgtcctgatcaccccacgaagcagcattcatcaccctctcgacaccacgtaaatccacaaaaacctcgaagcggaagcagaacgcgagggtgggaacttaccagggaagtgagcgggtagaggaagaggacggcgagcacgggctggggcaccatggcgagcagctcgtcgtcgaggccgtagacgtcgcagaactgcgcctccccctcggcgactcccagcccccacatgaactgcgcgacacgagcggaggcgccaaccccgcgacgaccggtgaggcggtgagtgtggaagaggaggaggaagaagaaaagaagagcgcgcgggaaaccctagcgatggacgcgagggcggcggaggagagagaggcgctcacctggttcatgacgtcggggttggcctcgagagggatccaccgcttccccatcttctcggcacgcggcgaggaggag

SEQ ID NO: 22669 - DNA, 10684 bp, Oryza sativa
tccatccgtccaaaaagaaactcaattcaaaaaagatgtgagaaaaaaaaaatcaattacacagtttacattgcgagataaatcttttagagagaatcacttatatgccactaaaaattgatttgattccttatatgctattgaaaattggttcttcccttatatgccattaatctaaatttgcacaccctatcatgctactcccgtcagttggccgttaattttcaagaaaaaaagacgtatttacccttttgagtatagggcatgcctaacaactcagagagggtaaatatgtcttttttacttgagagttaacggtcaacacatggtcaattgatggtagtggcatgagagggtgtacaaatttggaccaatgatatataagagaatagccaattttcagtggcatataagggatcagaccaatttccagtggcatataagggattatctcaatcttttaagcataattacgccatgatattacaacgtgatgctacagtaaacattttctaatgatttgttttgttattagtctatatttaatacttcaaatgtgtgtcagtatacttcaaagtttttacacccaaataactaagcacacccatagacagaataactgattaaaaaacatgaatttatttatattattgaagtgaattgtacttcttacctacttgtactcacccatcccctacgagtgtgtttgcataatgggaaatgggggtgggattgggattgggaaataaatgaagggttaggattaaatggaagggggagaatgaatagttagaatttaaagatgggtgggaaattatttccttttcccatttgccaaacactacctattcggttaaacaagtgaccaagagtaggagattgcttaataacacatacttaagccagaaaaacataagtatgaaataatatagcggatgttaaatcttataaccgaaccgaacccggggtttaaaaaaacggaaccaatgtctagtccgacgatataattaacttgagaaccaaaggaaaaatgagctaatataattaacttgagaaaaatcatttaaaccaaatgattttctactgaaccaaagtaaaaatgagctggcttgattaaatccccgatgtacaaggtctgtattttttaaaaccctacctaattcttaaatattttcataccagaaatatataaaaagtgagcacatggcaaaaaagttgggcccgttactacctttactgcatacatgcatgcgcgcctgactatttgggctagtcgctacaatagttttagaaacgaaacaaatatatttttatgtgttgattaaatcaaaattctcaataaaatacactagtactcaacgttacttattttattgaaccggtcggattcaccggttggaacacaggtcgggttcagagtggcaatcagtaggtcgtcccagggccagcgccgatccccatccgtcccgcgagcaagcagaggcggcgccgtcgctcgtcctgctgcttccgccgcatcctccgccaccgccgcctgggccgatcccccaaccgtcccgcgagcgagcgagcgagcgagcaggggcgccgtcgttcgtcctgcttcttccgccgcttcctggttagcacatcctctttcccatctctctctacccaagcactctttatatatatatatatatatcgaatttgcgttaaccctagcttctgttctagaaatttgccttaaccttcacactaataacagtttgtttgttcccaaaaagtttgggggttcatctgaatccccatgtcccatgttagatccgcccatgttgccgcctgctgcgtgttgggaacctgctaggttaattgttcactaacagctagtagtagcatgaaaacactctcgtgcttccctgttgctaagcgatcttcttgactcaataagagagagtcatgtcttgattgctagggcatgtctggttgtttgctgattcgggctatagctcgccgaggtaaaccgaagcgaacctttccttggaaagctatttggttggtttgctttgcacactagcttttcactcggttttgcataaaacttgtgcgagagacgagcttgccatcaaaggcgagccaaatgggctctcctgcgcgagccagttttttcttgcgcgatatggcttgatttttttactgctaccaaatgcctctcctcactgggcaaggcttagatccaaacgagcacgtgctgtcttgtaccatattgttcaagtagccatgcactgaagtctgttggtaccctggtagaggtgaccagactgtggagaggggtcaatatttagaaatgaatttatttggtgctaaacttacccaaaaatagatgcccttttacaatacattcaatcaaaccttaaaaaccttgtccaccaataatacccaaaaatagatttgttatgcgaaaactgcatatgattaaaaaacaattgttccttaaactgcatttgcacacctgtgtgctttgagttggtctcttgttttctttgctttttaaaacttgatgtccattttacttgcaggttgctgttcctatggacttcacatatcatatcttttgaatattgtgatcaccccattttcttgttgagggtacatgaataatctccatttttgcatttcaggtactttaccccagaatagcagtgatgtgtcaaaatctatagttggtcaggtgcaagcagaagagcaggaaggaaatggccaggcaaaccaacaagcagtgcagcaacatatgattttagcaggccagttgtctcagccaaaatcgttaactgaaggtttggaaaataatgtctacccaattaacggaacacgatcaccagccagaacaagaaccaccacattctgaaaaccatctgaaacaggcagagccaaacagcttccagttcgctgaaaaggaaacaggctatgctggtctacagaatttcacaggccccaaggtggatgtgggtcagacttcaggagagcagcagcatgtaaaacagatggtcggtcagcaagcaccacctggtgcacaggacgcaaggaagcggggataccaaccgtctataccatttaatatgttgattccaatcctacaggctcatcttgacagagacaaggatatgcagcttcaaactgtgtgggcaaaacttagggtgcgcttttgtctcactcctctgttgttagctgctgtttttcatcaatttgattggctagggaaactacacagccttgttgaggcgaagtggggagcaaagttaacctgcttcgcacatctattaatttgttcaaagttatatatcctctatgttgttaatatcgttgttagacttctaaaatttgttgctaaaattaggacttagggcgtgtttggtttgtggccgaacccaaccaagccaaaagaaagacatctatttggtttgtggccaaaaaattggcattgccaaattatttcgcttagtacactacataaatgcaactttggtagtaaaccaaacaaaagcctagccaattattgccatttttaatccatttgaataaaagaggcgcctgggatctttttttttctttttttttttggggggggggagggtgagataaatgaatgctagcaaagatgcctcatcatttaaaatggagtttgcaccatttccactgaaatgaaactaactcagctgtaccattctatgtttgtagcgtaatgaagttcataaagatgatttcttgagagttatcaggaacatcgttggagatcaaatgctaaagcaagcagcccataaagtttttgcacaggtgaacggattgtgttaacttcattgctgccatttgtttccctgataactgtttaataaatatcaatcaagtttgatgaaagtgaagtcactcttaattgtcatgttggacgagagatcactgagtaggaaatatctttatttaatttgttttcagatgcaagcccaggcacagagaagtggccaggcaaatgcaaatcagcaggctaatgcaaatcagtattctttacaatcccaagtatcttccagcggttcagctcaattacatgatcagcaagttcacgtgtccaccacacctaatcagggccaaaaaaaccaagcattgtcttcatcccaaacctttgtgcaatctggcactcaggtgcagagcagtatgactgctcatgataattccatccaacggccagatgcaaagggaatgcatgttacgccgaaccgacctcctgttatgaactcagcaatttctgcacaaacaatgaacaaacagcagcaacccacacaagtccagcaagcctcacagcaaatatatggaacaactaatcgccctgaccagccatacactaggccaatcggtggttcaacacctcttagctcactgagttcagaatcagaaataaggccttcctctcatcctgcaaaaatggagattcttccttctcatccaatgacacaacaaaatgcagctgcgcagcaaatgcaacagaacaaggatgtgaagactaatgcttctaatccaaggagtaatgcaaagcaagattcggggacaggtaagggtcgtgcagttggcactggaggttcttcaacgaaatcgcaagggaagcaggtaattcaattcctgcatcatctcacctatctgtcttatgatatattcaaatcaaatttccagattcatatgcaacccaattcctcgatccatctaaatagtctgaattaccaataattttcatttatgcaattccccatgttacaaagggatagttacatgcataaaaaaattcctacaagtttatttgcattccatcacaattagtttttgttggactcaacacaattaattttgatgaacgccataataaacggaaatgatcaatgttagtgagatctgatgccataattcttcaggtagaagattgatcaaacttacctaggatagcctgcacttgattgtatcaatatcttggaggaatggaaatatgtagtaccagaacagagaacctccactgttttgaagttttaatttttgctgttacactaagttgcatacaaattcactcagtaattgccctttttatttgctcatacgaccactcttatcattttgagaatgtggccatctgtagtacatcccgctgttacatgcagggttatttcattgttatcaaggtgtttactaagtagtggccacttgccccaccatctgacacctcacctgggtccctgtgtctggacagggccttaacacctgacacaaaaaataggggatgggggattggttcatggagagggctaaacattagtcacaacttttgggatctttgtttttctgccatttctcttttctcaatctatttcactccagtttcctctactttctgctgcatcctggtcaaccaggtgatggcttgagtgcttttttttttgtgaaggccttattatcctatgaaaataattttgtgaaggccttatttctgaggagtaacatgtgatttagtcagaaaatggctgaaagtgtatttggttgatttccagttgtatggctatgcatgcatacttcaataggttcacagcaaccatgaaactattatatgccttctcacatgtagctgtacgtataattatctgactggactgtcagggcccccctaacttttccacacctcccgctgcaaagagtaacaagaaaactgctgggcagaagaagtcattggaaacatcaggctctacaccaccccctcctaggtttttgtagttcatttcaccccatatgctctttcattagcagattgttcagtacattcaatttttggataatcctaaggtgatttcctttttgtcactagcaaaaagcagaagacttctggaaccttccaagaacaaagcttcgatcaactaaatgatgtcacggctgttagtggtgttaatcttagggtacgcatctccctctatgattctcatttgatgtttgttttatttttgtatatcctctttatattccatcactgttttactttaacaggaagaagaagaacagctactctctgccccaaaggaagagagctgggcctcagaagaagcaaggaaaattgcacaggaagaagatggcaagctttttctgcagaaaggcccacttctgaagaaactagcagcaatcggttaggaccttggaatttcatattgacactgtaaaacaatattacatggcaatatatactatcgaagcaatactaactgatgaaacatttttcacagttcctaaatgcaatttgaagagcattggtggtgatgttgagcattgtttatcaatggtgagctattcatatgattgtccttaagaattttttcagagtaatgcagtatatctaacataaatgccttcagtgcgtggaggagcgattgcgaagatttatcagtactctcataagagtttcaaagcaggttattttacacaacattcaattactaaatttatggtattgttgttattttgatgtactaaccatgattttcttattgctagagaattgacacagaaaagtctggccatcaactagttataacatcagatgttggccggcaaattttgcggatgaaccagaaagctaaggaagaatgggataaaaaacaagcagaggaaacagacaagaacaagaaacaaaatgaggtgttccataatatctatgttatttgcttgtgtacaattttgcatgacatgcttgttccgttgaactatcatgttattactatggcacatcatcttcagttatttatcactacctttatgctgtcctaagtcctaaattattatttgttgttcttttatccatttttatactgaaatatctaaacacctctctctctctctctctctctctcacacacacacacatgcatgcctaccccgcacacatcccacactctcctgtacaacttatcccaaaggaaaactgaacgatttaattaatatatttctattttcaattttgacacgaaacagtttataagcagcttcacatgaaaagggactgtagcagatttctttgtcttctcactgttgaagatcatacattttttatggttacgaaaggtccatcaagttgcgatgttgcagttagtcattctaattaaccatatccttacacacaggttgacggcggtggcactgtggaattagacaaggaaaaggaggaaactcgttcaaagaatgcaaaggtaactttactaatgtgatatttaggtttggtggcagcccttgttttcctaatatgcttgacctgtagcccaacaaagaagaagatgacaagatgagaacaacagctgcaaatgttgccgcccgacaggctgttggaggaagtgatatgctgtccaaatggcaactgatggctgaacaagctagacagaaacgcgaaggccttgatctggctgcttcttcacagcgcgggacagcttccaggtcgcatatggctgggaaaggtcccacagatcaccacgaagcttcgaagaggacccattctgcagcgtttggaactggtaaatcagcaaccttgcattgatttatttcccgccctttcatattatgctagaaaaagctgcaacttcagtatccatgtcatattgctattgcaggaggcatgaacaggcaaggcaggggtaaatatgcagcgtctcatccaaaaggaccacaaagacctatttctatgaagaatgtaatatgtgtcctcgagagggaacctcagatggcaaaatcgcggttgatatatcggctctatgagcggttgcctgtagattccaccagagattaggcttgaatcgtcatttatttggtgtatgtatgcacatttgtgtaacaatatcgagctataacttattgttcacttccttccattttctctggtttggagttgcgaggtgtgggtgggtgtgttgggggaggggggggggggacaaaactagtgttacaagttagctgacatggtactcttagaatatgaacacataagatgtacttccaaacaaatggtcatgtaaagattatacagtgtaacagatggcaagattgcccattgctgcctgctggtgcatgcgcttgctcattgtactgttataattcagtgagataatttggagaaatccattgttctgatttatttctttccctgggttccagagtgttggatacattgcgcactaaaatcgcgctaaatctaacactggttacattgatccaggaaggaacactgcatgcaaaactacaatgagacaccacacctaaaatgcacacactagtgagactgggcattcagcaactcattcataatctaaaagaattcgaagtcgaggtatttcccgccggacctgacctcggcgccgaccacccttttgccgcctccgccgccgttcgccacgggttggccacgccgtacttggccggcagctcggcctcgacatgcctgggcacctcgggaggcgtgctgcaccggatgagcgcccagttgacgccctcgaagaggggtgctgcttgatctcggcggcgccacgcttcacgccgagccgctgctgcggctctttcaccaggaggcccctgatgaggtccctcccggcgtagctcgtcgacggcgactccgggaaccgcagctgctgcccgaccacgttgaacagcgtggcgcggttgcccgaccccttgaacggcgtcttgccgtagaggagctcgtggaggaagatgccgaacgtccaccagtccacggcgctgccgtggccttcccccttgatgatctccggcgccaggtactcgtgcgtccccacgaaggacattgaccgcgccgacgtcggctcggcgacgagctccggcagggcggcgccaccgccctgccccaactcggacctcggcctccggccctgcttcttgctcctctggccgaacagcttgggcatgaagcacgccggctggatgcacaccgaagaaggctccatgcaagcaggctgcacgcagaacgaaccgccggctctcctgggatcggagtcggacgccgacgctctgatgagcgtcggcgacaccgcgcaccgcagagagaggtcgaagtcggagagcatgatgtggccgtcatcgcgcaccaggacgttctccggcttcaggtcccggtagacgacgcccagcatgtgcaggtactccagagctaggagcacctcagcggcgtaaaacctgatcagttttgcacattccaattcctatcagtacttcaactagcagacagtactatgggatggttaaagaagatgacaagaatcagagtatatgctaagcattattactagcagttattgcaagtttgcaacacaagaagttaccaagcagaagaacacagctgtgcattctaaattgtcatgccatcggatgccaaaactatactgcatgtactattgcatactatgtcccaatcaatgcagattgatgtgtaaacatcagggaccctgtgttcataaatactgtagtactgtactccatggctgttagtctggagagaatatttcagcaggccaatttctcaaatatccatcactaaaaaaacaattaatagttcaagaaaattaatgtatcatgggtacaactgttgttaagatggcattgaatttgaataccaacattaaaggagtgctaactaacatgtcaagataaatggcatagaatcataggcaaatttgctcaagaaattcaccttgctgcatattcagagaaatgctttcgtggctgccgttgccgcagagtgtgcagatcaccacccggacagaattccatgaccagacatgagaacctgtcagtctcaaagtgtgtgtacagagttggaaggaatgggtgatccaaaagctgcagaatttccctttcagtttgagctctgttcaacttctttcggcttgctaaggacgccttgtccattactttcatcgcaaagtagcaccttgtcccactcaactctgagaggtagacgctgccaatgtcaccacagccaagacgcttgagcaatctaaaatggctcatcccaaggacattgccccgaccccggacagctagaatagccctccatctaggatcattgcccttgtgaggcttgttagcacttcctgtgatgttactccagttgctgtcatcgctaacgccactactatcactcgctcgactcatgctggtctttgtgctttccattgagttgcctcgggtgctatcctttgcgctctcacatgtcttctccacggtaaggatggattcactagttagaactccacttctacatgtgcttgtggatcttcccctgatgcttgtggcagcgaccgcaccagtgctgtcactgctactgtgtgggctgacattgccactgggagggaaggaggcatcccagacgcaatccttctcctccgaggcctgagttgaggatacggcttcaacagcatctggtgctaccacagcacagtgcaccttcctctcttcaaccaaaccattgacattaactgtgcaaacaatcacatccggctttgcatccatggcatggactgagaggtcctccatagatgctcctttgaccgataggcctcgcatcaagcactcgggtggctcaggcttctcctcgtcgatcgcgacatacaccgtgctcataagatccaca

SEQ ID NO: 22670 - DNA, 936 bp, Oryza sativa
ccaaaataatgaaattgaagcagttttgagcattaaaagattcttagaaataagcaaagctccaggaagtagggaccgcaggcaaccaaccaaattacaatttcaagaacctgaagcaacctgcaacttgtctgtaattgaaaggattccagccaccaagaaatcaagaatccacagcctgctcctccaattattggtgcccaaagagggcaaatgtaggagccgggagcactctcagttctgcagagaaatgcacaataatcagcttaacacgccaaattggacatggatttgtgaatggaactctaatccactggaactagaccaaaagtttatcgaatcctaaaatcctaaaagcaaaactaagcacatttaatatcttcgcgcacataaccgaacagcaaatatttctactttcccaagaaacctgaacgagcctgaccaagagggggaaaagaaaactcaccttggataactcaagatggagatcccggagcggcttgagctcagttcagtctctctgtctcccagccattctccagtcaagcctcgcccctcccccctgatatactgctacttcccgagcgacctcacctcccactcgcaccacgtacttccgcaccgcgtgattcgaggagatcgaagtgggaagaagggaaagcaaacgcgagtcgtggaacggtggagccgacgaactgaaaagtgggggagtggggaggaggtgtggggggcaaaccaacaaaatttaaaggaaatgaaaatttactactccagcgaggaacaaaatggaaaaaggctactgcagtatcacgagagagtgagagaaacagtgataataacttgaggtctttttcaacgtgggagttttctctctctcttttttcttccataggaattggtttttgtttgatacgggacacatttttatcacgtgct

SEQ ID NO: 22671 - DNA, 10605 bp, Oryza sativa
  unsure (1)..(10605): unsure at all n locations
tctattaaaaggtagtattatgattattagtaaaggagaaaaggatattacaacgtttattatagagactattccaaattattaatccctctatcccatagaagaattagcctttagtactaatcttagtatcacgaatatagacatatctctgtacagattaattgtattataatatattacattaatcctataacatttttttgggattaatcctatatttatttatttttaggacgggagaacattaagtcattaatcttttttttacacccattattaagaatgcgtactaggactattactactgcgaggtgaactgataactgcatgcttcctactactaccggccaaggacgctgggcctacatgcctggctctccagggccaagggagccccacatgtcaccatcctttcacggcagcggaagcaaacccattaaacgctgatgctttgtggctccaaatcgctttctcgctgtgagtagtttgcctatctacatgtacttgtgcagttatgcgagtgtactaagtactaacaaatctgttgtctgagcgtacatgtgtttatacgagcgtccgtatctacaccgtgtttcaaaaaaaaaaagttatctccgtgtaataccaatggatgtgttgatgtggcattttttcctgcgttctactgatgatgtgtcacgttacaaaaggcagtgtgtactagtactagatagccctgaaactaaacaccattacatagtgcttggaactgattgagctgaatggcatgcagtgccagatgccatatgccatgcatgcagattactactgcataatcctcctgtccaccggtctcagcctctcaggtcttcaccacgcacagctgaaagcctcagtgttgcagcagcaaccagggcttccggtttgcagctttcaaatctttcggtaaaaccaccggaggatttctgcacgcatcctttctgagttctgaccatctgatagtttgatcctagctcatggctctatggaaagcatcacgcaatctgtcaaggaacagagaaatgatcgagggaggaggaggatcacaaggtagaaatgatgatgattaactctgctgctgaagatcctaatactagtattactaactactatcagctggacccccattatatcagaccaaaactgttaaccatcgggattacccctgcagaagcaataatcaatcaatggccccatgcagcagcagcagggccactcactctcgctctcttgtgcctgacaggttcttgacatgaagaacatggcgtgtgtttctggctgctgctccctggccatgccatgatctatagccattggaatcggggaaagttgcagcagctgagagacccaagagcttctggtcttcgtgaggcgtccgtccgtccatcgcgctcatcagtggcatgagtggaacggaatgatgcctggttgcttcggccagatcaaagcatgtgagaatctgaaggtgactcgtctctctgctttgctttaccagccaccgccatgagagagagagagagggagagagaagagctctagacttgcatgcttggtgggttttgccttccaaagctcatcagtcatcatggccgacttgcatggcagacaggcctggcagtctctcgaacagcacattcatattcttttatcatttttgctttgcctgtttttagccgggatattttacctttgctctttttgttttttccctgtaatttggggcatgtagttaaacaattatactccttgaccaattaactaacttgacgccagcttagagctctcctgatacttccctttttaatctgtttcacatgtttgttcattgtctgatttgtatctgaaagtgtcattgtacagtgtttgttcagtgaccgaggagatcaagagcgtacctgttacaatttgtccactgcggacacttagtccctgaatctttacgagagggaaaaaaatgactatttgacaccatcagatataatgttgggagatttggtattgctaattattcacttgattttacccacacctctcatattctaccattttcttccctttttgcctgaaattcaatctgaaaagcctctgatatgcactcttcttttttcactttgtttctttgctttaccaagaccagtattctttagcacaaaccggcagagtgagcagcaagctctctcctcacgctatgcttttatcatccccatgtcctccccaaacatcaaatattcaatatctacatcgattcagtatttgtgtatgtccttctccaagcatcagtttttaatttgtgcattgtaatgttagggcttgtttggcatgcatggaggaaagaaatggacttttgaaaaaggtgcaagacactactccaatctgtgtaagcaggcctgagttctagacaagcaaaaggtgatgccggccaatggattgtacaatactactaataagccggaaggaggctaacaggtaggctcctttgtgttacccattagtcgtcaaaaagtgttctttgtgctgcccttttgtagccagcaagacaagggtacaatgacatgacaaaactgcaacatctttacaagccactaatgcttttcaaggataaataaggcggtctaaaagtagatttgctgcagttttcatattgcagtgcagagaacatgtgtaaccttattaacttgataaaatgtagcatgaattggcagatgtatcttgttcttcttacatgtatggagaaagatatgaacacagtagaaagtctaaaaataacctgctcaacccttctggatgtgagaagctcaattgaaagcaacttgcaattttaacaccatttacaaccttatttccctgtgtatacaggtttccttttctcagcaaatgcagctagaccttcaagacgatcttgagtgtgcagaacttgctcgtagcattcttcttcgacagccaatccggcggacagatctacctccatgccttgattgatggccttcttagccattcttatcgctaacggaccctgaaagaacaaatggtgcttagatcgtctacaagaacggacagaacagtgatcttgttgaatttgattcagaaagttcattatcatttgtagaagctgctctatcagagatcatgaacatctcaaacagatcaaatataacatgttactcattcagaagcctcttactttctgatttatctcctgggcaagttcaagagcccttttataagcctccccagcgggaacacagtagtttactactcctgcaatgaaaacatacatgtcgtagtggttcttctaagaagtcatataagcttttactaagaaatcacacctgtagaaataaaatgtaacaagactcctctcaaaaaagaaggcgccaggccaaccttacccatggttacagcttctactgcatcgaatctacgaccagtgaatattaattcctttgctctggactttccaacaatcctaggaagacgctgcgttcccccagctctatagattgttacaaagtgatgttaacagcagaagcacaccattttgcttgagacatttcaacaaaaatcaaactagttccactatgatatgctattcaagtacaatagaacagcataacaaacttttcgataggatgcaatttcccactttgatatgatacacggggttgctgcactagagcaagagaactgtgaaaaaaaagggaacaggtttggcatatactggtgggtaaatgactagattttttttgacgcaaggtaaatgactagatttacaagccaaacaatactcccatgttatttaataaagtgccagctacatttataaaaattacttacaaaagtaaagcgccatcttgaacacatacccaggaataatagcaaggccagtttctggcaagctaaatgttgcattttcccctgaaaacacaagcattgaaatgtttgagttttggaaggaaggaacaaaactctttgataagatggatggaatatgatcaattgatcactgcaggttgaaagagtaccacatatacggagatcacaagaaagagccaattctaacccaccgccaaaagcagctccctcaacaatggcaattgtaggaattgacaatgcctagttgtgcaagatgcattttgtaagtattctcaacatactctaaaaataaaacttgcatcaaggctttagaaaaaaaatagctagaatgcgaaagatgagcgtgcataactacttataatttgaaccgcgagtaccatatattgcttcactaaaatctactaagatacaatggatgttagcaaaatatatttgaatcatgcacccagaagcaaacctcaaaggacaggaatgtagatcttagggaattgacaaattcgcgaacttcgcaagggctcattaacctcctttcctgtcaacaatttatgtacaacggttatgattttgtttatgatcagcaaaggacaaagggacataagtacttacaaagcattcaccatttttttcctatactatagctacaatgcttttagttccataactgacacaaaagttatctacgccgtggtggatagcacttatttcaaatgctcaataattcaaacaaacttcttcaatcaataccatctgcacaaggacactttgattagttggtgtgtacacttgtacttactgaccatagctagccagtaaccagcatttcaaccatccatctagtaagtcttaacgtatatgaggaattgaggacatatatacatatccctcttaataagtcggaccctgctactgctattaacccttccaaacttgttgataaaaagattgaaacaacggtgccaatccatttgtttctctccatccgatattttttgagggactagcttctcaatgctgtcacaactcatttaagccttgattgatgtttgaagctcctgatcatgttgagtaatgagtacgtcaatcatcagttttccagatcgattcaactactcccttaaaattagaacactcaattaaaacatcacattaactcaaaattgaaacataccaaccttgccaaaaaaaaaaaaaacagtgaaccaatccttatctactttcagactcttctaacaactgcttagctagagtatgccacaaacatataatccttaatccttatcctactgtgagcagaaaacctatcgagatttagcagaggaactgatagagcgttcaccttgagatcagcgccagcgcagaaaaccttcgggacggagctcgccagcagcacgactttcgccgtcgcgtcagccttcaccttctcgatcgcgctccgcaacccctggagcatctccctcccgatggcgttcctggcctccggccgctccagcctcatctccacgatccctgagtccaatcatcgcagctgtaataaaccacaaaccccaaaagaggaaggcaaaaaaaaaaaaaatgacaggagaagcgagcaagggacggaccggagtcgggcgccgagagcttctggaggcggacgggctcctgctgggcgaggatttggagggcgcgggagaagagtgccaggtgggcgttgttcgccggcgcgcggcggccggcgaggtggccggagacggcgaggattccccggaggatgcgcatgctggagcagcagcggttgggtcaggatgggaggaccggaggagtcgtgtgggactgtgagtgtggaaacgagccgagcgtaaaaggctcgctagaagggcggctcagctcggttggagaaacgaggtaaaacagcagctcggctcggctcattgacgggctcgagccagcttgaggctgagccggtgactaagatgtggcaggctggcagcgaatttttttcattttttaatttttttcttttaatatttaaagaaataatctatcgacgcaaaaaaattacaaaaataaaccctgccgccctccaagttgacgtggcagatgtcggctcgacggcgccatctgctgccatctgcgaaaattgcatttagccccttgccgcccaaggctaaatgcaattttcgcagccctaaagagcatttggctggtactttttgcatctaggtaccagccaaaaagtattaggcccgggttggcttttttttttgcatgggagccccttgccgccataacatagggcggcaagggttttcgtgcaaaaaaaaaaacctccctctcccgtctctcccgtctgccgtcaccacccgtccctcccccatttgccacgtcagcttgccgccttagtagagggcggcagggtctatttttgtaattttttgcgccgatggattatttctgtaaatattaaaagaaaaaatttaaaaatgaaaaaaattcggctggcagcgccctgccggcaagggtgaggcccaggaagcctcgggtgggcctacaggccagcccaggaaggttggtccgctgagcccaacaagccacgagaattacaagagttgggcttcttgtctcgaacctacctaggcaagtgcaggagaattcatcgacacaaacttctttatttactctcgactaaagtcaccgggaacgggcaagcgaagatgatcaccacgacaccaaatggcagtatactgtatacacagataaactactttcctgagtatacaggtttcctcctctcggcgaatgcggctaggccctcaaggcgatcctccgtgtgcagcagctgctcgtagcactccccttcgacggccaacgcggacggcatgtctgctgcctgcatcccttgatcaatggccttcttggccattcttatccccagaggcccctggaagaaaataacaggattcagaaaaaagctacagattggaaaaagacctcgtattgtcacagcacactgtatgtgtttggtcaagatcttcatatggccaaaattgtggcttctgttttatttgaacagtcctgtgttcaaagccgacgatatggttcttactttctgggctatctcgcgggcaagttcaagggctttttcatgagcctcccctgctggaacgcagtagtttgcgagtcctgcgtttcaaacatccaattaaacctcatttgaagaaatgcaagtgaagataatagaaggaaagcgtaagggaactcttacccatcattacagcttcagttgcattacatctacggccggtgaatatcatctccttcgctctggaccttccaacaatcctaggaagacgctgtgtgcccccagctctacgtagtacagtaaaagatgaagattatctgctcaagctgaatattttcattgaagaaacacattttggactgtaatttatttatttatttatttttgtcaacgtaaagaatcgtttatatgttgactaaaagaggtattggaaataatgatgagtgggtcatcctgaatctggagctagcaatagcactcacaagtgcacaatgatcgactctctacaattttagtgctaacctaaaagaacattagtacattacccactgattttttttattatatttctcctagtggatcagattatcttttcattgccaagcataagcaaatactaccattaagacagaaattcttgtcagtaatatttaatatgaacattagctccactaattaattttctttttgagcaaaatgaaatcttttctgggtgttggactttgatgtaaacagattgcattaagatgggaaattctaaagtatgaagacctgccttattctggtaggtaagtgcatattccatttagtttcggatcatcttgacaatttcacgagaaacctatgtacaaaagtatggagtactagatgcatacccaggaatgatagcaagtcctgtctctggcagtccaagagttgcattttctcctggaggggtgaacacattatttcaaaaatttgaaagaaaggaacaatgattatgtccataagatgggaaatattgaattgctcatatactaagacaaaaggaagcaccacatatacgcaggtcgcatgaaagtgccagttctagcccaccacccaaagcagctccttcaatgacagcaattgttggaatagatagtgcctgaaaaaacaagatgtggtttttatatacacataaagaaaaatgcgccatgtataggatctgaaattaatgggcatagtttctcataaaaacactggtccactcgagggtggatgccaacaaaaaaaaaggtaaattctgaataaatacagacctcaaaggatgagaatgtagatctcaaggaatttgcatattctctaactccagaagagctcattagtttccgttcctgtcatgaactgttgctctgttatcttagccatgtggattgtaaatttgtaagcaacaaaaaacaacatgtaggaacagtataacatgtttttgttaacatcatctcatgattttaatatagtccatgagatggttttggttctttaactagtctagaggtcaatatttggtttaatggcaactacaagtacgagaagtcaaataaattggttgagaaatcaatatcatctggactgtgcaagatgacttatattaacttctagtaccaagttttaaagcttaaaatgatctgtctggttaagcagctattcctctctagaacacagccccaactagtaattgaccccaatttttaatcctttgtttaaagcatgacatcctccttttctcttatagtatgttctttgagatagtgactcctccatatgctgtcccaggatcgcaatcatgatatttcattttctccatgaatcattttcttcgtgacacgccatcacagtatttctttctatgaatttcgttttcagcactacaccaagctcatggatccatatttcttactcctgcagtttttccacagctactgagctactccaatgtctttgatcgttcagaattcgcagttgcatctcaactgttctcacagccattctactcaaatgcgaaacgctctaatcgatctgtattaaaatatgaagtatgaaaacacatgcttgcatttccaagtagtagaatagacagagaccttgagatcggcgcctgcgcagaaaactccaggcacggagctcgtgaccaggacgaccttcacggtgtcgtcagcctcaaccttctcgaccacaccccgcagcagcctcatggcttcccagttgatggcgttcttgacctccggacgctccagcctcagctctacgatttctgtttccacccacaaatttaggaaccgcaacaagggagaatttttagagcaactctttcagaaaaaaaaaaggattcttcagaaaatttaggcaaaggctaaaagccatgctgatccccgggttaacagaatcatcagaagattagtagtagacaagacatgagaggacaatctttaacagtccttaatagaccctgtcttttgcacatcgacattgttgctatcactgggtagcatcacacaccccatcagagataattgaagggacctctgcagtactactaaagacatattgtgaattgagtggctactggctactgctggaagggatcaagaagtggatggctttgcagcaaagtacagtgtctcccaagcccctgacctacctacttgtaccgctccactgttccagggcctcgccgacgccacgccgagtcgccgattccgcccggcgggaaccgaggagatacaaagcgagcgggggatcggcacccacgccgcgtcaggagatggcggcgctgacctgagagcacgagagggagctgccgcgcgggaggaggccgtgcctggcggcggccggagaggagaggggtcccgtgccgaccgccggcgacccgacccatcgagtgctccgatggtaacatattttgcggaacagcccctccttccgatcgatattaatggcagcgatccaaatttctgcagaataccccctataggttttgcaaaataccccctctccctgtttcgatgttttgtgagttgtgaccggaattacggcgatagattttggaggagaagagggcgaatttacagcaaccctaaaaaaaaaaagggtgaagattcacgaaccgcagtcgggtgccgagagcttgtggagactgacgggatccggcggcgccaagatctggatggcgcgcgcgaagagcccatggtgggtgcgggtcgccggagcgcagcggccggaggcggcgaggaggcgccgcattgtggaagtggacggatgggaagaagtgaagaacacggcgatgcgcgctgctcatgcggatgcgggtgagtttgttggctgcagctggagatgcatccaacggtacacgtaagacacgacacatcacacatgaacagtcaccaagtgcttaagcttggaactgcacgagcattcaacatttttctcctgttgatgtttctgaaagacgttgatagtggaagacgaggctacttgccgggcaaagctttgaccgtttctagttttactaccttgtcttggtaaaaaacaaagaagggaagcagtcaataattttcagtgacaagagattgtacttctctttgagtaaaaaacaaagnnnnnnnnnnnnnnnnnnnnnnnnnnnnnnnnnn

SEQ ID NO: 22672 - DNA, 529 bp, Oryza sativa
  unsure (1)..(529): unsure at all n locations
cgtcagcctctgcacgcgtctgtcgcccgtgtcgtcgcgccgctccaaaccgccccgccgtcatcgccgtcgtcatcgcccgtgtgctcgctgtgcccgtatcgccgtggtcgctccgccgctcgtcgccgccgcccgccgtccattcgcggccgggtcgtcgtctacctcccgccggcccgcgtggcatccacgtaggcgccacgtcggcgccagcttagccagaccgggtcgggccgaccccggttggtccctccgcgtgcgcgcgatccaccgcgagccgtgaggctgcgcgtgggcccgcccgacgtgcgtncaccgcggaccgcgcgcatgcactgcgtcctcttcccgcccgcgcgcgtgcgtcgcgtgctccctccgcacggtgagccgagccgctgacaagcgggtcccacccgggaccgcgcgtggtgagcccggtccaccggctcttttttcctccttccgcgcgcgcgcgagtttgggcccgcttggccggccggccatttagctcggccggaccgct

SEQ ID NO: 22673 - DNA, 3946 bp, Oryza sativa
  unsure (1)..(3946): unsure at all n locations
aaagttgttggcccgggtggccgtttaaaaagctattggccgggtccaacttgttgcaatcctaaagattgacacattgcacatactccgaccggacgagacgcactgtctcatccgtgtcgcctgagaagcactcacttagttattttcagaaaagaattcaaataaaatcaattgcaaaaacaacagccttcccttgaagcctgcattaaacacttatttcccctggcttgctgagtacccccgtactcacccttgctctatataaatatccccccccagttgctgaagaagatgaagcggatcctgctgatgaggagttcttccaggagcaagccagctacgatgagttttagggtttcggcctagttcccaagtcgcgcctgtgatgtttggcccaagtcctggcttccgtttcccttttgtaatgcagttgtgagctcgggatctgtccgcagcccaacatgactgtacctctactctataataaagagacctctgttgctgtggtattctgtctccctgtgataccagcactgtttcctgggactggtatcgattaacaggctaaattggagcgtcacgggctagttccggtcgggactagttcggggcgtgacaagagatggtatcagaggacaggcttggccctagggcgaaacccgacgcttaggacgaccctaaggatactaagttcaaaactacttgcgaaaagctaaggtttcttttgctttctttattttcaatagtttgtttctaaaacggttactgatctttctccctctttcaaaattgtagatggcagtgaacgccagcttcagttcccacggttttggtgagggtcaccacgtcgcttagcttcgtgacctctcccgtttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggacctctcctggactgcgcttcgtcacctggcccacgactacagccaccgtctcggaggctccgccttccggcagcttccacgccttccctctggccactcagacgccaggtacccttgtccgtacagcgagtctcagccagtgctgactcgcatggttgagctttcggaggctcaggccactcagcacgacctactccttgaggcttaccgctcccttgcccgccgatacgccgccttggaggcccgtctggccgaggagggtgtcacctcagttgacactatctcttgggactcaggacgcctctgccacgccagccacctgtcctcccacagctcccgcggctctgcctgcactcccagtggcccgcgctcccccagctcgcgtgcgccgtactcaccagtgtactccccctacccacacccagttagcccttcctacaccccggacacaccccagttgcttcctcccgccgtggcccacgctttatccgcaccgcgcggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgtggtgggtgttgtttggtagtctggttctcctaggtggtgtgcgcacagtcaagctcggcgtagctctgtgacttgtccacacccgttatatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcaaccgctcgcatcgcacagttttccgtaatgcagagatggaacaatctcaccgctctcaccgcactgccagtcacaattctggagaagaacacctccctcccccacctcatgtggaaaacaacatgcaacacataatggcagttcagacacaaatcttgcaaggactaaccacagccatagccagttttcagcataatgcgcatggaaatggccaccctcacgtgagcagcaatagatccaagctgacagattttctgaggtcacatccgccagagttctctcagaccgtcgagcccgtcgaggctgacgattggctgaaagatgttgataggaaactcaacttagtgcagtgtactccggttgagaagacgctctacgcctctcaccagctaagaggacacgctgcagattggtgggagaattactgcaatgcacaccctgaacccactaacattgcttgggatgagttcgctacggctttccgtgcagctcatgtgcctgaaagcactattgacatgaagaaagaagaattcaacagacttaagcaaggcaacatcagtgtcaatgagtacctaagtatgttcaacaagttggctcggtacgcccctgaggaagtggacacagacaagaagaagatcaggaaattcttgaaagggatcgcagttggaatgagactccagttgcttgctcatgacttccccacctttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgtcctcagatgaaccgtccggcacctcagccacagcagcgtgcccctagtagcaataccgcgccaaacagtgttacctccttcaagtcaccacagggaccgtcagcagttcagtgtttccggtgcaaccagatgggtcactatgctagacagtgccctcagaatcctaccaacaccaactcagggcatgctaatggcagcaccgccagaactcctactccagcggcagctcagtctcgtcctagctctcaggcaagtggacaaggttctcgtgcttccaaccactttggtcgaggaagtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggatatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccctggagtcggtacccatagtctgtgaatatnnnnnnnnnnnnnnnnnnnnnnnnnnnnnnnnnnnnnnnnnnnnnnnnnnnnnnnnnn

SEQ ID NO: 22674 - DNA, 1524 bp, Oryza sativa
agcttcccattctttcatatcacaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggatatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccctggagtcggtacccatagtctgtgaatatcccgacgtatttccagaagaattaacgagtatgccaccagaccgagagattgagttcgccatagaactggcaccaggcactgcaccaattgcaaaaagaccataccgaatggcagctaatgaattagcagaagttaaaagacaaatcaaagaactggaaagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcactaatgctccagcattcttcatgaacttaatgaacaaaatcttcatggaatacctggaccagtttgtcgtggtgttcatcgatgacatcctgatatactccaagaacgaggaagaacatgttgaacacctgaggctgataatggaaaagctcagagatcatcaactattcgctaaattctcgaaatgcgaattctggttggaccgagtagcatttcttggacacgtgatttcctccaacggtgtcgaaggggatcctctagagtcgaagctgtacttgcttggaacccgcccaagaacgtgtcagagatccgcagcttctttggcttagcgggatattatcgaagattcattgaaggattctctaagctagccagacctatgaccgagctgttaaagaaggaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcttaatgcaagaacgaaaggttgtggcttatgcatccaggcagctcaggcctcatgaagtcaattatcccacccatgatctcgagttggcagccgtggttcatgctcttaagatctggaggcat

SEQ ID NO: 22675 - DNA, 1552 bp, Oryza sativa
  unsure (1)..(1552): unsure at all n locations
nnnnnnnnnnnnnnnnnnnnnnnnnnnnnnnnnnnnnnnnnnnnnnnnnnnnnnnnnnaatccactatcatcctggtaaagccaacgtggtcgctgatgcgctaagtcgcaaggcctattgcaatgtagctcaaatacggcctgaccaagatcatctgtgcagagaattggagaagttaaggctgaccgtggtacagtcaggagtccctgccagcttgacagtacagcctaccctagaatcgcaaatccgggaggctcagaaagatgacgaagggataaaagagttaataaaaagaatacaggagaagaaggacaccaatttctccatagacaatcaaggcacagtttggtgcggtccacgcatctgtgtaccggccaagaaggagttaagagatctcatcctaaaggaagctcatgagtccgcttactccattcatccaggaagtacgaagatgtaccaagatatcaaggcatacttttggtgggctggaatgaagcgagatgtcgcagaatacgtagccttgtgtgacatttgccaaagagtcaaggcagagcatcagaggccagcaggtctgctgcaacccctaccgattcccgggtggaaatgggaagagatcggaatggatttcatcaccggtttgccaagaacccccagcgggtacgactccatttgggtaatcgtggaccgactcacgaaatcagctcatttcgtgccagtgaaaaccacctatgatggaaagaaactagcagaactctacatgacccatgtcgtatgtagatttggctgtcccaagaaaattgtgtcagaccgaggcactcagttcacctcaaggttctggaagcagttgcatgaagccctcggaactgatctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgtacggaagaaagtgccgcacccccttgtgctggaatgaggtgggcgaagcactggtattcggtcctcacatactcaagtcagcagaagaacaagttaagctgatacgagaacgtttgaagacagcacagaaccgtcagaagaattacgctgacaatcggaggcgtgaccttgagttcgaaaaaggagatcatgtgtacctgcgggtatcacccctccgtggtatgagaaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagttaaagaaatgtattcgagttccagaagagcaagttcccctgggtaatatcgagctggaaaagaatctgacctacaaggaaagaccgatcaaggttcttgaagaggcagaacgtcagactcgaag

SEQ ID NO: 22676 - DNA, 10752 bp, Oryza sativa
  unsure (1)..(10752): unsure at all n locations
catcgccgtcgtcatcgcccggcccccgccactccgcgcgctagcctccaaggggcggaggcagagagcccctctccctctgccgagtcgccccgctccctcccccttttcccgaatcggcaaaagagcaagccccttttctctccctcctttttccccttttcctcccgccggcgtcatcctccctccctcctgtcgccgttttggccgctagccggagcgccagctcgcgccttgaccgccaaagtcggtttccaaaccgacattgccgccccctataaacccaggcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttccccggcccgaggccggagagatcactcccgcgccgtcggcctctcgtcactgcgccccgtcccgcacggtagtgtctctctccgttcttcctcctcgctccatctcctccccctagctttcggtagtagcttaagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgtcgctaccgcaatccgccaccgtcgagcatcctccggcgaatccgagccgttggctcgcctccccttgtcacgtgcaaccgcccggtgtgctcgctgttgcccgtatcgccgtggttcgctccgccgctcgtcgccgccgcccgccgtccattcgcggccgggtcgtcgtctacctcccgccggcccgcgtggcatccacgtaggcgccacgtcggcgccagcttagccagaccgggtcgggccgaccccggtcggtccctccgcgtgcgcgcgatccaccgcgagccgtgaggctacgcgtgggcccgccgcacgtgcgtccaccgcggaccgcgcgcatgcactgcgtcccttccccgcccgcgcgcgtgcgtcgcgtgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccccaaatctcgagatctatctaatggcacgcttagaggtctttaatagggctttattttcgccgtttgttgagttgttccgtttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgatagatcgcacttaatctgtttgtcccgtctgcaaggcagattggcagacctacctaatttgtcgcatttgatccttcctttgttaattgctataccatgtccccttgtaaccacccagttgcgcctcgatactcgtgcactctgtgcaagtatcgacggtcgccttcaaacttaaaatctgagtaacaacttgggtaaaactggagttttacaaaagacttggaaaacccgacacctgggtcggtgcttgcgaactaaatggattttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtcccccggcgtggctgatccccacgggctgggtgacccgggttagtaatgtcatgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttaaaaagctattggccgggtgccaaccttgttgcaatcctaaagattgacacattgcacatactccgaccggacgagacgcactgtctcatccgtgtcgtttgagaagcactcacttagttattttcagaaaagagttcaaataaaatcaattgcaaaaacaacagccttcccttgaagcctgcattaaacacttatttcccctggcttgctgagtacccccgtactcacccttgctctatataaatatccccccccagttgctgaagaagatgaagcggatcctgctgatgaggagttcttccaggagcaagccagctacgatgagttttagggtttcggcctagttcccaagtcgcgcctgtgatgtttggcccaagtcctggcttccgtttcccttttgtaatgcagttgtgagcttgggatctgtccgcagcccaacatgactgtacctctactctataataaagagacctctgttgctgtggtattctgtctccctgtgataccagcactgtttcctgggactggtatcgattaacaggctaaattggagcatcacgggctagttccggtcgggactagttcggggcgtgacagatcccatattcgacttcaaatgctacagctatccaactaaacacattcgttttcggtggactatacaagtcgaaccggcactagagatgatctaacgaggataagacaggacaccctctattcaacctcgtaccagattggataataacctgatacaaatcaagatagatgtttatatatttatagtactaaaaatatgttttatactatgttcctaaaacacaaaaattaatcagcgaggcctcttgatattgtcttatcgcgcgacgccattcagattcgtccacacacgctgcgtcatagccgtttgatcgtgggagaggtggagaagcctactacacatgcatgcctttttttattagacatgcatgtctttttccccttcttataaagttttatctcaaattacttattcgatctataatccgattacatcagtgtgtttgttataattaaatcttcacaacaagatcttacatattatattacgacgaaaaaatatttatatttataaattacttttattatatactccctccgtcccaaaatataacaacttttagccctcaggatttatcccaaaatataacaacttctccaccaacattttcttgtcaaccaatcacaacccttcaccattcacctttctcacgtaccttcactactcatccattcacaattctccaccactcacttctaactactttcttaataaccgtatccaactctaaaacttcttatattttgggacggagggagtacgtatcgtaagttacttttatcatatataaattacttttagattttattaaattatttatacattcataatgctctaagttgattatttttattattgtttttaagtcaattctataatgtatggactttaaatttaatttttagatataccatttttttctccctacaacgaatttacttctaatgttgtaacaaattatttccattttgtgctaagttacttttatgatttatgtaaattacttttagactttattttatttactttcataaatgtatttacttgaaaatcttctctacacttttgtttgtgaatttacttcacatagtttcttatttcaactcagtcataatgtaattacttttaatactatagagagttacttctattacataactaagttacttctataatttaaataaattacttttaaattaataaaatgtttcgaatatattaacatggatctcgttttatcacatatttcgagcagagtacaatgatgcaaatagatcttaaaaataatatgtgatttaaaagatataagtcattaaagatgttttaaaaaagtacaccattgtattttttagctaaagagagatttatatgtggatgaagtggtcgctaattaaaacaaaccagctatcggccgctccctagtcgcgtcctttctaaaattagggcttgtctagttagtaaaaacttttgcctatgcatgtcacataggattatacagatacacatttggagtattaaacatagtataataacaaaacaaattatagattctaccaggaaactgtgagacgaatttattaagcctaattaatccgtcattagcaaatatttactgtagcaccacattgtcaaattatgatgcaattaggcttaaaagattcgtctcgcaattttctagcgaactatgtaattgttttttttttgtctatatttagtattctatacatatgtccaaatattcaatgtgacagcataaaatattttgtttgggaactaagcaggcctttattttaggatggtgagggcgggcttatatgtgcttcccccaggaataagtccatttttcctccctcatctcttgcgcttgcgtgaataacatccctcaactggaaaactgggtataacgcctccttcttctctgaaaaccagagcaaatcacctccctcattggtttggctggcgttttcgtctgacgtggtgtcgttgacccgttgacgagctgactcagcgtggtgagacccacatgtcagtgcaaactctcctttccttcttcctcctccctctctctcgaccttctctctctcccgcggtctctctctccaccttggccagagcagtggcggtggcggtagggagcgacggtggtggcagacgatgtcggagcactgatcgccgtcgtacgaccaaagtagcgagaacacgcaggacgtggagaaggggagagagagagtcatccccgtcaccgccggtgccgccgtcctagagatccctcgccgagctcctgtcctgccaccaccgccgtccaccaccgccgtccaccaccggtcgccgtcccgtgctccttcgctatccccgggcggagaagaaaggaagaccggggagagagggggggagagccatccgtcaccacgagttgcgtggccctggagcgttgcgatgctactgctggcttcttcctgcgatgctactgaggttgaagaaagcctctgtctaggtaattctttttgggtgtagctatatgtatggcgctatatttttcatcaaaaaatagtcggtatgtatttatattgtaagtccctaaattacatacgtaattttagtgtatttacaatgtaagtcttaaaattacatatgtaaattcgaaaattacatactattacatatgtaagtggggtgtaaatgaggtgtaactactgtgtaagtggctaaaaaaatcgattgtagcatatggcgccatatttctagcaactccgttctttttcttcttttctctcactcactccatcagctgctagctttgctagctaggagtagctagctgcttgtgctcttgctgtcgagaggaggaagaaagactcgaggtggttggctgtcatgttgtgcatggctacattcagagccccgacggtgatgtcatcgactgcgtgccgctgcacctgcaaccggcgttcgaccacccgaagctcattcatttttgtttcgatttgcagtgatcgtttctatctccggcgacgtttcttgatcgtgtttgtgactgtgtgcgcgtgcaggttgagccggagccagaggagaggcccaaggtcggcggcgcggcggtggcgcatggggaggcggcggaggaggaggtcgtgttcccgatggcgtggacggacgaggacgagtcgtgcctggaggggacgatgccgatgcggcagacgacgaagcgagacgtgctgaggtccagctcctctctctatttcaggatgaagcagcctcgtgcctgcgtgccgctggtgtcgtccgcgtgaggaagaagatgggatgggggttgctaacaggtggggtccataagctgactcagctagttaatggaggagccaccgccacgtaagtgccacgtaggacaaaaccgcctccgaaaccgctgagggaggtgatttcctctggttttcagagaagaaggaggcattatacctggttttccggttgagggatgttattcatccaagagcaagagatgagggaggtaaaatggacttattccttctgccaacggaggtgtgtcgtgttctctcggccgttggtgaagccatctgctgaaaggaagcccaagaaaaagctgcaaacctgggcttgcgatgggccagaaaattttccgtagtcgcgatgggctcaaccgctcgagaccgaagggtctagcaattttgggaggcccaagtagaggagatggaacatggaaggaggacactagaagccgatgggttacaaggtcttctcctcccgctcgccggctcctcctcgcaccaactccggcgagcgcggcctcgccgccggcagcggcggcggagggggtggcatggaccggtggaccggtgtcctcaacgtcccgctctcccgaggtggccctcccttccgcgtcgccgcctcgctcgtccttactccggccaaaaccctcgccgtaagccccaatcccctgcaccgtcgtctccttcctcgctggccctctctctctctctctaatccgaggcctgattctgccaggtcccatgcgccaacgcgattctcttcacgggcgaccgcgtccggggcagcggcgacccggcgatcgagcggctgtcggacgccgcctacctggctcggctcctcgccgggaagctcaccggggaggccaacgcgtgggtggtggatgccgcctgcttcgctggttcgtttgcagtttaccgagatctcgttccgtccgtggacgccgtgggcgaccccgagcggtatgatcccactggcttcccggcggcggctggcgttaccatcattttaggacattgcattcgtgaggtttggtaaaattctgtaatttctctattcttttatgcaattagaatcattacaatcaagcgtttattcgaatactttgtacttgtatcttaatatttccgtagtagtatgtttagatacttacatatacaggagtaccattgaattactgatgcaatcgtgaattcatgaggcacattattcatcactggtttcagttatagttagtatacgatgctacaataactgaattcttgatattttgttaatttttggttaccaacacaggaatttcgcgctaacatttttttttgtcaacgtaaggtttcagcctgctatatgaatcagcttctcagattattagttcacatttggtaaagtaaatatgactttctaaggatgacttgattgggtttctgggatggtgatttttgtctttcttgcttgatttaccttttgactacatgagcagctactactgtattttttttttttgctaacgtaatgcttagcatattggatatatagatatactgccatggtgcgctaaacttcaagaactttgcttataaaataaatacttcctaaaataggagaaaacgaatgcattatatgttagttttctttttactccaatgcaatttctgtcttgatagttgtttacctactgagatgtcaattgtttattgcaatatctcactattttgagtcttcatttcatgatttcatccatttatcgtgtcaaattattgtgctgaattgctttgtactgaattgcatttcttccatgcacaatttgtggttaccagatacaatctatggttacgaaggccacaatgaagggttcatcaggcaatcaaagtcctactacatcactgttaaaatactgtcctccgaagactgtcatcctggggttcagtaagggtggagttgttgtcaaccagctcgtgacagaacttgcctgtttggcctcagaatcagcaaagatatcagatgatgtttcaggatcaagcccacctcttttaactcgcaatctccttgttcctatttcagctactgagtttttgtcaagtgcgtctgaattccattatgtggatgttggcctcaatcatgctggagcgtacattaccgatcatgcagtgattaaggagatagcaaattatcttatgcacactagtaagaatctctgttttgtccttcatggtactccgaggcagtggtctgatcctaaccgctcatggatccagatggagaaagaggtaatgctgcgcttgcttcaagatgaagctcaaaggtgtgaagggagacttgtgttatcccaaaagagatattttgatggcaaacctcgcagtctgctcatgcattttgaaattttggaagtaatggacataggctgactctatgtaaacggtctgtagcttttttactcccgtcagggatatgcatagaataccagaatgtgaatatatctgagggtcttggatactttcatccgtgctgacttcacggtatcccattccataagttgttttgtgcatgagaattcttgacagaataatcaaccacagttggattcctcatatcaaatgatgatctatgaaatgtctataagatgctttatccacctacctttccatttgagacaaatgtccacgctgaacttgtaaatggtaattggagctttccagcaaacgtaattttttccattctgacctcaagttggtcgtgatgaactgctgaatagtttggattacggatgacctgccggcttaccattctggtacgttatgctgtcacggatacttgttttttttttggtcaattttttttcctacagttcaagtgagaacaggtctctggtatttgctttgccaaattagcggcacatggtatcttgctatctactggctccattgtacttgtcaaatgtatcaagaccagtgtatttagctatatgacatttcgacaaaatcagtcttggccgttaggttacctattttgagttatggacacacgagcaaggccaaaacatgtgtgccgggcgtgcgacccatcaacctactagcaataggggggaaaacttagcaatggaggcccggcatagaaagtcgtggaattacaccatacctggaatttcatccaaattcaacttctgatcagtttcctgtatcagatgtcagaacgaactacatgatcgttccattgctggccgaattgcacagtgcagattcagcggtgaatcattcgtagtcaaaagggaagaatatcgccgtccacaccaactttacattatccatcaaacaaatcattggttatactaacaaagtactccgtaagataacaccattagtggttctgttagtaaagtagtggcactatagtatactactactgcctgctgatccgtgattccagctacactcttttaactgttcttgtctcactctctgtcgaacacctgaaccagtcaaacaacagtgtgctcgaccaagtggctgccgaattaacaaagttaaaaccggacctgcctttcatttcgttcggttgacaagttggcagaatacttcgcagtgatatcttaatcgtggcatacagtttgggggtaaattatgcctcggaatcctgtccgggcggccgcgaccggatcacggagcttggactcttgcgaacggtgtcgttgctgcctttcaggttttagacgtttagtcgcggtacaatccgcaacctctcgctgcgggacaaaactcgagtaaaaccgcacgaacggatcaaacgctagacgccatcggcgcgagtccaaaaaactactttttcgggggggacgcaatatcgcctcttgaaacggtcagttcagagaatcagagtcccagagatagatatcctttctgtaatttttttccccctgaaatgcaatgtggcatagtcaggtagtagcttatcaaatgcgtcaggttgtttggggttttgcgaagcgaatgagctcgtatactcgtatgcattgcgtgcatgcttctcggcgttggcttcagagttcagaatatcatggacttcagcagtcctgaataaaccggatttctgcattggtttgaactctgaaatcgacctgtgaacagaatcaagcgatagattcaagagataaaagcaatgctgctttcttttagtaatttcactggnnnnnnnnnnnnnnnnnnnnnnnnnnnnnnnnnnnnnnnnnnnnnnnnnnnnnnn

SEQ ID NO: 22677 - DNA, 10772 bp, Oryza sativa
atcgacctgtgaagagaatcaagcgatagattcatgcgttcaaagcaatgctgctttcttttagtaatttcactggacagcgtgacaagttgatggtcattttcctgcgacgccgatagagttttcgctgaacggggattggcactggcttcaaatcaatgcaatcggtgaattattctagctgctgtgctcgttactacccatgagacaattgcgacgggatgatgtggatgccgtggtttctagcagggtacgacagtggtaggcgtgtctgctcatttctttacagtgcatataccaatcgtatctcttttctctgcctgtctattcgtctccatccttgtgaatgtaaccacttaattacctggctctgatagcaaaatatcgtatagggacagttcgcttataaactaatccagctactgaatgaccgaattagcgtagtaatcttctgccacgattgaggacaaaataaagagtgtagagagcgcagactgcagagaagtccagtagaacaataccggtaagcaagcacgttagtcgagccgctgatgattggtcagtggtgtattctaatctggtaccctattaagtatgagagcaaaaactggaccaagcttggagaacaggagtacatactactattagataaggtgtacattatacagtgatgtagtatgtatcaggggtcacaattccgacgaaaatcggttgaattctgcgaaatttcaaggttttgatgaggcttgaaagtagaagccatatgagatttcgatgagttttatctaaattcaaatttgaattgataaaaaagaaaacaatcaaataaaatcttgtaaatagtatgatattcatagaatttattgggatataaatttttgaaaaaaatgatgtatttcacgtatttactgaaatttatagtaggaaagaaaataataacgaattaaaaaaggggaaaaataagtttacctcttttaccgattgaaatttcgattatttcgccaaagccgaccggttttcgcgagcttatcggtaaactcaagaaatttatatttaaattttggtttatgaaatttgtttggaatctaccggcttttcaccggatttcacgaaaaccgttgttccaccagagcacgaaacggaaggctatctcgaaatcgtaaaccctttatgtatatcttcgtccagttggccagttgcatgcgaacagattaaggattcgctgggaaacaaactggataagctaactcaaattaaaacgcgtggcgcggtacgcgacctggcacgctgtgtgctgtgtgcttcgctgccgtgcggtacgggtgcgtgtctggaggcaggccggccggccggccgcctcgctctcgcgttgcgttcgcgtcggcccgcccgatccggagggaccgacccacagatcacgcgcgctgacgcgtagcgagcgtccgacaaaactggacgggggccgcgcgctcccgggcgtgtgccgtactagtagtagcccgtaggacggggtccaaagcgcagcgcgcgcgacgtcgggtactcggactcgggtggccgggtggggggcgtgcgcgtgtgtggccggcgataagttggcgtttggcgcgcgtggtcaaggcgccgaacagtgtttggctgttggggttgggctggaacttggaagtccgctctagcgtttgacttggttctgcctggtccttctagcaaggtggtggcaatcacaaatttttggagtgtttgcatccacggttactacagtaacctcgtgcagtaaccgttgtggtttttttatcttagttttagtaacctcttaatttttattttagaaaaggctatacgcactaattttttcttactaaattcttactaacactgatgtgtcctatgagtgcatctaaattttttataacttacatatacttaaatcaaacggttgagataattgttagtaaaagtttagtaagaaaaatttagtatgtgtagcattgctcttttattttttagagtgtatgagatttttaccgcacggtaagtaggttaccgtggtacctgctctcggtaggagtaatccctttccaaacagtagaaatctgtcgcatggtttgacgtggattttagcggcgatgtgtgtcacctttctttcacggcttgtaaagccttgaatttggaacagaaacatagtttcattttacgtatataattttaaacgaaattcgagatttttttcacttcggttgtatttcacgtacgaccagtacgtgacaacccccaccatatattttttaatatatatagagagagtgagtgagtttagaaacaataaaatatacggcatcatcttttctcttatacttatgtttatcagctaaaatttaaattttcaaccataaatttatagctgattttaagattttttcatcgaattttattttccaaccttttattttagatcaataagaacacgtatataaaagttttattcataaattattttccgtttgcgaatatgttgtttagcttattccaccaaacagctgaatgatatggctgataattttctgaatagctaaccttcaaacacgaatggtaatccataatttccggctactgatgactttttacaaggcgctaaaaagggctaggttgtcagttgtcacgtactcctacaatctctatcagagcaaatctgttggcggcagctagtgtggccatgcatgcgtacaagctcacgcacgttcttgtccagtactgctacttctgctaggctgctacttctccgtgggaaacagtaagaacacgaaaccgagacgtgtcaagcagcgcttgagctagcggcccccctgctcgcttggcgtagcagcaggcggcggcggcggcaaaaactcgatctggtgacatgacggcatgcatcgtggcgccacggcctgctcgacacgttggtgaacggctatcgatcgatcgatcgatcgatcgtttcgtcgcgatcagcccaatccacgcacctggtcgtccggcaccgcttcatttaatcgttgggcgcgtacttcttcccgaagttttggtacactcatctttttgaaagaaatactccctccatacttataaagaaagtcatgtttaaatcaaactttaaaaatataaatcatgaataactcttaagttattgagtttgaaaatataaaaattatatgaatagatttgtcttgaaaaatactttcataaaagtatacatatatcacttttcaataaactaggaaggtagcccgcgcattcgcgcgagcatgtatcgtaggctgcatttgagatactcgtaagtaataggccgattgtgttaaaatgtcgtatttgttatatagtaaactataggcatatggatcttatatcgttggtttgattataaacagagcaatagttagattagaaatcaaacgtgaaacttataattatagattatttatattttagttaaataggaacgtaagagaaatgaaaagtgtagagcttgagccagagaggggaaggagcgggtgtgtagtgatgggcgtgtgtggaggggatttttttttttgtaatttttctaagtgattaagtgaaagccaattattaaatgtaattttcctaatatttgcaagatttttttaaaagatgtgacatgccacttatcaagatatatttttctaaaagtagattatatagttgaaaataatgttaataggtcatcaatctaggtgaaaactgttagctagatgttttatttttttcttttaatatataagattttactaatttttaaaatgtgacacttggtaatttaacatgtctctaaaaggtcatacatgatgactttgtatttttctaatttttattacgtagaatgattaagatgacataatacatattgtcaattttttaatgtttcagtgttgttcgcttgttggtctatgttaaaattaagtattttaaattttacatagtaaaatatgagtaacataaatcaacggttcaaataaattaaaaataggatgttatttgggttgtcaggtaaagaataggtggcagttcaaataacacattttattttttaaagtgaaatattggtaatattgattctaaattatttagctgtctaattatgaaacaaccgttcaaacaaactaaataaaaacagatatactacctctgtttcagtttcatattataagtcattttgaacttttttaagtcaatttttaagtttgaccaagtttatagaaaatatagtaaaattttcaaaaataaaaaacatattatggatatatatggaacgttatatctaacaaaacaattttgtgtgatagatgttgttaaattttttatatatttggtcaaatctaaagaaatttaattaagaaaaaagttaaaatggcttataatatgaaatagagggagtaaatttttaaaattatgattattttgctatgtaactattatctttttttttaaattgttagttaaaaatagatttgttatttataaaagcatgcatcagatcattaatcatttatatatttaggcatgggacatgcaatcaagaatccacagccattctcgtgagatagaagtgaagaaattaattattaagtaataaaacaaaaatcttaactactatagagaaaaaaaggaaagagatgaggagaagggattgaggggaaggaaatgagaacgtacggtagtggttgaggaatgatttttttatgagataaatccaattggcccaccagttcaagttatatattttttttaatttattagagtgccacgtggtggcttaggagtgtttataggaagtttaatgaacttttagtatataataatagatagatagatatatatatatatatatattatatgttgttaataagtatttaatttatttagatggcatgcaaacttgcaaaatgcaccgtctataccacaataacatattgcttatatatagcaaaatattggatgtaaaattgtcaatttaattataaatagagcaacgttttaatagaatataaattagctatgtacatttaaattatggtcaacttaactcgtttttaatttgataacataaaataattaagaagagaaagagatagagatataaaagaataggaagaggaagagacaggagagcgtactacgttcttatggttttttctttttccggcccatggttatacgaagccacacgtatgcacgtatgtttttttctttttctgacccacaacagaggaatggattactttcttaaataatagatctaatctaatggtctaaaatatcgagtccaccaatttaagtgaaaatcgacggtaagattatatagtgtcatgtggcggtttaggagtgtttgtaggagtgacacgtggcggattgagagcgtttgtaggaagtttaatggacttttagtatataatagatagatagatagatagatatttttatagaaaaaagaagtcaaagttgtgttttggagaccgtgtcgctgttctaaacgatttcttttacgagtatgaagagagtactatattatttgaagaataaagaatttattaaaactagactattgcgctaaccccggtaacatcgagataaagttttcggatcaaatttgccaaaatttcggcactcgtccgtcgtgcgttgatcgctccgagagtcgaaaaaagaaacaacgcagtgccgagaatcgaggtaccaagttatacaagcccaagaaaaaaatgcacacgtacatcgtacgagcctcgaaatgtacttgatggaacttaaatacggcagcacgcttcatcaagtatttcgtcgtgcacctgttcccgaagccccaatggatggatacagttacgtggagtagtcgggtacgtacggtacaagcgctggacattctcgactagctgctatgtaaggttatgcatgtgaagtactatactacgtatgtacaaacttcaaattgtacataacactagcccgtcaatgactccgttatatgaaattttggaactatttggtatatatgttgaggaaattaatcgtaaaatatagtgttattaaatttggtaagctcgagaatgtgaatgagtttttaagaccccataatttggtatagtttgatgagtagaaggttccaaaattgttaaaattttgacagggattggtaaaaacgtgatactaagatttcgttagagcatcaccaacagtatcctaaaatttcaaaggtcaagaaataatttaatcacctcctcgattgatcacctctatgtataaaaataatgtgataggggatttgatggtagaagctttaaaacaaagtaaatttagatgatgatattttagttaatgtacgcatatatgcaagttttataatattataagatacggtgagaaactgatatgcattatatttggggtggagtgaatattaactattacaaaactgtcgacgtttgatgtcgcgattccggtatttgcatagtatgagaatcgttggtactaggatatacgcgagactgaggtaaaagagacggggacaagtatttttatacaggttcgggccctgaatgtcaggtaataaccctacatcctgttggccgaagccggtcgttgctcttattcaccataatcacaccagtacaaaatttggggtagcctatctaactgttgtcgacatggcggtctgaaggtctgactcgtagtcgacaacagggtagtcttcctcctcgaatccgtgcccggcgagatcaaagatagcgctttcgtctctcctgacagtatccggagacaccgtaggggactagctgtgcctatctccgaattcgatatctggcgtcttgtcttggcgtatgttggcttgtattggcttgtggctttgtggcgtctatgttgtccgtggtgggtatgtcccctctcctcctagggggctttgtatttatacccatagaactagggaaaccaatatgtatacaatccgagtagtacttgtcgtttccatgtagaagtttggttgtctttccttatctggaactcctcctatatccacatgttgtttccgtataggatatggtatgtggtgggtcctgccgagatttagtcaactactattagttatgtggtatctataaccctaacgaaaactgaaatgtagatttatttattttttagaaaaaaactataaaatttttatacaaaacacatcgttcgataattcgagaaatatacccacgaaaaatgatggattacctcagtccatgagctgaatcaaacacaacctaagttagacaccccagcctcgttgccgatgctatgctactcttcacagtcgtaacgcacagcacacggcccccagtaggtctcgcccatgtcagcccagcacccgtgcacgctcacgcacacagccactgcacagtgcacgcacacagcacagacagaagaaaaaataattaagcgcgggatcaatcaccatctcatcttaactcgcaacgcgccttggatgatcaagcggcgccgggcaaaaagtcagcccgtgacaagtgttagctagctagccactctgcaacggtgctgccaattatggccgtgagatagctagaagatcgatagctgcagacaggaagccaggcacgctgcgatgggaacgtcgtcgatcaggtatagtcgatcgttgtaccaccattttgccaagttgcgagaccaaattaaagcatggacctgatcgagctctccgacctcgatctcttattttaccagtgaaatggtggtcacacacacagcagctagcaggcgagaatcgtgacatccactgcaccgcccgggctcgccgacttccctttcgcggtgagtacacagtagcgccccctgcttggaacccaatatgaccagttcgatttgtcgtgtcaagcggcctaacctgctagctatagcatgtgtccacagctagatggtactatatatcagtactaataagtgtgcctacacaaatctttcgtgtctatatggattaattaagttattgttgttgtgaatgggatttgatcaaaacgtgaaagtcgatcagcagggctgtatcgcggcaactgtgtgaaaccatgattttaacggggcattttaatttgtcctgcggctgatttaatttggtaagcagaggtatactactgagaatgaccttccacataaagcagtgcatacagaggatctaatattctaattcaaaacatgaaaaactagccacagtccacagaccacctcgtcccaatactttacacatggacatcatgcccgggataagatctgatttattttgatacggtacagaaggaaacattttccatggactaaggtaagtacattagatatatttatgtctgtgccacaaataattcctcaacaaatttgttggtacactgcataaattcgcatgttcaatgagtatacagaatgtgtaattatgcgaacagttgtgtgtttgagtttgtgttctagtcaaagaaaaggtacggatcgactttctcccttggtgagatcaggaaaaaaacagaaacatgcatctacgtgtaaaaagagtgcagattgagtctctctccacgtggtaggagaaatttaggaatgtcatttctgtggttcagttaacgcaaccatgcttatctcgcttctcgccctatacatctagctatcctttatacagttataactgcccaacacgaccccttttgagttttgaccgagatggggagtagaatatactcctagctagtcatctctcactgcatgcaccgtatgtacctctgtgataagttacacagatgaatgtcacaaaagttgggaaaaaggattttaatgtacactttcttttaacacgtggttcaaaaagttttaaatatttttaaaaatatagatagaataaattattatgttatatgtccctctataaacatagagaggtttaactcgatctacgtgaaaaaaggtcaaataattaaaacatgtcactgtgtgtaatattttttgtgattttaatttgatcttgcaagtttatatagtgatattaacatcacaatcgtctatgaagtctgatttttagaatttctttataactatatatttagcacgcatgaaactatggtgaacatgtttaatttactttcatctaatagtctcactattttacaaacttaagtcaatccgagctacaaaatttactgcatttaaccttgttaattagcaagggcaagacatagaacctaaataaaattgggacccaaatcttaatgaggcttgtgtccgaaaaaatgatatcttaatagaacaatcattggcaaagtcttatcttaataaaacaaaatagagaaaatagctacaaaatctactcttttttttacgtaaaatagtaaatacatctcaaccagggtttaaaatttcatttgagctatttctattggggctaccgaatggaccaaaaatttgtctgagataatttgaatttttgaacaaaattttccaaattctagaaaaaagaaatttgggcgaaatttcgaaaacttctgtatgaaaatttgaatcatgatctcaacccaaatcttttgccggttcgtacatacggagtatatattattaatattacttctagctccagtaatactaacttcactgttctatattaatatttgatatatttctaggtttgataagaaaccatatgtattcaagttgtatagtaagtgaaaagcttaagcctgctttggttatatgatttattttccatttttagagtctaattaagtcaaaaagaaaattttacagctactctaatttcggttgtgtttagatccaagggtgtaaagttttggtgtgtcacattggatatgcggacacacatttgaagtattaaacgtagactaatgacaaaacaaagaatccgcctgtaaaatgcgagacgaatttattaagcctaattaattcatcattagcaaatgtttacaatatcaccacattgtcagatcacggagcaattaggcttaaaagattcgtcacgcaatttacccaccatctatgtaattagttattttttcgtttatatttaatactttatacatgtgtctaaacattcgatatgacagggtaaaaaattttgtcaagcgatctaaacaggacttcatttttcacaccgggacagcaaaattgccacaagttatttcgtatcaaatcacacgacccaagtaactagtccctacatgcagctcgtcaaatcaggctagtagtggctttgattagtgcaagccttctctctgattactctttgctgcttaacgcggaaaggggaagagcgagagagagaaaaaaaaaatctttccggccgccaacggtcaccccctataagtagaggagcccatcttagctttctcctcgcagatgcaattgcgcgaacacctccaaactcccgagtcccctctcctctctcgtcttcctctccacgacgacctctccgcttaattgtgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatccccggcgttcttgccgcagcagccgatgacgatgacaccggctgggtacgtggacatggcgaatgatcagtatttgggtgcgca

SEQ ID NO: 22678 - DNA, 9059 bp, Oryza sativa
ccccgccgccgacgacgtcgacccccggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactatactgtacagaggagagaagatagtatattagcgcatgcatgtgacgggtactgaatgtgtgcatcgacataggtgttggagatacactctagatatcttgaaaataataagaggaaataatagtataggatgggtgataataacattgtaaattaattaattaaatgaagagtaaatgtgtactagtttgttttatgttcttttcttgggatcagatcgatcaatcggtgtctatccagttgtgtttgcctttttgcgccataaatttgattatgacttccgagtcttcaaatagccagggtaggagacatgtacaacgcacaagattttagtcatatgcatctagatgctgtaaatgccgtttgcgagaaaaagttccatatatatcttctgtgctttggatcgactagctctggccagaagtgtagtttaattagccacatcgaaatgagatattgtacatttccgtttagatgttaattcttgcagaaacggaaacaattctggttaacttcaagcaacaaccttatgccatacaggtcgatctcacactacaagtcatcatctagtacatgtgcatacgtactaatcagtaatcacatactagacgtatgcatacatcgatttcatctacagcgtgagtcatgcatgtgtgatgcacacagctaacaatcaagaggttgaactgagttagaatttcaaacgatgtccacacttgatttgattttcttggacgtgttcatatgtgcaataagtctaaactgtcaccagtaattctgaaagaaacacacgtacatactattgatctgtacgtacgtacttactataggtgttggtctgaatgtagtgtgtttcaaacagttgacactgatatacagtagcgtgtttaatttgtggattgcatgtgaatttttatgttgtcgccaaaaaatttaagttccagcctcctatcatataatgtcatattgatgtccacaatgtaaattcaagctagtcaaactatatgagtggccaaagggtaatacacctttaaaaagctaatgatatacggaatatgatatcagaaacagatgaggtttgcacataggtaaaaaagtttgcatgtgtttgctttgttgactacttgagtcttgagctagcatcaacccaaattaaaaatgggccttgaacgaagcttaaaaccctttagataagtctcatgcatgcatatatgcaatcatgtcaactcttgtcaagattacgtgctggtaaaatactattgagttatatcgtcaattcgtcataagtcagaacagaatccagatagccacaacaaagtgagtttactgccacatggttgctcggcgtcagtttctttgcacgactggaataacctaatcgatcatgatctaattttaattacattgagaaaggatcgatgccctacggattagtattggtcacttgttatggaagatggcatgaagctgctgcttatttttttcttacctagcgagggaacagaggaagtacgtattccctctttttttaagttgtaatttagaacactgatccaataaacatatttttaatcattggtttttctgtcttctaaatttattttttagataaaacaaatatgtcaaaaagaaaacaatacgaaagatgttatcaagaacactaatatatactccctccatcccaaaatataagtatttttaaacttcgacacgatcttcgagatgttactttgaccaataatatctataaaaataagatgttttaaacaaaaagatttgcatattatgatagtttgtttaatggtaaatctagtaacatcaatttgacatgattaatcttttttatttttttcgttattaatagttaaagtgaaaaatatttaacttgttactatgccaaaaatgtttatattttgggacgctgggagtactatatatctccatatatcaaatccttctttcaatctgtacatgcatattagagattagatattttgaggtttaattatgcatattatgcaacattatctatttgagaatggagccaatatctgtgtgttgtacaaagagatgcagtgaaattaacctcactcccgtgatttcatatatcacactaccgcatccaaactcaactgacagaaaggataactacagatcgtctccatgtacttggtccagcaagaaatttggtactgcaggacaacgtgtcgtcagtgaatgaggtggcttagcctgcatcactccaacgaacataaagtaagttcagtttcaacagtcaacggctccacgttgaagagatcaaagtgctcatctataggggaactttgttcgtgtagcattcacgtgcatcgatcccgatgcacgaggtgcagtatatgtcagcatgctggtcaagaaatgaagcattgatcaatcgatcgaccgggccgttgatgcgttgagaattataccctactacacgaacaaagggaaaatacccccatattgtggtcgttttcccttgctttccgttacagaaatcaaaacggaaatggttctaggcttctagctagctaggcgcgtactccctccatccaaaaatagacaaaccctgaatttccgtgtccaacgtttgaccgtccgtcttatttgaaaaaattatgaaagaaattaaaaaggcaagtcacacataaagtattaatcatgttttatcatctaacaataataaaaatactaattataagaaaatttcattttagaaggacagtcaaacgttggacacggaaacctagagtttgtctctttttttctttttaagaaggagggaggatctgtgtgtgaaagaaacaattagaaaccatgtttgaaacatgctggcccaaatacatgtcaaattggctctgaatttcatgaagcacagcggaacaggctgccataggacataggtactccatccgagacaggggaaaggctaaaatggccgaagaatgcactcgcaattttttgaccaaaagtattcgctctacaacactagcccgtaaccaacacgtccaaagttcgatacgccctactcccccgttcaccatcagactaaaaaagcgtacgacgccgccgtcaacggcggcgttggtagcagcaaaaaccgacgtaacaagccgcaaaaccttaccgacccaggatcgatcgatcaagagctagcggcgtcaaccgggcgaagaaaaaccagaaattttgaccgctataatcatgaggtgatcagagaccgccggtcaagctgtttacggcctttgcggtgtgcgatcgaattgaagctgtagctagcaggggaccgtgctggccttgtcgctgttaatgcgttcgtaggcagttagttaaaccggcacaggggagttttgacgtttcatatcgtacacaaccaatactaatggcaaggtggtgctagtagcaaggtgctatttcatacagccttttgacaagttgatgaagaattggacttgagagagtagctgaggaagaatttcgaatgggtatatatggtcagagccaatcggacatgagccggttcaaagtaaacctgaatgctgtttcagcacagcctagagtcaatttaaccatggttcagaagtacacgggattcaaattgagatcctgaaactaagtttgctactagtattatcaggagtaggttaatttagtagtactacgaaacaatgttccagtaggctctagaacgaatctttacaggaaataatcttatttttctgcatattgaataaatttcttgagattaaatatattaatcttctctgtctcaacgctctcattatgtcttttgtcggagcaattaaaagtcagcgtccactgtaattttgctggctagttttagttgacagattgaacactcgaatgaggcacaaacccatagaattcacttcattttggcatcaactttcttcgtttcataatcacgagaggcaattcagagaatcagaaacagaaaggtgagaggaaagcgagaggctttacagtacatggctacatcatcaaggtcaaagcgatagcgatcgaagggctagctaatctgcaataaatacgcctgcattccaatctctcgatatcgctctatttttatttctttatgtgtgcaagcaaaaaagtcagaaatcttgttagagaatctgctcaccgttggcagattgaggctggaaccaggagatgatgacgacgacgagctcttgcaagaaagggactgcaagcagatagagggccaagaaaaatgttaaccaagagaaccttactttgatgtgcatatgtgtcttggtctgatccactgtctcctgcaattaactgcattcttacaaataattcaatggttgacatgcgatcatgaactgtcgtcagacgttgtcaaatcaaaccaattgaccctagagagacgacctctgccgtacatgtacagtgcccagcagactatcgagagtaagagtttgacttaagtttctctttattcatgtcgctctcgccatgggagaaaaactaattaaaaaaaacaaccaagaactgtctgctgaatgattggtactgctagcttcaaccttgcatgctgcacatcgactacgcgtgcctgcacaatgtacagacgctgttacgcatgtaaaatacgttgcctgaaactttggcatgcaaattgcgttgtccttgagatgaaaagaggaaataacaaaatggttgttccaaactacaaacagaaatctatatgcaagtactactaatgttttctggcaaacaatactgaatacggcgtgcgtgacaaataatctcggatcacgagttttgtacgcgtgcgtacgtgtatctgaactgttgtccggccacaaaaccccagcctccgaagatagccacacggcacactgcaaaccaaacgtgtagcagcagagtgagatcgacagacggcatcggtcggcatccgatcccaacaacaacattgacaatcagagcgaaacaggtgttccccaagccaccagttttaagtcagctactcccgctatttcagattttataatcattttagttttgatcaaagttaaactattttaagtttaatcaagtttatagataatatattaatatttataataccaaattagttacattaaatctataattgaatatatttttataatatacttgttgggttaaaaatgttactgttttttctacaaacttaattaaatatggagcagtttaatttttaccaaagtcacaacgacttataatatgaaatgattataatgtgaaatgaagggagtagctacttggcggcagctacagtaatgaagtcttcacgcaacgttgacgttctggagtgagcagtaatcgagacgctacgtcgtgttccgcagtagtcgcgctcgtaaatcgaatccatgatgcggatcgacggcatgcgagaccttgttgtcagtgtctacagtaactgccccgccgtcgatcgttttccgtggcgcagcagcagtactagtagctccaatttgcgagcccattaatgccatcagctttgccggtttgaggttaaccccgtacacacgcacgctcgctcggctcgatccgtcgatcggcattgcttctgtctctctgtgatcccgtgaaacaggccggtgatctgacaccaaaaaaagtgtttgcgagaccaataataatagggagagatgagagcttgcgaaacattttctgatgctcctcgctgggtgtaaacgcctcgcgtcgccgccgccgccgcgcgcgccggcaaggcgcgggcagccgcacaagtcacaacctctgttgctaccgcgcacacgtacgccgcgcccgcgcgcgcggcggattttggctggaggctgccgtgatctgtacaatccccgtggaaactgaaaacccggatttttccaacaacatcaaaaatttttcctcggtttccgttctaaactccaacaacatcaagatttttcctcggtttccgttagcacacttttcactaaacggcgtatcttgtgcgaaaactttcaggagaatagctaatatagtccctaaagtttcgctcctgggtcattttagtacttaatctttcatattgtctaaacaagtcctttaaatttgttatgtgggctaatatagtccttggtcccaccaaaatcaccacatggacatgccatgtcaccttcgtacgcaaaatctatatgatttgtccaatttacccttacgcataggaaaataaaaaacaaaagaaaaagttaaaaaatatatggtatatgtaagagcaaaaatatacctcaaaagggtgaaaaaaaagaagtattttttctatggttatgtctaattcacccttatatttatttttctacgatatatgtaagggtaaattgaacaattcatcatagattttgcatgaatgatgacatggcatatccatatgatgattttgatggacccaagaactattctaggccttatgacaaaagttaagaatttctttcgaccatttaaaatgttagggactaaactgatcctacagataaactttagtgactaaagtagctattctcccaaaactttctatatagaagttgctataaaaaaacaaataaatccattttcaatttttttaataattaaaacttcactaatcatatgctaataacttatctcgttttacgtgcgcacttaatcttaatccgataagcagattcgaacggggtcgaaaacacaaatataccgatatttcgattaagttctttttttataagaaaaatcgaactgaactattaagttttggtaatatttgtttggattttattagtttttatcggtttatcaatagttttcgtgaaataccgctcttgagcggttttgatccgatactcggagtcgtaaactctggtgtcatgtacggtggcggcgggctgaccgggtggttgttggtatgtgcacacggttgccccgggcgttcaccgttcgcggctgggggtggtgtcaccgtgtcagcaaggtgagattttggggtagagggccactacgtgacagctttgggccgggaaatccgaagttatatccacattgcaacgagaggccgtccagattgtatcccgttttgcaggtgaaaggtcgtagctatcacgtatgagggcgagagaccgtccaagtggtgtaccgtttccagatgaacacggtcgtaactggtatcacgtatgggagagctagagaggtgtacattagctccgacagtggcttcaggccttcaatttggtcagttccagccaaaagcaaatacattgccgctaccatgtggtgtgaaatagattatctgattttggtgtaatatttgagggtacatgtaaataaattaattactataaagtgcaaaaaatgtttttagaaagtattctaagcaacttgtacacgcaaaattttgtaaaatcaaaccgtttaggagtttgaaaagtgtatatgtgattatctataatctgtaaggggaaaagaactgggcctctgtccagggcattggagatgtgagagaaatagagaacaaatgcaatgaaaatagcagcactttgctgtagctgtagcagtactgaactttatcacaaatcaaacggccgtacaaataattctaaacggatatgctgcgtgtaattccaaatgcatgttgtgcagtgttgccatctgccatactcacattttggagtcagtccgtaatttggagtcaaatgtagcctcacattttgtagaccctgtccaaatgcctactatgcattacagtggagatgttctatctagaaagtcagataaaatggccctccatgacatgtgaaattcacttaaactctttttctttcaaagcaccaaacttggttttatccataacgagcagctgggcatcctattcaccatagaatggttgagcctaaatcaaagtctcctattttgaaacaggaatatgaattgccattatataatgataatttctttggtataagaaacaatattatcgaaacgagataggcaaatcggcaggtataaacgagtgtattacataaggtgttacataagatcacatggactaatacatcatagttcagtactctgtaacttttaacttattccaaaaacaccactgatgacacacaacctaggtaaaaacagcagtacaactgatggacaatcgcatagaggtgcaataggttcaaatccacaacccagtcttacttgctatctgcagaggcctcgactatcttgacagcagaccaaactcgcctgtaagttcaatgacacgtcatcagcgtatggcagtaaaattgtgaaagaaaaagaatcttgacattgcatcaaagcaaggtggaactctgcatccagtgccgactgccgaatgaaattgatgtgatgtttaatgaaattaaacttagtttcaccaaatttcagctgtatggaattcagacaaggtcatccgaacagtctagtccttgataatgtccacagaaaataaaaaggatgattgtccaaccacagcagattacaggaaattgcatctacagaatcaaagtcttgaaattttgatatatg

SEQ ID NO: 22679 - DNA, 13638 bp, Oryza sativa
ttgtaatggtttttttctgaataggcaaatttgcaatggcatggatccaattaaccccaggttcaataggggaagagaacccatgtagtttgagccatagaaggattatcttgatacagtttggatgaagggcagacatcacttattcactttcaaactactgtaagggatggaactgtttggtaattgggttgtgtttaatgataaagcaaagacacagagagaaacttgatctgaaatgctctgcatcatgtactagtaaaatttaagccctatctgtttgctcttagcctctgggaagccacagctctcagaaatggactatcaacaatgcatcaatttaaacactgcatgactagggtttcaagtttcacttttcaatgtatgaaatttcagccaagcattatttcaaaatgagtagaaaaactagctcatcagacaatcaccagcatagtagaacactcagagcagccagaaatgtagtatcaaatcaaatcaattgcttaaagatggacatcagcaaactattccaagagcaacatacagtacaacagcaaagtgtgctatacataaatgtacatatttttcattccaacactgcagtacttccaatgtgtggtgattacccagtgcttaataggctacatattatacactagattagtatcatggaacaaaatttctcagagaacaataatatttaaaatcacacaactgttgtaccctaaaccaggttacctagatatagtatattgcaataggtgctattgcgctagagctggaaactaccagatgcagttggagaacaacatgcataaatctgttgctccccaactgttactcctgttatcgatcaatcctggggttatagtagcagaacttacataatagaaatcagtaataaaagatgaaattttgttgcttaataggaattagaacaaaattaatatgacgattgaaatgtcctacctttccctcacgcagacttggatgcgatcattccggtcttccgggcataggcaaagatcccgcctgcctcaataaccggcccggcatcgccgataggcttcagcttgtactgcttgccggatgtgtggttgatcatgacgcaattatcaagttccaccgtgaccacatccccggtcttgcactccttccaggctccagtgtccgctagctccaacgggtagacctcaccggtggccacggagttgcggaagaagatgcgcgcgtagccctcggccacgacggcgcgggcgccggcggcgcccagggcgacgggcgcgtgctcgcgggaggagccgcagccgaagttggcgccgccgatgatgacggcgtagcgggtggtctcctcgccgggggcgacgaacggcgtcgggtaggccccggtggggaggccgacgaaggcgaacgagccgagcttgcggtactcgtcgggcttggacgggaccagggtcaggtgctcggccgggatgatctggtcggtgtcgatgttatcccccacgacgaagcactcgccgtggaatacgccggccgacgtcgagtcccccgccgcagcggcagccgcagccgcggcgaccacgggggtcaggggacgactgtggtggcatttcagggcgggccggcagatagccgcgacccagctgcggcggcggaacgtcctcgagggcgtgggacacggtgccagaactgctgtcaccggcgccgcctcggccaaggatagagccggagccgccgccgccgccgccatggtgttcagtgtgtgagggagaacccgaaccgtgagaggcttagggccggggaccgtgaagcaaaagaccattatgccccttctccccaccggccttgggccgtaacgagatcgtgggctgcgtgaagccccattattattaggccggagcgggatagttgggccagaatgggagagtgtggcccatggctgtcgtcagcacagcacacgattgttgtgctgctcagactttacgatttgaattctgctccgattttatttttttcccgactagaagaaatgtccatgcgttacaacagataaatgctattttaattttattactgttatacggtttatttaaagtaaaattcactgtgggaattcgtttggatatatattttcttagaaaataatgagctgcagttaggaatctgatcgtctaaagttagcatgcgagtttttttaagggatttctatacgactcctttgcatttctaaaagcaaacgaacttaaaaatcgactcaaatacggatatatattttcaaaagcgaacgaacttaaaattcagactcatatacgaattacgtaacaaaataccagaaaaacatcttcaattttataatagtacagataaaagttgtgctccgattgtgcatgcatgtgctgatttggagggagtgatattgctgcagttttttagctgcatttgaagactcactttttttttcgattttaaactttgatgaataatggataatcgagtttaaggttgtgttctctaaagttttgatggataatgattataaataaagtctataacatttcacataaataagagatttaaatattagaaagttgatttaaaagttcttttttttaagacatgttggtaaagaaagtttttgtaaagattatgccatgtaaacacttagcaagctcaagtttttgataaaatataaggagagaactccgcgttgggcacccgatccgggaggaaaatatcgggcactagctacaccatcttatctgggcaaatttgcatgcgtccgttggattgaagaggctctctccatgcggatgaggtagatttacgctcaggcacgcagcccaagaacaaaatattttaaactttaaaatgttttttcttgtaaaatatttatctcatttatgatccgagtacaccgttaaattcgttatgattaaatctttacaacaagaccacacatggttatattccattgaaaacaatatttatcttcttagtgatttttaaatattgcaccacgttttataaagtttcaactactagtattttacgatgcttcacctgtttaatttataagcgttgcagttggttttcttttagtgtttcactaagtattttataatgtttaaacagttagtacaacttaatattttacacatgatatagaaaatgtttcaataacatcaagcttcagacggttaaatatttcagttgactaccggtgaaacattgagatatacatggtaaaataaaaaatcagtcactgaaacattattttttttaaacacacagtgaagagacacattgaaacatattgttatcgcgtatgaaacattgagtgttaacaaaccgaaacatatggggtttttcatcatagtataatcatatgatatcttgttgtaaagatttaattgcaacaaatacaacgatatgatcggatcatagattagataaatagtttaggagaaaaatcattttgaaggtcactagatgcatgcaatctagaggagagagagaaagtatgtgtagttaattgtgtgaattttatgaaacatggtaaatgcgtacattgaaccatgtccatatcacgcatgaaccattgagttttaatagtttgaaatatatgtttttcttttatcagaatataactatacgatatattgttggaaagatttaattacaatgaatacaacggtgtgatcggatcgtaaatcggacaattagtttaggaaacaaatatttaaacaaaggatgtgggaagctataaactagctagcttctagctatagcttcgtgcatgagcccgatttttgttggctcaatcaatgtaccgattcaaggcattttctaaaatataatcatgtaatatactgttgtaaaaagatttaatgtaacgaatacaattatataataaaactatagattagataatagtaaattagaagaaaaaaatttaaaattttgttatggaaattattatagagagaggtcagagagacaacgggtatagtatcaagccaaggacacgagctgcgaacaaaaggggaggaagggcacaagatgttttgcgttttatcaggcgcatgatgcgtagtctcctaaaaaaaagtgaattggggaaaaagtggccgccctcgtccgctgcatggatccacgccctagccttgcccgttgatggtgggcgggcttcgccggcggcggggtggagatggacaccgggaacaaaggcacggcgacaccggtgctgctcaacgtctacgacctgacgcccgccaacgattacctctactggctcggcttcggcgtcttccactcgggaatcgaaggttcgattacatgcattcttctccgttccccttttatctcttgattgggccaaatcttcatcgtgttatattggtcgccactctgttgcaaaaaaagattgatgttctatttctcgaacaaattatcgatcatgatgatgctttgttaaaataaaaaatcattttattattctgctgtaggatcaaattagatgtttcagtacctattgcaattaattgtagggcaactcagttttgctcttgctgatggacgtacagtaataatggggaaaggggaaaacagagacaatgtaagtcttggtagcaaatggtagcaaaattggaaggataattatgcatgtagttagtttttaatgctatttttcaaaggaaaatgatcacttatgtcagaatctcacgaagggaaaaaaaaacactaaaccgtggcctgccaagcagtttgcaatgcataggaacctcaaaatgaatcatagccctatttggatatatgatttctactatccggctaaagcaagcacggcgcgtttaaaattttttttcttatcgattatatttccctttttactatctgactgtcatgtcgtgatctaggtagttcacagaattatgaactcaagttgttatttatttttcttgtctcaaatgagcagttcatggcatggaatatggatttggagcccatgatttcccatcaagtggtgtttttgaggtggaatcgaaaagctgccctggctttatatatagaaagacggtgtggctaggcacaactgacatgtcccatggagagtatcgctcgttcatcgaaaagcttgcagggaaataccatggcaactcatatcatttggtttcaaagaattgcaatcacttcacggatgatgtgtgtaagaacttgactggaaaacccatacctagctgggtgaatcggctagcaagagtaggttggtattgctagcatgtgttttacttcctgaattggtgaacatcgtaagcaattgaatttttttttttgattgaatctgtaggttcattttttgattgtcttctaccagaaagtgtccaggtttctcctgttgggcgtgtcccaactcttcgtccagtagctggtcagtatcttcctaatttttccctctattgtttccttccagaaaaaagaaatcctctgttattattatatgtgatgtacaattggtttttgttagaaatttattaaccaccagttgcagtcgattgattggtttcttttcatgatccagatgatgatttggattcaatatccacagttagtgacaacaatgaggaggacaaacacttgctgccagcaccgtcgaatgacctacattccgtagatgtaccattaaagttagccaaagatgttctttgaattgtttcatattttcacaaaacatgccatattatcatcgcaagtgctgcagtcggggtgctgaattgtttctcgaggtgacttcataggacaacaccgttgagcagaggttcccgttcgtgatactgatttcttttttcagagtttcctgtccaagtaggtacactgtatacaaataggaattgcccatctttccagctatttgttgtttcactatcgtacagtgagattgttgtatcgtccttgctacttttttatggaatatcatccatgctactttggtagcaatggtatgacattagtccatatgtcatggcagagctggaatagacatcgtactatggctatatacttatatttttctattagccttgtgtaaaaattgcttgtatgagctcggaaatgagaatacacactataacttactatcattttgcatcattgcatggtcaatgatttgtgtaatcatgattggttttgttgtagtgcagatgaggacaagaggctgccaaacctcgattgatttcaataagctacacatgaaattataaataggttgtctacataataataccagtgagttccttgcaaaaaaatattatcaatgaattacaatagattagagattatgattagaaattacaataaaattggtccatcagttggcgcgcttgtttattccttgcccttagcccatatatgtaatttgcatctcctttacaatctaggatatttatatgattattacaaaaattagttaaatgaccataaaactctttcgtacaatatattaatggttttgaaatttctaatttaatatgcaacggatctatcccgaagttccaatcatagtagagaattccattatattttaaaatattaaaagccctttaaatttcctcttttcatttgtcatgcttactagtaaaggtactattcacgtccatgtttctcatatcactaaccaatatttagataaaataatattaatattagtgtaaatattgtagtcatccattgtctagttgtatagtaaccgcacggcctatttaatccaaataatatagaatgagatatttcatccaaataatatagaatgagaatcgagtcactttatctaggttcctcttctcgatagttctgcactattcacgtccatgtttctcatatcactaaccaatatttggataaaataatattaatattagtgtaaatattgtagtcatcaattgtctagttgtatagtaaccgcacgacctatttaatccaaataatatagaatgagatatttgatcgaaataatatagaatgaaaattgaaaataatattaatattagtgtaaatattgtagtcctcaattgtctagttgtatatagtaaccgcacggcctatttaatccaaataatatagaatgagatatttgatccaaataatatagaataagaatcgagtcactttatataggttcctcttctcgatagttctgcttgaagttatttctttgtttttttccacaaagcacacaatggatctttaaaagctagatgtgctcaggttcaccaaactgttttggatggggttaccgccaccccatggtaagaccccacggtaagacggttatcgtggtaaccgcggttacagtgaggtataatgtcacaatatatttgtaacatattttaaaaacatgataggatttgaccaaataattatagttttgtgacatttgtactaaatataattattgtattatgtatatacaaatacaactattatttttttcattaatcaatgtaaaatttttaggcgaccaaagcaaacacagtatcattgctaagctatctttatcatataatagatagattattttcacccattgcaacgcacggacattattgcaacgggcattttgctagtaatttttataatagtagaagaagagatagggatagatagagaagagattggctgaggttcttgccgtttcttatctatttgaattggaattcgcctttgctctgttacttgtaatcaaaccctcctttcaccggttctggactctagtggtaaatcctttttgtacttgttctggactctagcggcttatgccatctatgagagttcgagttcatcccaaattataaatgcaatgtcgggtttaactatacccaaattataaacgcactgtcgggtttaactagacaattgcaatgtcgggtttaactagaaaattatttgagccattttccgatctcgagcagttctcttcagctaaactcgatcgagaaatcttagggcagcttggcagcttgaatagtacatatacacaacccaacaaatgtttgtatggaactaatctaggaattgctattgcgtatgtctgtctattaatctacctttttaatttatattatatgctactcacatgattttttttatttatgtttaatttgttctatgatgtgcatcaattgtctgacaattatttttgggcaacaatggtgaataaataaatcattttaagtgtaacgatggtaaaacatttgacattttactttcataagcaaaaatctggaatcgtgcacctgacattttttagtatgatcttattttctttgatcatattagcaatgtatagattacaagtattttaaatgaaatatgttacgtgatatatactcctaataatatgcatttgcacatacttctaaatataagatagaataacatctcttattacacgacttatgcatttgcaaatacttctaaaaaagtgttgcctaacacaaaatatatacaattgtagataatgtaagtgggttgaacaatatatatagtgtattatgaccattaaattcataacaaatgtcacatttatattctttatataaaaactatagatagttataggactatctatatataaataataatgcatacaaatcttattaccatacaacatcctaaatactttttggaaaaaaaaaatctctcctgatttcaaaaaacgagttaagcaacatagatatataaagtattatttgtatgtacaatatttgcaaataaaataacacaatcttatatgtgaaaataaattatatacggtgactacagagcttgggcgcgggtctacttacactagctcagggtgcaagcataagtggtcggagctagtggcattgttattgaagatggaaaagagcaagcaaacaaaatagaaaaagaaatgaagggacaaatccttaatttcacactgcattatggcaaaaagaatgaattggtattacaattatgaaatcccacttatattagtaattagtcttaatttaatcatccaaaacaaagtgactattaaatttactagctgacgtttgatatgcttttttttcttatttagccggttacgaatacgcgttgccgttgtattcccaacaagtgccaacaatactcgcatatccggaccaaattttctgaaacaaatgcaggcggcgtcaacactcaagatttaaataaatcaatgatgaacatttacaatgacataccggttatattccagttacaacgaacaacgaacatgatcataatacataatgaatgacgaggcatctgcagcgagttttctatttctcctgtatatatgtacttgcctatcagtttctcctttttagtgccatttatcacacaaccgaaacctggattttgcgataaacttgctcaccaggctcggcaaatcagcagttagcaactgacgttcctcgctcaagcttgcttctagatatcggagctgttttactataggacgaaatggtcgatcatatggtttatgacatcggcaccttcgctatgcataacgggatctttgacctgtccaaatttcatttataagcatgcgttaatctcagcgctatgtcaacaaacagaaactggttgctaagttaaaagaaaactacgagtaaataatatcgactctgtttgtacacagcatataaaagaacaaggcttagacgggcaaagagatacctgaatcacactatgtgctgcagatcttactttgctgttgtggaagctgacatccaccttttcccacgacacaagcttcagacctcttaaaagccgttctggaaatttcagaagaagttatgctcatatggacataacacatggcataggaaataagagcaggtcaggtcataatatggcttatatgatcacttggacagaacacttctgtagtgcatattattgttccaattcgcagaaaatattaaaagcctatcggaaaacgaggacagtccaacgacatcatttgatttttggaacaccacacgcatgttctaatatattgacgggaaaagtttttgcacattcacgaaaaaaaaacatagtaaacagacagatacaatcagagtactgtcgttgagcatggtctcatttgcaaccatacatatggagttatggacattgttaagtcacaagaatacaagcaacgtgcattctgtatagtcggggggggggggggggggcatgtatgggagatcgcacgctagacccactcagcaatgcagccatgtcctggttatcccaagagccttagcaaacttagaagaaatagcttatttccattttcccaaagaaagaactataactaaagaaagaggtcaccatatgtcatataaacatgcataataagtagcatcccaaaaactcttttctttcactaggtaaaaacaacaatctaattaggaaaatataaaacatggaattacataaaccatggaaaaatagttatatctatagcactgaatatttatcagaaatactgttattgataatatgggattacaaatattaccaaattttgaatataatcatgttgatccattatcaatcaaaacaataatacaaaccttctaacatgcagctgtccacatcggcaacatcagtacattgattcattgtttctgctttggatagttcttcatatacaatatgtgggtaaatcttgcttcctgaatcagtccactgaaatagcaagaaacgcgtatgtgggaaaaattcaaggttcagtatacaggccaaactaacaaagtcacaaaaaagtagccatgggggtaaaccttcggtagctcagaatttcgcctgatggatgatgttctccacccaacaatatcttagtcaacatcaagttatggaatgatattttaaacaatacttagtactaaatgtatatttagtcttttagtagtaaaagaaaaggatacgatcatgaccaacattggagtatgcaactcttcgtttgaatactttcagagcagacctaaaacaagaagttaataaacttaacagtcaaatgattcatgatccaagcatatagatccaaatgatgggggaaaacatacatgaactgtacgcccccccaatcatccaccatgcgtagcaacaatggaggcttcccatcatcattgtccataagaaatagatgcttgccagtttttccgaatatcaaatgaatgatgtagctggcaaaagtttctattgcagtaaatccaaaaaggaaaggaacctgcggattgaatttcagaacaaattaataatgatatttcaacctgaatataaccaaagccatatgtatctctacaaaagaagagttctctgctgattgcatggttgatcttggcatcacaatattgattaaagaaaccttagcaacagtactgagtacagactagcatgtgcttaacttgaagaaaatgtacatgtcctggagcctggagcatgaatgttcgtgcaagtatagcaattcagagtaaggtaatatactatattcatatcactaaaagcaagtgattgttcaacctcgaaagttttaaataacttatcaattcttgaattaagtacagtaaaacaaggtttaagtagtacctgtttgtttcctctagaaccaagatgcggtgacgcaacagttatgaagttcactgcctcaagcccatgtatagtacccttattagtgttgttcagattctgagaactttgggatgtttgtttaggtggcctatagagtcttccaatagcatatcttgcaaccaatcctccaacagaatgtgcaacaaaagagatctttctgatctgtggtcttttgttggtttcttcaacaatctgcctttctaaattttgtcatgaatttgggaaacaaagacatacatactcagcaaataagcaatatgcacaatgaaatcactgacctcttgtgccaaccgctcacccatcacatcaacgccatctaaagttagcttgtacatgttgcgattgctacctacaaaattaaaatatcactgaagtaaggtaaccataatgaaatggttcaaagcaagaaaacatccatcttaattatggaacatatgctgtatgactccagcctccaatgctgtagtgcaaatacaaagacacatatgattgtgcattgactgggataacaaagttatctactatatttgaatttgtgtttcacatatggaaagcaaaataattatttgcaacaatccccttaatgaatcataactttgtaactgttgctcacaggtagggacatattctacaagcgcaacacaccttggtgatcttgttgcaatgaatgatttggaaagagtgcaaagttaggatattcaatggttgtttgaattggacaatagaggatattgtttgggtgatccgtgaggaattatgggtgtgcaaggcagccgagagtctgttgtaaccgcgtagaggggcatgctccctcttgcagtcttacaagtagcctctgagcaaggagatcccaaaaaacatggaagatgaggtaaaattcttttcttttttcattatgatcaccaaaattgcaaaacaaaaaagatggcaccaatgagaggtgtccattgggcacattcccatcgtatcacactttgtaagttgtaacaggtattgctattagataagatgccataatggtcttactgaagtatatatagaaaagtggcagtacaattgctcaccaaacaccattcagaaaaatgatatacacactcgcgaatagggagaagcttacgatgaactataactttgtctgacagcaacttttcaaattgctcagctccaaacttccaatcagctgcactgcacagatgaagaaagaaagatcaatgcatggaacagacaaccaaaacgatatacagaagggtaaaaaaaaccagttagcaacggggctcagtgatgcactaatatatggctgaaatgtgcataagcatcgtgctatactgcaaccaggtagttaagcactctcgattctcaagcgattggtatggatctaattttgcgtgccttgattggaaacgccgacctgcccaatatgaaagaatgccatagcatctaagggatatctcaaattcagtttgttaactaagtgcccaaatctccatattttctgtccactgtccagcaaaaaaacgcgcgagcccgctgctcacgcttgctatagcgatacctcgctgaagagaattcagagaacactgaattcagagagcgcaactgaacccatcagagaataaaccatacaaaaaataattacttgaattcagagagcgcccccgagccgaaggccgaagcaattaagcagccaaaaattacggcatcaaaccaaaagcggatcagcacacgagccccccacgagcttagtatccattacctcccgacgatcccgtggaccatgaccaccaggtggtcgggctcgggcccgacgccgccgcccggtgcctgtgcctcctcctcctccgccgcggccgcctcatgccaggctcctcccaggtcacccatacctgccaagccagccacgcaagcgcgcgccgcgaagggggaagcgaggaaggggggagagggaaaagggagaggagtggtgggggggaa

SEQ ID NO: 22680 - DNA, 9819 bp, Oryza sativa
  unsure (1)..(9819): unsure at all n locations
nnnnnnnnnnnnnnnnnnnnnnnnnnnnnnnnnnnnnnnnnnncttggttttagtttattaggacaaccaatgggtttttttgatcgttttattagttataaaccggtgtgagtaatactcgttggtttcatgccgatcgccctattggtgacatatactgacgtttcatgaagatctatctattcaaaatctacttgcacatgttgataaactttttatttcttattgcaatagaaaaattacttaatattggcagcaatactttgaacttctttagatatatgaactaatagtatcggtttgatgtggagttcacaaaatcattagctgatcgaaaactgctctggagttgttttcaattttcatgaaaaccagttgaaaacagaagtagttcagataaaaaactgaaactaggttttactttaatttgactgttttattgagtggtttgtcaactagagccaactcaaatctcgtaattttacaaaaaccaaatggttttcatcggttttttcaatccgggtgtgatatttgtctaacttaggtctcatttgaactagtagcggataaagattaattggatttaaattattttaatttaaaaataaatttatctaatatttgaaagtaatttctatataaaaagttttcacacaaaatatattatttaccagagtgaaatcagtatcttaattaaaaaaaaggagcagaggagaaaatgtatcctattaattaggatggacgaagcagaggagaaaatgtatcctatatatctaatattacgatccaaggagggtggaaattggtgacatcaacaggctgtgtgtaccatggcaatgtacagcatgtgctcacgacgcctaagaaaagggcgaatttgtctttaatcggtagcgtgtagaagcactaagcactaacagcaacaaaatgacccgttattatgcggtgtctaggtcgtagaaggcacgcgtcgatcataaataaattagataaagcgacaaccgaggaagaattgcatgctttgtggagtactgacaagtgacatttgatgactaacgtcgcttctctctatatctcaattcgggccgtgtttatagatttattttatttcttctaacttccaactttttcgtaacatcaaatgtttatacacatgcatagagcattaaatgtggacgaaaaaaaccaattacacagtttacatataaatcgtgaaatgaatattttgagcctaattacgctatgatttgacaatgtggtgatatagtaaacatttagtaatgacagattaattaggtttaatagattcgtctcgcagtttacaggtggaatctataatttattttgttattagtctacatttactacttcaaatatgtatccgtatacttaaaaaaaattggagcatttgcaaatttgccactgttttttctaatattgcaaggttgccacttaaatgatagttctagtggcatttttataatttttttagtggcagttttgcaataacgattcaaagtagtggtaaatttacaattgcctaaaaaaaaattttggcacacgaaataaacacagcctcgatcgcttcctctgttcttttttctaggataacttaacatcgttctgaaaacgtaggatatatattcgttgtgttaaactatacttgtcgcgaaaggaaaatggaattaacagcataagagctcaatgtcccgtaaatgacaaatgaataaaagctagtgattgtgtagaaggcatgacaaatgagttgatggttgacagccagagctgatatgatttcgcccgattaatatcgcaaccaagcttgttcagtgcacgcaaaaatagtgtgctagccaggaccacgtaattgcgtgcactaatcctcgaatgcgaccatggaatagaatgaactagctaatcattagaatcctcaacgacctagaatttcaattccatttcgttcgtgtggatgcttaagcctacaaaataatattacgtccgtattttaatatatagtattattaactttttgaaatatgcattcatcctataaaaatataagtcatgctaaaaacctttagtaataaatcaagtaaataataataataattttaaaaataaaatgaatcatcaaacttattttaaaaagtaaagtaaattatatataaaaaaattaatggagtactttgaaatgccgtttaatgaccgagtaatgcttatgaaattcctctgaaaaaaatgagtaatgcagatgaaatgaccatttcaagtagccggaccgtttctttttgggtcagcgttcagattacccatagacacagccacacaagcatcttaattaacacaatacaaatattctctccgtttttaatacatatgttatcgttggcttttcaacgtgcgtttaaccattcgtttcaatcaaaaaatttatatgattattattaattttattgtgatttaatttatcatcaaatgatttttaatataacttaaatagtgttatatttttttaaaaaaatttgaacaagataaatgatcaaacgattttcagaaaatcaactgcatcgtgtataaaaacgaatggtcaaacttttttcaaaaaatcaacgacatcgtgtattaaaaaactacagtgtgtgtaaccatgtgtttgagactttgagctttgaggcgatgcgataaaggcagaggcttcaaagtggacagcgaccgagaacgacgataagatttgcgacgccgcggcgccacgtcaagagatagtaggtgtccccattcggtaggctgtttgggacctttcgaccacaactcccacacactatccagcgctggcatcctcatcacggcctgatcaatgatcccctccagctgatcgagatactaactaactgaaattagctctaactactccggattacttaagttgatatgatcaccatggctagattatcagagcatcaatatgtatctttgcagagccttgcaggccagggctggaaatggcaataatgtttttgcttaatcctcgttgattgggtccgtttcgtcgcatgctgggtcatggatcatcttatatcgtcgcttataagattctttttagcattctcttagcctacctagtaatagttagctctttactatgactataggacctacttatctttctcatatagttttttttggttccggtgtccgaaccgaaagtttacagcccgtttttcctctcttttttttttctctcctacacctcggcatttagccggtttatagcgtaccattatacttgctcttatggcttatccgcttctcatagcttccacgtcaactgcaagacaggcaggtacggcgagaggcaaatcattggcggtttttgtagtggattggcatccaaacaccagcgccaaacataaaacatagctgtcgttcgccctgtccacgatttcacgaatccgtatgcactccgctgcttgagagcggtttgccaacagccaaccaactgctgctgctcggtgggtgcttaattaattttcgtcggcgtcggtgtcagcggcggcagaaagcgttgaaacacctgaaccgaccatcggctctaatgccaaacgatggtcgtcgtgccgtttgctgagtagcttttggcgctggtagtgcgctactactcggtccatttgttggaagaggtcgcatattgcatattgtttttttacttgtgtggcttgatttctgcaacttccaagctagaaataataataataataataataataataataataataataataataataataataataataatatactaaagtagatatcccgttcgacgaaatgatacttggtaggtaccagctgatgatacctcttagatatcgtcttatgtctaataggaattagtcgatagcatatgatacctgtaaagtaccatcccatccaaacgggttaacatcttatagcatttttttaaaaggaaattaggcggcagtttttttttcttcttttaaatgtaatcttcaaaggaaaaaaaagaaacatttctaaagatcttgcacgaagcaaggtttgagtcagtggtgggtcttgtggtatgttcttttgggcccaactggttccagtaagaaataagttcacttaaggtcctttaacttttcaacgaatccaattttcatccttcaaccggaaaaccagatacaatgggtccctcgactattaaaaccggtacaaaggaagtccctcaacggtttctatggtggttttgattgacgtggcgtctacgtggctgctttgacttggtccttgtcctacgtgacgatgatgtgacactataagcaaaatataaaaactaaaattaaaaacaaaaatgtggagcccacgtcagacagacaaaagaaaaaatagtgagactcacaagtcaatgggtcccaccctcctatctacacacagaagacgggagacgagagaggagggaccgacgcctcctcctctgtccctcctggccatccttcctcgtcggccgacgagcacgcgcagagagggagaagggcggcagccagtgagaagaggtggagattgacgcggaagacgatcgctggccgtcgccccctgcgcgcctctctttccgcccgtcgccgtcgagccctacccacgacgccccgccatcaccggcctctctgcctcctccctccccacccgcctcaccggacgccgtgcgccgctccctcctctcccgtctcccgccggccaccgcacgcccatcctctccagttggccgtcacacgctgctctctcctctcccatctcttgctggccgccacgcgctgcttctttcccaccggcaaccacgcaccactgcctgcctccctgtggccggacgatgttgttcatcggggatccctgctccagattcgactgtgatgcgagaggaagtcgagcgcctcgctggcgagcgacacatgcttgccgagcccgccctcgcctccactaccacgaccgccctcgccacctcccacgcctcccctgggttcggtcttgggcgggctcgacaaagcctggagagaggagaggggagagagatgaagagaggggagtgggagagaagaggaagaaagaggggtgagaatgacatgtagggcccatgtgagccccatcacggtttttattattttccaaatcaaagtgccacttaagcgtcacgtcaataccacgtcagattaagacagagtcaaattagccacgtaggcgccacatcagctgaaaccgccgttcaaatcatcatagggcttatattgcactagttttgacaaataagggacctgttgtatctggttttgagagataagtgaccgtttatctggtttttggttgaagggcaaaaatcggattcgttgacaagttaagggacgtcaggtgaacttattccttccagtaaaactgtagctaataaatgggccttacaacttctcaaaaattgggccatgcaaagagatctagtaaatgggcctcccttaagaaaagctagtaataatgagcccaataatgacttgtaccagtccgaaggggactctgcgcaacccggtcccgaccgaaccacaccggatgacgcaagagccgacgtcactcctccccgtctgggcgcgggcgccaacgcggaggcccaagaccacacggcgccacccgctccacctccacgaagcagccatggaggaagaaggcgcagaccaccggcccccctcctcctcctccggcggccgcggcttcctctccggcctttgcgccgccgcgctacgccgcaagcccatctccgcccacgcggcccacgccgcctccggcgagggcctcgtgcggcagctcggcgtcttcgagctcgtgctcctcgggatcggcgcgtccatcggcgccgggatcttcgtcgtcaccggaacggttgcccgcgacgccggcccaggtcaggcccaaacgccccctctttttttcctcgttcgcttcggtttagagtccgcggttgcagcactctaatttagcgttggagcaactctggtcaacttgttggcgccactgggctacagtacaatcggctgcctgcatatgacattgacatatctattgcaagaattcagcagtgtagcagccaggcaggcattagggaattgctaggcagtttgatcatactgctcgtagtcgtaggcagtagttggttaaacatatctattgcaagaattcagcagtgtagcagccaggcaggcattagggaattgctaggcagtttgatcatgctgctcgtagtcgtaggcagtagttagttaaacatatctattgcaagaattcaacagtgtagcagccaggcaggcattagagaattgctaggcagttgatcatgctgctcgtagtcgtaggcagtagttagctaatcgctgctcttttatataagcagatttgtgtagtggccatttacggactgccttattgttgttgatcacggtgcaaatgattggtagttgatggccacatcaaatcaattgcctctttgcactttgcccatttcatcatttccgctaaaacttacatgggtgctctaagcaggtgttacaatcagttttgttcttgctggagccgcatgtgtgctcaatgccttgtgctatgccgaactcgcatctcgatttcctgctgtggttgggggagcatacttgtacacgtatgcggcgtttaacgagctcaccgcgttcctggttttcactcagttgatgcttgattatcatattggggcggcaagcatagctcgtagcttggcaagctattttgtccaattccttgagctaattccattcttgaagggccatattccaacttggataggtcatggagaagagttctttggtggtgttgtatcagttaatatattagctccaattcttctcatcatcttaactacaattctctgctatggggtcaaagaatcatcagcagtaaatacctttatgactacattgaaggtaaggctgcgtttatggggttttccctgcactaggatgcataactttgcagctttcatgtgtttaagtgagcttatcttatagcattaccattaggcgttctatgactatgaattatgatatataaatttctgcatgcacatgaaggtttattttactttgttgatcaatgaagtggtgttcttgtttccctgatgcagatagtgattgttatagttgttgtatttgctggtgtctttgaggtggatgtatcaaattggtcaccgtttatgccaaatggtttcaaatctgttgtaaccggagctacagtggtctttttcgcatatgttggatttgatgcagttgctaattctgctgaagaggccaaaaaaccacaggtgatttcagtaactacccatatttgttgtgttcatttgactctctggggttggaaataacatttcatttttcccattttatttccagactatgatagtatgatttttgctttaacttctctttctgctcatgcattcaaaattcttcagagggacttgccgataggtatcctagggagccttctagcatgcgtcttattatatgttgctgtatgcttggtgattactggaatggtgccatatactttacttggtgaagatgctcctttggctgaggcttttgctgctaaggggctgaaatttgttactgtattgatcagcatcggagctgttgctggtcttactacaacacttcttgttggtttgtatgttcaggtataccttccaacttatctataagtgatccgtctttgctttaatcaaattgatcaactttctgaacattgccttctttgaaatcacagtcacgtttgtatcttggacttggaagggatggattgctaccttcaatatttgccaaagtacacccaacgcgtcatactcctctgcattctcagatctgggttggttgtgttgcagcagttttggctggtctctttaatgtgcatgaactctctcatattctctcagttggcacgctggtatgtaaacttcagttaatattcgctattacaagtttacaacacataactgtttgcttcttttttttttccttttttatgtgtgatgcagaccggttattcagttgtatcagcttgtgtaatcacacttcgatggaatgacaagaccaccagttgtcgctcccttggaaatatgtcaatctggcaggagggtgttctatgtcttgtcataattgctctttgtggtttcgtagcaggaatgtgctatcggtttagctatgccattgccttcatgataatagctcttctcatagctgttgctgctggttttgctctccagtttcgacaggtaagtaccttttatattagccagtagtactaattagtagatcctcgcatacctacctcgtgtcatctcagatgtgctccatagtctgtaccaagtgatccttattggagtgattacatggatcaccctcttttgtttttctgcttgcaaattgcaaccgtgcatgaatgtgttaataaactaaactgtacatatcgaatctactgttccaaggtattgtacagttgtttattcaaaatcttgcatggcatgcattttcaggtatatgtggatccacctggcttttcttgtcctggagttcctattgttccaatggtctctgttttcttcaatatgcttctctttgctcaggtttgcatgactcaacttcttggatatatctgcattttctttctttgaatttaaatatgaaaactttgtttgtaccctctgtcttggtgtcttggcttctgttgactgatgaatcttcctaagtcataactgatggcaatcattctacatctcgcagctgcatgaagaagcttggtatagatttgtcatccttagtctccttgctgtgggtgtctatgccggctatggtcagtaccacgcagttcctttaagttcagaccacccacacccggccgttgcttatcatggaattccttctgaagctccatgagctactgcaatttgcaagcctccggcttcatcccaaagttcatgtgcaatacatctgggtagcctggggcctattattttccccagctggaatattaaacctcgccttgtcaccatgcatactccatagttccacaccgtacactgtaaatcgccagtcttaaacgaagatattttagctggcatcataccaatataccattcaccatagatgccaaaaggacagacaagttgccctcctgtatctagaaagaaggaatctagcaaagtagtagcaattttttgtcacttctatgtgctgaaatgaaccttttgatatcacttcttatgggtgaaggatagatgattgcgttgctcatttttaaatatatgaatctcaccatatttttgtaggaactttacaatagtcagatcatttctgctacgaatatcgaactatgagaagttaaacttaggggttgtccagatcgatgtcatttcaaactatacccttttatggtaaaattgttaaagatgtacatacatttagttttctttttttaccaaactttggtaaatacataagcaatcatgccaaaacattaatattgaactatgagaatatataagggctgttcaggtttattttggcttcaatttgaaccgccactttacacggcattgtgtgcatagtatatcagatgctggattgctgggccgctgttgttctttgccaattttaagcttaccaaaaatttggattgccgaaaaaaaattgtcactcatttnnnnnnnnnnnnnnnnnnnnnnnnnnnnnnnnnnnnnnnnnnnnnnnnnnnnnnnn

SEQ ID NO: 22681 - DNA, 6335 bp, Oryza sativa
tataccattcaccatagatgccaaaaggacagacaagttgccctcctgtatctagaaagaaggaatctagcaaagtagtagcaattttttgtcacttctatgtgctgaaatgaaccttttgatatcacttcttatgggtgaaggatagatgattgcgttgctcatttttaaatatatgaatctcaccatatttttgtaggaactttacaatagtcagatcatttctgctacgaatatcgaactatgagaagttaaacttaggggttgtccagatcgatgtcatttcaaactatacccttttatggtaaaattgttaaagatgtacatacatttagttttctttttttaccaaactttggtaaatacataagcaatcatgccaaaacattaatattgaactatgagaatatataagggctgttcaggtttattttggcttcaatttgaaccgccactttacacggcattgtgtgcatagtatatcagatgctggattgctgggccgctgttgttctttgccaattttaagcttaccaaaaatttggattgccgaaaaaaaattgtcactcatttggtttgctaccacaaatttggcaatgccattttttatttcaacactagcctagcaggtcttaaaaaaaaattggtagtaatccaaacaaacatcttgccaaaattttggcaattgctaacctgccaaaagaatcaactaggcccgagtcatactgcaataagcgctactactactatactcccttttagttattcctaaatgatctacatatttgtgttcattcattaggtctattcgttatttgtacattagagtaaatggacattgatacatgcatccatgcacacaaacatttgtaacatatatgcaatatcttgatttgctattggctaggaaatagtggggatggtgcatgcattaagtttgttgctagagtaaatatagtatgagagttattagcttttcttgttattagtgtacctatgaaatatacagataaatttggaatggatggagtagttttttcttccgtctccacacgcttcacttaactactcatcaataattctgggacagcgataattgcagaattgcagtacgtactagactagttcgtgcagtgcaggtacacaattaagtcacttaactccggtacttgcttcccgatccaacttaacaccagtacatgagtactatctcgcggtgcagcaacaccggccaagagacagccacagcgcagcgaatcgtgaaggatggtagagtaggaggagcagcgcgtagcaatcaattcattccactgcacctttacctttccgttcccgtcccgtccagcgcaacaagccgctcctaccacatgccccgctcacatgcgattgcacgaacgcatcatcatcgcactcgcgccacgtccggtggcgactggccgtggccacgcctgcacgcactgctgcaagtggttaaacctgccactctagcactccttccgcccccattttcacttaagctgtgtttaattcacactaaaattaaaaaattagttaaaattaaaacgatgtgatgaaaaagttgaaacctgaaagtttgtatgtaggaaaattttgatgtgataaaaaagttgaaagtttgaagaattattttggaactaagcacggcgctagtactcattgtgttccattttaagtattttaagtatatagttgtgatttctatgtccaacctttaatcgtctattttgtttatttttttatggtttatatttttattattattagatgataaagcatgaataatattttatacatgacttattttttttttaaaaaataagctttttaaataagtcaaacggtcaaacgttgatccacaactacacttaggggctgtttggttcttaactaacattgccataactcattttagaaaatgttagacaagtgtggcttgccacactttttgtggcctataaattgtaagccacacttgtggcaaagttaggcaaatgattgagtctatgacatgtggggtaggacggcaagaaagtgtggcttgccataactatggcaatgaaccaaacacaaggctaaggatgtgtggcagtctaaagtgtggtgtggcaagttaaagcattgaaccaaacagcctctaaaaattggacgtagggagtacaaattatactacaatgcagtagtacatactcctactagctactccattgagtagtagtagtactaacaagtttttttttttgcggggaagtagtactaacaagttgaagagattttgtggtagtgtgatacagatcgatcgtggctggctactcaagcaagcaaggagacaggcgtgtttcatggcaatcgttacagcacggagcccccggtgctcgacgacaagatctacgcattagagacgccggagaggacgggcggcccgtgcgtcggcccatgggttggaagctagtatagctctggtggtggagtttggaggctgcgttgcctccgttttgcaccgggacaggtctccttcacgtgcactgccgcttttgcgccatgatggggtctcgtcccccctggcccgccgtgagtgagacgcaggggctacccggtaaaaaaggggaaaaaattgtaaccttcacaccaacccgactctttttctatttaacacacactcacctcaccaacctgattctgacacaaagtaaaggctatgttcgtcggtgaagaagatgtcgatcgaatctgtagtaggagcactagtagatgggagtagatcgtagtagagcaatacgccaatattaatacggaagttatactgcagcctgtacgcttgtacggctgtacccatcaccagtgcatcagaaaatgggagttgttggggattttcagaagctgtggatgtctgtattctggtatgctagctccgaaaaggaaaagtaatgatagcacatgtatcctttgtgtcggcgaaaggaacgggattgatttttgaggccactggggtggtgtggtgagcaattagaatcgctcatagttaaaccatggagtaagagcacccgcaatagtaaaataagatattctctataaaatatgtacatctcagcaatagactagattaatagtaaaccacctcaataatatgtctacatgggatctatagctctctaattcattgtctcatttttctctatagactatctccaggttagtaaatagctttgctttctcttttcatttaatctcttctaaatataaaaatatgctgacatggatcttttctaaagagcctatagatatccattgcggctgccctgagtgtgtatgactagacgccactaagccacaggctatcagaaacaacgaaccgtcgtgggttagttacaattgggagcagagagtgaattatttgtttactgataatgacaaatctccaaccttgcaaggaccagcattggggaaggagccaatggcaccactgaaaggaatcaccattcgtggttgtcagtatgtatagcacaaacgcacatgcaatgagaggtgtgggagcatcgtaatctctacagtaactttagtttcatggcgtctggatgaggaacattccagttcacatggagtgtttcgatgcattaaaagtacaacatatacatttcactaacagtgtgttatacagttcttcaggggcactggcctatgaacagcagttctacattttttttttcggttccaggtaatgcacaagaaaaacacagtgatcctgcatctgaagcacccctccagcatgtatgttactctgagttcatgtcaaggctattcagttccctggccagcacaaattcagcaggtttctagccttggccaggctgaaatgcctcagtactcgtcattgctgtatatgctgctataatgcaatgccgattaaatagcaagccggtaaactacccagtttaatttattttgcaatctcttcgagctttttgagtataaactttgtgttaggtctcaatgatggtgaagggctacagcaagctgttgccaactcgaagaaagcattcaaattcttttccttccctgacttcttgctctgcctgacaagatcggagctgaatgcatcagaaatcttcctctcaagaaccaaatttttgaacgagacaggcaataggatgtcgcgagggtttggcgtgttatcctttgctgattccttctgggcaagcatctcaagcagaactactcccaagctgtagatatcagtctctctagtggcatctctcatcttgatcagctcaggtgccttgtaaccctgtgctgctgaagtttcaagcatctcctgggcaccagcaggattcagcagaaggtagaggccaaagtctgatatcttgcactcgtaattagcatcgagcagaatgttgttcgtcttgatgttcccgtgaattatcggtttctccaaccctgtatgcaggtaatccagtcccttgacaatactgatagagagcttgcaaattatattccatctttgtgaatcaacaattccctctgttttcggtagcaacagaaaaacattgcatggttagcaactatcacaatgaatgccagaagatgcctaataacaactttattgacaaataatgttatccaaaattcagccatcaattaatatggtgaattttcatccacaagcccaacactacataataaactgacagtttaacttaatttattgaagatctaggttcaatgatcgaaaaagaaaaggaagatgaaatgcagtggtttgaaagtaagacattgctagtacaaaattctgggagttaacttgaaatatcaaatatgtaaatgtgtgctcttctcttcaatcaagaggcaacaatacttgtatctaaaggacctttctacaaaagcctgactgattaattgaacacgggaaacttgttatatcctaatgattatggtagttaagggttaattaatgacttcaacaaacataaggagtcaggaccatgtcaccagtacacagtgctatgtcatgtttcaagctaaacaagagttgacaaaatactttttgcaatcagcaattatagcaaggcatagattagaattaacaccataggtccatagctatgaggttccgagcatgactatcttctccattccacttggactcaaatcactcaaaattgagagtttgagaccaattgccctactggttttcttatgtcttcaaactctcttagaaacttcactatgccttttgcattacaacaaattcttgacagatctgttgcaggcttgcagcttacaggtataattcatatccagctatattctccatgctcatgtgagtttttaacattttaaaaacgctgttactaatttaaaacggaattcccctaaaaaattaaaatggagttgaactacctcttttacaacaaaaagttacattttttttaaaaaaaatcacgttgctaatttacactgcactttcacaatggtggataactagatacagaagatgagatacgtgcattgcagcctgcgtgcttttgatgctactctgcagtgcagagatgactactctaatatcgcagcattgccatcattgcctaacatttcggggtgtaagatctcttctcctaaaactctgaccttgatccccatactcgaatagtataatcagtcacagtaaattatacttcgaacattgaaaattttggaacgtaacaagattactacgcaaagaagagctaaaaactgcaaaaggatacgagagaacagataaaatgctccacatttgttaccaagaaactaacaacaaggcaagtaaaataagcagagatgcagaccaaccttgcaagaatcgccggagcgagccggcggcgtagaaggggtgcacgagcagcttctcccccctcggcccgacgtagaacgcgcggagcggcacgaggttcgggtggctgaccgcgccgatccggcgcgcggcggcggaggcctcgtcggaggtgagcgcgcacgcgggccgcacgaaccggagcagcacggcggcctccccggagcgcatcgcggcgcggtacagggtgctgtgcgacgacttggccaccacctcccccggcgccttgaggatggcggcaacggagagcgcctcccccccggggaacttgacgagcgcgtccgccctgccgtacgcccctgcgccgacgcccgcctgcgcgcccaccccgagacggtcggcgatgggggccaggtacggctgcagcgcgccgaggcggtcggcgatcggcgcgaagtaggggagcatggtgttggccgtcctgctccggcggaggcacgccgggagg

SEQ ID NO: 22682 - DNA, 15487 bp, Oryza sativa
acatgcgggacgggaggggaggaagggagggaccggcaccaaccgtggttggctgctccgtgtggcccgtggttacggctgctttctgtttggccgtttcgacgaacactgcgagtgcgagcctaattaactgcggtcggattcagccttaagatccgtgctatctggcgtcgatccgacggtgttgattgatttcatctagtagcggacatatctatctaggagtgcagaaagaaaatttcccggtccgactagctttcgtgaggtgcaacacatcaaggcttctgttgttgtacagtcgtgttccttcatgaaggaaacaggtacaagctgatggccacggaagcgtcgtatttcgttgtgtccaacatagaaacctcctatcacatctcgcttttagcaactactatcaataataaaccttggtccagactctaaacaacaagtccctgtcaaactttcgttgtatttacatgaaaatccttcatcaagattcatttcgttgatgcctgcataccaacatcaataataaagtatattaagaattggtgtcctcccagttctatagattgtttttttaacaagtttgtcatcatcatataaagctccaatagttgcgtaggatttctaatgtattttatacctttatattcatttcaaaattcgtgcattacctaacttctcctgttttttaatctctaagagcaactccaataaactatcacatagctagctcttcaactgacttggagagccaagcttgttgctctaacactctctctatttacacactctatttcgaatctataataccgggacacacatatcaacctctacttcctcattcttcttcctcctctttctccccttcttcttctcccgtggccatccttgagctcttccctcggcgacagcgatggcagaaccatgcgctcatgaggcgacgatggcggcggtgagaggggagaagacgatagtggctgatccgtgcaacgataagggatagcaatagttatggctacgacgacagatacggctacagtgatgagctcgacaagaggggtgaagccggcgacgagaggggaggaggtgcgaggagggctcagcggagcagccgcttgtcccttcttcacccgtaactcgagcggggggaggacggggaaggcggtgtgctgggcgggtgacctaagaggatgatgacggcgatgctgggtgagcggcactgggagtatgacaacgatgacgctaggcgggcagggagtgaacggcagacgtgatgggaaaaggaggagaaagagagagggggtgggacccatgtcgatggtaagttgtcttgccttgccaactttggccaatgtggagatgaatttagccagccggttggtaggtctattggagcttttttttatataagtttgctaaaatttggcttggagagccatttggccattcttttagagatggtctaacatgccatcgaattaggttaccgagttaggtgtcactattggcatcgccatcaatcccctctaaccctatctatatctatcactatctctactattataaaaatcgaagatatttttgcccaaaattttagtgcgtcgctctatttcgataagatgttggtgtgcaagcatgtgagatatctttgcctctatatctattataaaaattgataattttttggttcgtcacatcttttcttttgtccgtctttcatttccgactctattccctgttccgtgcgcgatgcgtgagatgagcgatggccaccatgcgaaatggtgccgcaacaaatgagcggatctgaaccggtatgcaacaagcgtgcaacctaggttaattctgattcccacgcttattcatcgtgtcatccctgtgatctcccgcacgtgccttaacaatcctactcgatcaaattctggagcacgtttgcggcaacgaatccaacgctgctccgactccaccaaaaatctctccgccatatatacatgctctcgatcgatcgatcacatctgtgaacagatagagatggctagcaataaggcgacggtaacgctccacggctgtgacagcacggggtgagcgtctaggcagagatgatgtcagcaacatcggttgatcaccgtgatcaggatagcgttgaaggtcaagtgtgccatgggccgcgatcgtgaccatgctcccgatgaagccatcgtctcagatgtcatcatcattcccgatgtcacagaccgctacatccttgtcatgtcgtcacgtttcttccggcggagcgatcagactgaagtatgggtgaagatgaaggtttgtgttttgccgttacggagtgggtgcattcttcatggttgccaggatggttgtgttggccctaaccaagcttaggccaaagaccgagtcagtcaactactccctcagattccataattcttagcattttgaaaaaggttgaggtctaacttttattactttgactatcaataattttaaaaatatgtagtttgaaggcattaaaacaacacatatagatttgtcttataaagtactatggtaaagtaaaaaagtatttattttattgtacatattataatacaaaagcgcaatcaaagatatattttgaaaaccgtatcattgttcaatacatcgagaattatggaaccgaagggagcagagctgcacaccacatagccttctacatgcaaagtgcagccactcctcagtcgacgaatagatagtagtacaaaaaattcaaaatgacaaatggtaatagctgaattcagaacatcgaaataatacttggatcatgaatattaaatcctaatcatcccatgtttaacgtaattttagttctttcccgttgcaacgcacatgtcttttagatataaattgaaacataaggggacaaaataaacatctaagggaccgatagatataaactgtatcaaaactgagcgtttatttgaaaaagaaaaagtttgatattttagagggggagggggaggggccttgagcccttgacccttttgctcctgtaagttttgtgtcagaatggtaagagaaagccgtacatgtacatacctagaaatggatgcatccgaagaacgttattttccgttcattaacacctccttttatccggctcctatcggcataaaatcaccaaaataaaatcaaaatagaaaaagagagaaaaaatgatacaagaaacatgacgttaccgatgaacagatcagctgttcacaagtacacccatgtcacgatcccccttcgtacgtaaaatggctcataatggttttactcactccacggtacggtgcatgactgcatgcatcacgtatgcatacttgccaagttgccatgaacgcctacaacctctgcaacctgatttgctccctgaacttggcgatgaactcgtcggccttcctgtccacctcgtcctccacctccgccgccagctcggagagctcatcaccgtcaccgttgtagtcgtcatggtcgacgtacgacctttgcggcgacgcggccatctcgtcctgcacgtcagccttctcgtcgtcgtcgtcgtcccagtcggtgacctcgccgtcgtcgctgaacgactggtcgcaacgaggcgccggagaaatgtagctcgggaagcccttcgacatggcggacggcgccgccgccgtcgcagtagcagcgggtttccgggacctgcagacggcgtcaagaacagagggcggcgaaggggcggcgccccagaatcccgccgtcgatgcggagctgtccgtctctgcgccaatgccgtcgtcgctggcatcgccggcttcggactctatccccggcatcgtcggcgccggtggcggcggcttcagcctccgcaccggcaaggaaagcggcctcccgctcgcgccgccgccgccgccgtcgtcactcgccgcattgtcggcgaccacgacgagggggtcgtcgctgaggtaccgagagttccacgccctggcgccatcatctccaccgccgccgccgccgcctccgccgctgccaccggtggaaatcttctgggcgaagacgccataggagacgacgaggccgaggaggaagaggtggggcacctcccacaccgcctgcgccagcgatggcagcagggagacggccccgacggcgacggcgagcagcacggccacgggcgcgagggccgaggagaactgcttgctgctgttcatcgcgttcttcgcgacgacatggatgccgccgccgccgccgccttgcgtactggaagagaacgacgccgcggcttcgacgacgtcgtcggccattgccagcttgcgcgcgcgcgcgggcagacgtacgcggagaaggcttgtgcgtgtcacggcgcgcggtgtacgttgctgggatgagatcgccgtgctttggatgcaaacctcgcggtagctgctactgtttggggataccttgctttgcgccgcggagaggcttggctgcaaagcaacggtgaatatcgagatgatgatgacgccgcggtttcaactttggaaggctgctctgctccgcgtgatcgctttggcataatcacgtccacacggtcacggcatggtaacagccctagcctagctcctatcctccaacgaactgaacgagaaatctccatagtacctgctactgccatctcaaaataagtacagtcgtgagaatccgtatacaaagtttgactagccatcttatttaaaaaatttatgagaaaattaaaataagttagtcacacataaaatattattcatgttttatcatctaataacattaaaaatattaatcgtaaaaaaatttcaaataaaacgaacggtcaaacgtgagacataaacagtgcaaaactacacttattttgaggcagagatagtagtaatgaatctaacaaagataaagattaagtggttgatacggaaaacatgaaaaccattaacacatgattaattaagttttcaattattataaacttagaaaatgaatttatgtgatattttaaaacaatttatgtgtagaaaatttagtacaaaatacaccatttagcattctgaaaaacatgttgggcagaaatagagaaaaaaatatgtatcttaatgtcttctttttgcacattttagcatgcgaggatgattgttttgcgcgaaaaacaaaagaaaatgttagtaggatgtcgtcttctttttgcgcattttggcatgagaggacgattgttttgtgcgaaaaacaaaagaaaaaggaacggtttgatttctcgagagaagcgaaaagggaaagatgcggttgacgaggggcatggggacgtctcggcgattcgtcggggctcaggaagttacacacttggccacaaaggcaccgacacccctcgatcacggctgtccgctttgtcttgctccgcgccggccgacatcatccaccatcagtggcgatcatttccctcaatgattctccggggctcgcagttgaaagatatctggccgatcatgctgctgatacgcacagagattacagaagatagcaatttgcctattcctagtttctacagtggatccatggattctgtacgatctacagttctacaccgctggtcataacagtgcaatgctctgtttatgtgttgtcataacagtgtaatgctctgtttatgtgtttcagtcgtctgtacttgggcagtcccggttgctcaatgcctcattgcctcaaccagtgaagactgaagagtagtgctctgtttccatccaaagcatgcattgcatctactacttgttaccggctggttcatagttcagactgatgagtagtatagtattcacttgtatttttaattaacaggacactggatcgctggctggtctcatgcttgctgccctgcctacccaatacccgtgtaaatccatccagctccagcagcatcagccgacacggatgctttgccggcgcacgggggttaaaattaggcacggtgcagctgtgcccagccccagtgggctaaatcgtcacagtgtgcagatccaccaaccattccgacgaagaatattattgccccagggtacgtcgcagtgtgcccagacatgttctgatcatatgttcgcttcactctacttccggatattggaatcactttttttttttttgaaacggagatattggaatcactttacagagcaagttctgctttattacacagcatgtcattgtttcagaccaaaactactcctgcacttagggggtgtttgggaacttagagactaaatttagtctttctcacaaaattataagtccctatggtagggacttatatttttgtgagagggactaaagtttagttccactttagtccctccaaccaaacaccaccttagtaaactacatgcctgctctttccggtggcaaaattgaagcgacccaggcttctgcattccgtaatctgggcgctgtgttttccattttctacagaaaaaatagcaacagagtatcgaacaggaacttctgtacagcatacaagtacaacacgccggggccttttgcaatcgtcccttcgggagaaaaaagagaagggaatagctacacctcgggtcctgacgcaaagaggttgacaaggcctccgaaagcttgaacagatacctcacaggcctgaagaagttctccgtccaagttccagacactttcgtcatgtgacgatataaaagtaaatgcttgtgtctgcggaaatcggaagatcatgctcagatataataacatgaaggtaaaatgaagaaagaaaagaaaagaaaatgatccttatgatgttcgacaaacttgaagctcagaggatctgagcccttcttggtaaattgtgttagatgcctgcagataagtcagaactcataagaacatactctgcaaacagggatagtgaccaaatctagaaactaatttctgagtgaatttagcatgttctttagtttgtgaaaactacataaaagtggaaatatactagatttattttattttgtattcccatttctgttatgcctgtgcggccatgttcacttcagtgagtaaacatacatcaactatgaaaaggttcagagttccaactcgagcgcaaccagtctataaaaaatagctaaatagggatggtgggtcaatatataggtacccattgacccactttagttcaactgaatcaactaaaaatgaactcatctgactattagttcagctagcttgggtaaatggatatccatgtattgacctactcccttcctaaattaagaaaactttttaaacttgggataatacgcacaccggacctcttgtaacagatttctcaccataagtaaaagggaagagggcaatctctaatgagcagaagatgaagaaaaccatcagataggtgtgcgtcagctactagaccatcaggggctctttcgttacgacatgaaatgacagctgcaccaacactgagaaaacgacccttggaccagacccattttggggtctcacaagctgttctggaactgtctggattttcatcttctgaattctgttcagatgttgaagttcctttgcatattaaacaatttgttcggcagatggttttccgatgtctattttgatggtattgcagtgtttggactccatttgcattattctctgccgatgctgtaagtgaatgagtgtttccattttcaagaaaagccacttttgcctcataagatctgaaaaacaactagagactgttaatttcaaactgaataggtagataccagcacaaattcattgttaatcacctgtgcttcaaaaataccattgttccagagaagtcatatcgcgcaggacccatccacctgtacttttcactctcccttataacttctccataaaatccatatctgtaatcagatttaaaccacagggtttcagcagttatgcaaaagaggaatccgcagatggtcatatccaaaagactccattttttaatggatgacgctgttgacttttgaacacatgtttgagcattcgttttattcaaaaaatgtatgcaaatgtataagatataaaccatgtttaaagtaccttgagtgataaaacaactcacaacaaaataaattataattacgtaagtttttttttgaacaagacgaatggtcaaacacgtgacaaaaagtcaacggcgtcgtctattaaaaaacggacggaggtagtgtatgttcagtgcaatccatgactgcctgtgatgctaggaagaacacaagaaaataatatgtttccctaaaagatttaggttaaaaacataacaatctagcttgggttaactttttgaaagtgacttcaactgaagctctgaagttttctccagaactttaagcccttttatggactgatgttaacgttgacataggatgcctatgctggtactgcacaacgacacagccacatgtaagaaataggtaatcagaaatcaaatttgtggtagtattagctatatatcatgtctaagagacagtagcataccctgcaaacgaagcagcatagcgcacagttggtgaaacctcagctgatgggctacttttccatctgacaacttgagctatatcaagtgatatccttctgccgaggataataagcagagcagaagtcacaggatctcgctccccagttgtactgcaaacatcaacagggcttcaacaaccagaaaagaactgaaagtgatgatcaataatttgtatgcaacaatattgggcttatttttagtcatcacaagacagcaaatggttaatacaatgcatgtgctcctagtgttcaatggatttaaagcttaatagaagaaaacttcccaaggtgcatagtagtgttgaaggatcagcttgatattattttagcaggtttgtgggttattgcatgtttggcgttattgcacataaactgtcaggtatgattagaggatcataagttcataaaccagcttgcatgcaacggaacatagttacagttttttaagggatttgaatttccaatgttaagcaaacattgtaatcctagtaatacagatcagtaagaatagatataaaattgattactacctgagaacaatagcatccgttgagccagaaggaattattccaagcctaaaccaattatttgggaaggagactaaaggcacctgatctgcagtagcataaagtggaaatgaaacaggaactctatgtaagtcagtaaatcttaaaagtgtaacaattttaagataaagcaatagttaggatttcgcactgacctccattgcatggttcatcactagaatctacaaataagagacaagaaaattacttacaagagaaatttctctgtataatatgaggtagatgtaaattgtaaaatcaaagacatacctgatgacgagatgtccaatcctgtagatcgtgtggttgaaagaaggggctcatgatcatcaggtgtgttagaacttccagagatggcatttgcatcatctcctgtgagctcactattgcttagatcattatttctatgttcttgacacttcatgttgtttctgaaatatccaaacccttctggagttggaggataagaatttgtgtgccttgtacttagtagcccattcaaaatttcattaaataaaccatcaccaccctaaaatgtacagtttggagatcagggtagtaaaacgaggaggaacttcagtatgcttatgatttatgaacaagttgaaaagtggattgagaatgtgagtttttttttctctcaaagtgaaaagtgaaagttaggtttgtttctctagtggcaatcaatgcaaggttttatatagccatacaaaatttttggacatgtactaagtaatctccaattctccatgaaatttaaccaagaggtatattttgacaagcttgaagtgtttttcaaaatacataataaagcagtagaatatgagcatgctcttgtggccagatgcagctgattgtggatcataactaagcgtgttctctggcctagcactcatcttgtaattgtgatgcttaatatcaaacaatgatagacaagcatttattgtgttctaataaaaaaagggtaagcataagcatcatagcacttccctataactataaattattcaggaaaacagagaacattattttgaacgaataagtagaaaaaaaatcactcaagttcacataccactgcaataacaccatcaaatttcttgagatctttatctgataaagatgctaaagtatcatatgcatgtcctgctcgctgtgtgactatcacctgaagcaatgtgcatatgaggcgatcaggagttggagctttgagggttgttcaacaaaaaacttataatggtaatgtcacaagatcagaaaagaaaatcagtcatacacatcatatgctcatctttaactgttatagattttttatacttccactggcagaagtttaccttcgtttttacttttgcccgctcaaataatggagctactgtttcccaattcttacaccctctaccttttccacacaatggatggacaaatacctacaacatgaaaattagttgatgcaagaatataagaccaacgttgagcagcactgacatgtttgtcaaaatgctatgtcaaggagcagaaaagcacatcatatttaccatgaggctcttgggcctatcctgttccttatttatgcacgtctttatatgctccacccaagttttgcaggtttgctggtctttatgaccaaaaatatattcacaaggtacccatggagatggtctttttcttggtcttgtgaccgtgtgtatgacaaatcggttcatctgcatgagcaacagttttttgtcaattatttgtaaaaggtgtcatctggaagagcttatataatgcattatttaatatggcacgaacgctttgacacatattacagaaaattaagtctgcaaagtaactagaagggatgttatacctcagtatttatcttgccttgaacggtagctcttgcattccaaggttcacatacaggacccacctcaagaagctctacagcatagacatctgaaaacttaagcttgctctctaacttaggttgcattatgatagatgaccaacatgaagaactcacttcctgcaatgtacagaagcacaatgagcagaaaacacacaggtgcatgtcaaaagcaaactgatagcttctatgagtacttgtatgatttgcagatggataatgtaagtctgacggaatagtaaaattgcactatccttgctgataggaactaaatgcatgtcaaaaatgtcatattcaccaactatgtctttccacacgagctgggggagtctggagctctttattgaatatttcaaccaaggttcaagctgtgttttgtgaaatgatagcttcacaaacacactactagtgttcctgtttctagtttgagtaagaatattatcccttttaaaaaagcatgcttatgctggtcacagacgcaatcacacatctatacaccgtcatcaacacaagctacttatgttccaaacagaaacttcaatatcgccatgttggccaagatagcgatcctctcctgagcttttcattaaccactgattttcatgaatctcctgaaaattgttggtataaatagtgaaccaactagcctatgttcagaattctaataggtacagtacaaggttgtagattcactatttcagacaccagcgcattattcatcgtctacgcctctctatctaccttccgtttcttcgattcaagaacccgaagaccggaagctacgaatttcctgactccatcctacaattcaaccaagactcctgtcaaaaccccagttaagtctgtaggatctaaagactagattcggggtgagcgcagacgggcagaagggcagcggcgggtgcggctgtgcgtaaacctggtgaaggggctggaaggagaggccgtcgtcgccgacggccaccgtgacctccccgacgccgtccaggaagagcgcctcgccgccgccttccatggcctttcccgcttgctgttgcttggtctcacgactcctccccggtcacccgcggtgggggaagaggaggggcaaatgcgaattcttcctctgtttttttttcctttttcagttgggtctgtgcgcgcttgggtccgtggtggctgctttcgcgtgttcgctggctggacgtttttgaccaacggcgccttttcttgtcagtccttgtgcttgtacagttcaataactttgccaacaaattatccgtagcaaacgactattcttactgtttttacttctcttaaagtttataaaatatggagaggtcaaaaaaaaaatatagtggtttgaaattacaagagagtgccatctcacaatcacttataactttagagcaagaataatagtttcgtcgacaaccgagtacataacatctaactcatctgcacaaggagctttatagcaaagatcatatgcaatagcaggttgttaaattagcaaactgctaaaacttttgcgtagatttagcatggctagtcgcacatgtcccacaaaaccacgtgagtttccgtcagcatgggctgcaagtgggttacgatctcttttttccggtgctaccacctagcgataaatcaactgctcgtatttctctctcttcttctctcaatcttctacctagaattgaggtaatgtggatcaatttatcacccgctgactcatctttattgtatctgctattaaacttctcgaatgaaattggataaaattctggatactcgtggcacgtttttaaaccgctaaacggtgcgtttcgtgaaaaaaaaattcctatataaaagtggttctaaaacgtcaaattaatttgtttttcaagtttgtaataattaaaacttaattaataaattaatttgcttttcaaagtttgtaataattaaaacttaattaatcatacattaataccaccttattttacgtaaaacacttaatctttatcttcaggagaaaataacaccacccgatggcatgcctttacattttcagcagcacttaaaacaaaatataccatcgatgcaaccattatatatttaaaaataaatctatttgattttatatggtttgaggagaaatagttgattcggtaagcctattgcataattgcacaaacgacgacgagcagcagcagcagcagcaccaccaccaccgcttcgtccgccccgtgccccaacggccgacgctgctgcacggcacggcccccggccgaatctgccgtgcgcgggttggcacagtggcacacgcccaaattccatccctcccgtccctagccggttcctctccttcctccccccctcgcaaaaattcaaaaaaaagcttgcgctcctcccgtcctccggcgccgatctgctcgaaggaggccacccccaacctccccgaccaaaccaatggcttcctccaacgaaacctaccgcgtcgagctccgagccgccgcccgccagctcggcgagcgcggcctctactccgccgccaaatggtacgtacgccccccttcccctaaaacccaccagggcccccctcctctaaaccctaaccctaaccctaaccgccgccgcctcttccttcctttgtagggcggccgagctgctcgtcggaatcgagcccgacgcgacgccggccccgtcgtcggtgatggacaccccttcctcgtcgggctccgccgcatccgggggccgcctcctgcacctccaccgcagcggcgggtccagcttccgccgccgcctccgcccgggcgcggccgaggccgggacgccgctcggcggcgtctcgtacgtcagcacgcccatccccgacgacgacgcgttcgacgtggggggtgataggtacctgctcgccaagacctacttcgactgccgcgagtaccgccgcgccgcgcacgtcctgcgcggccagaccggccgcaaggccgtgttccttcggtgctatgccctgtacacggtgagttcggatcctattgtttttttttaattattattttggtgtgcgcgggcgtgttccagtttgcagatgtttggtatagcgagtggtgtttgtctgcttgaggaaatgtctctctggagctgctgcaaatatttacggctgcaattcgcttatagagttattcatatttttcaacctgtagaaacatctgattagttatcttgacgtgtcaatggagtaacagtagtgggatcttactgaaggaaacaccaggaatacattaaaattgttgtaaaaacgtaaaaatatttttatttggtatgttctcctttgttcatggtttgggcgctaaatctttgaagccctaggagcgccgatactaggatttacttgtcttaatttccccccatgtcatggtataatgatgtactgatttatgtcagtttaaaccttagtaatttggtaaatgtctgaacatattgaaaaatgctgaaccctttattttacataactgttgcttatttgcttcgttcctggttgtttggtgtccttaattatgcattacagggatgcttgattatttttattgtaagcaggggatgctggtttgctgcaatgttaacattagacgaatttattgcatgcaggaatgcattttactaatacagtggttctgttgtaatgaagtttggaaacattatattctaatattgagatgtatgggcagtataagatgttaacttatagtagtaacatgattgcctgatgcaacaaggagggctgaggatccaggtccataaatgatttatcttttcctctttgctatttaatttgtgatctgctaaaataggagtataggacacgccatagtaatacagtatataactgtacgcttgaggctatgttgcttttgattgctagtgtgccactagtgaatagtgactagtattgaagtattcaatttagaaccgtgctgatttccattttagcaggtctttctattacctggatttttatttaagttggtaagcttcactgtcaatatatacagttattgtcaatctttgcatcaatgtatgtctatatacactaacttattagatcgtacaaatgtggctagcagtcttcttatccatggaaggattctattaaatgatttatcttttcctctacaggttatctaatcttctaaatactagaaactgtctcccatttgcttcatagtttaattagcattttgaaatttgacatgcttggtgatcatagttcttttctctacaatttaggctggagagaaacggaaagaggaagaaacagtcgagcttgagggatctctgggcaaaagcaatgctgttaatcaggaactagttgcattggagagagagctcgcaacacatcggagaactggtgctattgattcattttgtttgtacttgtatggcattgttctacgtgataaaggcagtgaagctctacctggaacaggtttggtgggaaactgtaaacacctacccttggaactgg

SEQ ID NO: 22683 - DNA, 1467 bp, Oryza sativa
tctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgttcgcaatgatgaagagcgccaggagaagttcttggaaggacttaatgatgagctttcttacccactcatgactggagattattctgatttccagaagttggtggataaggctattcgtcaggaggacaaatacaatcgcatggagcagaagaaacgccggattgctcaattcaagacacaacaggggaataatcagaagccgcgtcttactttaggaccccagtctgtgccacaggggggttcttcgtctgttgttcgtccgcagcgtcagttcttcaacaacaatgctggcaacaacatccgcaatcaagctccacgtcctgttgcagctccaacacagcaacagcctgccaagagggagcaaggcaacaagcccgtggtgtgtttcaactgtggagacccaggacattatgctgacaagtgtccgaagccccgacgtgtgaaggttgtccctgtccagagcagctctaccgcactagcattaaaggcccgtgtcaatcatgttgctgctgcagaagctcaagatgctccagatgtgattttgggtacgtttcctgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctccttgcaacgtagcccctctgtcagaatagaaattcaaggagtaccatttctggccaatcttatactgttagaatccaaagaccttgatgtcatcctagggatggactggttagccagacataaaggtgtgatagactgtgccaacagaaaagtaactctcaccagcaatgatggtcgagttgtaactgttcatgtattgtcttctgagtctttaaggtcaagactgaaccaaataactttggaagagattcctatagtccgggagtatcccgatgtgttcccagatgatttacctggtatgccgccgaaaagggatatagagttcagaatagatttggtacctggaacaactccgatccataagagaccttatagaatggcagccaatgagttggcagaagttaagaggcaagtagacgatttgcttcagaaaggatacatcagaccgagttaataaccatggggagctccagttatttttgtggaaaagaaagaccatacccagaggatgtgtgtgg

SEQ ID NO: 22684 - DNA, 1097 bp, Oryza sativa
cccgaccttaacaaggcatgtcctaaggatccttaccccttgcctcgcatagatcagattgtcgactccacagcggggtgcgaccttttgtgttttctagatgcatactctggttaccatcagattcgcatggctagggaggatgaggaaaaaactgcgttcattactcccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcattgaggccaaccccgagaagatacgagctatagagcggatgcgcccccctagtaaacttagggatgtgcaatgtgtcaccggttgcatggccgccctaagtcggttcatatcaaggctgggagagaaggcgctacccttatttaagctcctcaagcgctctgggccgtttacttggacggaggaagctgaacgcgccctcgctcagttgaaagcatatctcagctctcctccggttctagtcgccccggagccaaatgaacccctgctactctacttggcggcgaccccccaagtagttagtgcagcgttggttgtggagcgcgatgaggacaatcctcattccgcgcacccccaccctgtgctgacttggcccgggagcgagcagggaggagaggcccccgagccgaacggtggcctaaggcccctgacgaccggagtcggccctctgcccgctcgtcagatggtgctgggcgcccccgaccctcaggaaggccccgaggccactgccggaaggctgcatctatcgccctctgaccccgaggctaaccctgtaccgattcgacccgggaaggagcagggagaagaggcccccgagccgaacggtggcctaaagcccctgacgaccagaagtggccctttgcc

SEQ ID NO: 22685 - DNA, 6571 bp, Oryza sativa
aggcttatccggtcatcaagatcgataagcactccgcacttaaattcattaagggcatcacggttctttttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcgggccttcgagccgcacgctaccagcagagcctgcggcgctaccatcagcgccacgttcaggcccgatctctctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacagagttgcctaacccgtggaacatcgagcaccttcgtcgcttctacccctgaggggggggtcgggtgtcaggtttcgggctcgggccaaccccgcacccccccccctcgggtgtgcagggttggccgggggctgccacacatgcacattctcatttctctcatttcagtatttcaataaaagcagtttcaatttcctaagggctgtatctgtgccgctttttcctttttgaagaatttttgacttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatatccccacgcactagccccgacccgcgcttttcgaggactgggacttgggcacgggcccttaaatcaagctaagacacaaaaagaggaccgcggcacagatcatcctcatctcattcgcatagcaaaataaaattaacacaaagaattttttcatcatttttgattgcagattataagttgatctatacaaaaaacaggcctgaaggccttagaagaaagaaaaagaaagaaattgaagattggcgggggcctgggggctcattccgatgcgcccgggtcgccggcctcgtcttccacgtcgtctgcaccgctggcatcgccctcctcgtcggagttgggggcgaacgcgagctgaggggccgagccctcgaagctgtggacgatgtggtcggcggcatcccggacctgcgcgcgcgcgctgtcttcagtcccaggtgggaactcgtccagcgccatccacggagagaagttggggtccctggcctggtagctcgccaggacgagctccaccgctccttgggcgaggtccctcgaggatgacttgatggtcttctcgagctcctcggggagctgctggagagccccggccatcttcgagaggcgctgggcaaggcctcccaggttggcggcaggctttattgtctgccctttccagaggcccgcctgccgaccggcgcgatccaggcgggagactgcatcccacagcatgccgggccctatctcgcccgccaaacggagggctcggcttccccggcggatgagtctagcgcgcgctgcatgtcggcgacggtgtgttcggcatctgcgaggcgggcggttaagtcgctttcgcccgcagccgccccgccgatgcgcgccctcgcgtccagctccttttcccgcgcctcgaggtcggcagcccgctgctccagcgcggctctctcggcgcggacggattccaaattgcggcgggcctgctccgtcagcgctgcttcgcggagggacagggagtccgccaaccgttgcgcctcggcctcggcctcttcgagagctcgctcccgctcggcaagcgcgtcctcgcggaggcggagtgcggactcctcttcggcgcaggccgactcgtgcgccaccagcgttgcctcccgggaggcgacggcggcctcgtggtccgccaggtccttctccgcgacgcaggcgcgctcctccagcgccatggcgcgcgcctcgagggcctcttcacgccgccggagcgccgcttcggtctccgctgctcgctgctctcgggcagcggcggcatcaaggaccccctgggcggcgtcgagcttttttttcagctccgcctcccagttcccgtgctgaaggcggagggagtcctgcgcctcgttcatcactgtggtggcgatgagggcagccccccgctcctcctccacctctcgagcgatctccgccagtgccgtcttgcgggcctcgaggtctgagacgtgccggcggtgtgccttgcggcccgcttccaccatggcctccaccgagtgccgcccctcctcgacacgcgcccatgcggcgtcgagctccgcacgctccgcctgcagggcctccacctgggcacttagcccatccaacaccgcggtgtttgcggcggcaagggcctgcagaaggggctctgcgctcagcggggcgacggaaggcatgggaaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcccagaagctgtcgcctaggcatcgcccgaggaggtgggcccaagcgacgcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgcaggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccaggttgctcttcccccgggcgtcggtagggcggttgctccccgagcccccggacgcggggcccagaagcacgacccccttcaggggtagattgatcccctcggcggcttccgcctgcgccgtcatggcccttaggagcctgcttctctgaggccccgaccgccgtcataatggtcaagatggaggcgcgatctggatcgctgcagagggggaggataccgtgggggatgagggacgcctcaacggagttgagatttagcacccgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggttggctcggaagtcggaggcgcgcttcgtcggcgaggggggtgtagaaccagtcgctcttccagtcatcccacttcttgcggaggacgcaggggatgtagcggttcagcaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaagggaagaaagaagacggacctccccgggtagtctggcgccgggcgtccctcgcccagcatgactatctcacggccggtggcagattccggcataaagcggcgcggcaacccagcctgcttctcgctcacgatgcgggaaggcgcagcacactaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaagtcccatcctcactgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgtagcagtcgagatagatcgtatcgtgcgcgcgttaattacgctcgccgaccgaagcgacattaccgtatctccaggcgaagcaaatcggctcgcccagattcgtgcgccgctcaggtgatgtggcagtcttgaagagaccgcccattattgacagccaaattaccattatcggcgtgcatggtttgagaccgttgggtttctgcccaaccatggagaccggtcccacctgtcaccaggctttaggagtggcgtcacacccggccgcttcccataagaagggcgatcgcccttgcataacgccgggggctactgtcggtgacatgggaccgggagtatcatgactagaggcttgaggcagacacaatcgcccacgtggcctggcaccctcgggggacgtcgagcccgagggtgatgtgtgcgcccacctcttggtctccccgaggggggggggtcggaccactcttgcctcgcccccgagggccgaggcgccccgaccccttgcggtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtcagacgcacgcttcgccccatcctgtcaagacgagagcttctaggcactcgtccccggctggagctagcgtgttacatcccaaagatgacacgttagccccgatcgatatatgccaggcttcatcctaaccattacaagcaagatgttgtttgaagaagggcaaacatacacgttgctaagtcaacgcgtggtggacaagaatgaccgatttgtgaccggtctgacactgctcatgtcgtcagcacactgccaccttcccacgacgtgcccgcctcaggcacgagtggaggtaggtgtgtcccgtcccgtcaggaggatgcttggaggacgaccgtgcaaatctccgtccatttatgaagagaagaaaagtccagtttggaaagggaagggtgcatgtggtatccccttgaagtataaaaggaggaccttgcccatagaaaaggaggatgatcttttccagattcagaacctagaacaagggagaggttggctcacactttgtagctccttcatacatagatccaccaaaacacaggagtagggtattacgcttctcagcggcccgaacctgtatacatcgcttgtgtttcatgctcttttgagaggtcgcgattttcccatatacacggagagcttgagatctcaccctgagcccccggccgaaccggcaaaggggggcccgtgcggtctcccggtgaggagcaccgtgctccgtcaaagtggactcctaaatgtgcgcacgtatccgttgccacgtcttgccatcccacaatccaggacacgacgagcacgacaccagctccgcgcgaactcagcgcgtgtcaagccttactgcacatgatccgaaaacaaagccaaattgtgtttgactaagcaaagtagaaagaaccgaaagcagggaaaactaaaacaaacaaaacagctagatttattcaacaaatccgaacaaatcca

SEQ ID NO: 22686 - DNA, 4487 bp, Oryza sativa
  unsure (1)..(4487): unsure at all n locations
tcccatatacacggagagcttgagatctcaccctgagcccccggccgaaccggcaaaggggggcccgtgcggtctcccggtgaggagcaccgtgctccgtcaaagtggactcctaaatgtgcgcacgtatccgttgccacgtcttgccatcccacaatccaggacacgacgagcacgacaccagctccgcgcgaactcagcgcgtgtcaagccttactgcacatgatccgaaaacaaagccaaattgtgtttgactaagcaaagtagaaagaaccgaaagcagggaaaactaaaacaaacaaaacagctagatttattcaacaaatccgaacaaatccaaccaaatccgcagatgctcaacccgatcgcgctcagcatcgacgacgacgcggcgccaccggcctccggcttccgccgcgccaccccgccccgccggacgtcctcgcccggacaagctctgacaggtccccggcgttgtcgccgccgttcgcaaggctcgtttgctgcctcgagcaggacgcgtgcatcgacttaggcggcggcatcaggtcgcgcggcgcctcggacgccgcgctcggcccgccacactcctccgccattgccgtgtcgtccttgcaaggcttgccttcaccgtcgccgtcgccatcggcgcccgggccagcagccgcagccgatgccgccgccgcgacgggcgcctcgtagaagaggtccgagaagatgtccttctccagcgagttggcgagcacgaacgggaaccacagggcacaggccggcctcatcttcgtgcaccgccgccgccaacccttgcgccggcgaggacgacgaaggtggtggtgctatccccggccacctgggagcgggaggacgggaaggagcgagggggataaggacgggaacaagacggcgtgagagaggaggacggaagaactaactggagtggcatggttctaattttagaaatttcgagtggcatgtaaccgatatgacgaatagtagtggcattttttcaatttggcaaagttgcagtggcatggatccaattaaccctaaatcaaaacaccatacagagaatttaatgctagaagtctaaaaatttgcttcgttacacatgcacaaggcgagcggtggacccgtcctgcccttgtgcatcgtcaagaccctatactatatgattttcatttctgatgtattttcacggatgcatcatgcatgcgtattctataacaatcacgcaacatcacaggcttgggatcaattggatgtacgccttccgagcaaaaaaaagattttgtagctgtgcatatttttcttggttgtttctcccactgctacagaaaaggttgtgatcaaatgttcatggcctcgcggtacaattggctatgttaaacaggaaatcagtcttaagtttggagcaattcgggttcttcagttagcatgggtcttgtccactggccggcttacaacgcacaaatggacttaattttcctcttgttcttgaatacagattcctggtgcgtcccattctcagtatgtacgtaccaagtcatcaccatttccgccttccataatccctcaaaattgctcatgattgatacccctttaattcgcacacacaacacaatcagataggtgtgaatgcttagctagccccggttttaagagttgaatcagctacaacatatgtaaacattaaagtcatttgtacatttaaaggttatgttaaggaggagagattgggaacctctctcccgtgtacgaaaaacgggtttgtattagcacatgattaattaagtattataaaaaacttaaaaaatggcttaatacgattttttttgttgcaactttcttatagaaattattttgcaaagaaatgcatgtttagtacttcaagaagcatgcgcgctggtaacgagggagtggaggttggaagccttcacttgcaagcacatcataagtacacttaggtacacaccagctagctagcatgtgatttactcccaagaaactagttgttaattagcataggggtaagaacagtccacaaaaaagggtgcaccctctataggtaccatcattagtttcgctatattaatgccggttccaaaaccatcatctacgaggagtttggaatcaacatcaataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagagtgtttctctgatagtaaaccacaccatgagaaaccactactccgtaatcagtagactagtaaagcacactgtcgatccgaactttgatgccattggaaacatcaaacactcattaatgtcttgtatcccttacgcactaaaattctcggtacatatcgttcctagtgcacctcaatgcctcatttgtttctgattaagatatagattttatcttggtttccgttagtacactttcaaactactaaacggtgtatttcgtgcaaaaaaaaacattctatatagaagttgttctaaaatattagacaaatccatttttcaagtttaaaataattaagactcaattaatcatgtcctaatggctttctcttttgcgtgcccatacttaatctttatcttcatcacttatggcaccacctcgaacttgccatgtctgttagtagttcgtatatatctctttggtttcgagacggaacatgggttgctcttcctcttacaaaagtcaaatacatgcacaagaattccatcatgtagactagaaagttgtctcactttatatgttgagcaaatgagtaatgtcatatatactcacaaagctattaactagtggagtcaagcaacggcttatttgcactccacatgttcatggaggcgacgatcgatcagactcgacttgagtagttgggcctgaggttgatcagttgttccacagttcgagtttagccatggaacacaacttatgctcttggcatcgtgcactaggctatagcccgacgtaacatcatccatgtgggttgttataatcccttccacgacattgtggtcaaatgatgaaggaccggtgctatggaaataggctgctaccgatggcattgttgccgatctccattagcaaactaacaagttccgtgtatgcatcccgcttgtatatataagcttgacgtcgtcatggtattgtccacgacaatgcccatctttccgtggatgtgtggaaatttcaataggtggcggtgtgaagaaaaattctatgacaactagattgtgagaaccaaatcatttttttaattaacaaattgggaaccaaactgtgtttgctaccagcttcttcttttttaaataatggaaatggtttacgtcttcggcctctatcagcaggcacatggtcaataaaatttagtattgagaaagaaaaataaaatcaatagaaagaaaaataaaatcaatatagagtgatggaatacgtccccaatctctgtaaaaagataaccgctgaattaaaagctaagaatgcataggcgtgggaatccaaagctcgggtgaaacagattggacctggagagaataatgttggggctaggtgattgtctgattatgcattatgatactgctgaaaaacagcaaggatagccaaacccacatccaaaataaaagcaaatttagacaagaggtcagagacccggcttttgattgtaagccgcaaaaattaaaagcaaatagctgtcttttgttctgaaactgtggagattatggataccccatatctacacagcgattatatttagactggatataggataccgaatatagatagaatatctttatttgtatctcgggtttgtttcttaacttgtacgtcaaggaaataccctgaggcttagtcggttacgattgtattttatctgtactctcgtattctgataaggatatgagttataccttgtaatacggactccttcccctatataaggaggggtccgagtcgttcctgggacatcaactttcttggagattatacatccaataatacactcggcggattcatccccggacaggagtagggtattacttcttgaannnnnnnnnnnnnnnnnnnnnnnnnnnnnnnnnnnnnnnnnnnnnnnnnnnnnnnnn

SEQ ID NO: 22687 - DNA, 14549 bp, Oryza sativa
  unsure (1)..(14549): unsure at all n locations
aagggtacccggttttccgcaccccacagcagaatgctgttgccgcgatcaccctcctcgacaccctcctcaaggaaaacgagctcaatcagtctgaccacgtcgtcaacatcttgaaccagacaaagaccatgattacggcttcggtcccagttaactccggaagcgtccgcacgccgagcggtagccgagtccctcatcttcgatctcacgactaccaccagccaagccttagcatcgctggcgcatgatctaatcgcaggagcaggggtcacgacgagcgatctgtccactcgctcccgaccatcatagggagcgccgagtggaacgaccccgttcgccacctcgtcatcgccccgtcgatcttcgcgacacgatcatacagcgccgggcaactcgaggccatcatcattcaccggatcgccacgacgatgacctagacggagtagccgctttcaccaacgacctgcgtcgagtggattggccagccggctttaagccgactggaatagagaagtatgacggtaccaccaacccggaatcatggcttaccgtctacggtctcgcaatccgcgcagcaggaggagatagcaaggccatggcgaactatttaccagtggctttagcagattccgcccggtcctggatccatgtattgccccgtggtacaatcggatcttgggccgaactacgcgaccacttcatcgccaacttccaaggcactttcgagcgccccggcacacaattcgatctctacaacgttattcagaagtccgaagaatctcttcgagattacatccggcgattttctgaacaacgcaacaagatctctgacatcaccgacgatgttatcatcgccgcattcaccaaaggaattcgtcacgaagaattggtcgacaagttcgggcgtaagcctcccaaaacagtcaaacttatgtttgaaaaagccaacgagtacgccaaggctgaagacgccgtcatcgcatcaaagcagtcgggctccagttagaagccaaaaaaggatacgctggctacgggagcgggtggaagtaacaatcataaggaccgcaagcgtaagcctgaggaacttgttgcaaccgctactcactcttctcgacagcgttcacgcgtcaacacattcgacaagatcatgaactcccaatgcccgcatcatcctaactccaaccacgtggccaaagattgtttcgtctacaaacagttcgcggaacaatacaccaagactacacggaagaactccgacgaagaacaaagcacgtcgaagaagaaggacgatggcgaccccccggcaggttttcaagaccaccgcaaggagcttaaccacatcttcggtggcccccttggcttatgaatctaaaagaaagcaaaagttgaccgaacgggagattaacgctgttcagcccgacacaccccaatatcttcgatggtcagagacagcaatcaagtttgaccgctcggatcatcccgaccgagtggtccacccggggcggtaccccctggtactagacccagtggtccgtaatgtcaagcttcgcagaaccttcatcgacggtggcagtgcactaaatatcctcttcgccaaaaccttggatgacatgcagattcctcgctccgagttaaaaccaagcaatgcgccttttcacggagtcattccagggttatctgcaactccactcggccagatcacccttccggttacctttggcactcgggaaaacttccgcacggagaatatctgcttcgaagtcgccgatttcgagacagcgtaccacgccatactcagacgcccggcgttagccaagttcatggccgtcccacactacacttacatgatgatgaagatgcctggtccccgaggagtcctatccctacggagcgacatcaagcaagccgtcacatgcgacaaggaaagttgcgagatggcccagactcgcgagatggcgtctgcccgagaagatatccgactggctgcaaccacggcaagcgaaggagaagtgcccgcgaccaaggtctcaaagagcggagaaagcgaagctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctggtattcctagagaggtgattgagcactccttacatgtcaaagaagacgctaaacctattaaacaacgactccgccgcttcgcacaagacaggaaggacgcgatcaaggaggaattaaccaagctgttagcagcaggcttcatcaaagaagtccttcatcccgacaggctggctaacccggttctagttcggaagaaagctgggcaatggcgcatgtgtgtcgattataccgacctcaacaagtcttgccctaaagatccttttgggttgcctcgcattgaccaggtagtcaactcgaccgccggctgtgagctactcagttttttggattgctactcggggtatcatcagatccgactaaaggaatccgactgcttgaagacttcattcatcacgccctttggggcctattgctacatcaccatgccattcggactaaaaaatgcaggagcaacttatcaacgtatgattcagagatgcttctcaacgcaaattggccgcaatgtcgaagcttacgtggatgatgtagtcgtcaagactaagtagaaggatgatttaatctcggacctagaagaaacctttgcaagcatccgcgctttcaggatgaaactaaaccctgaaaaatgcaccttcggagtaccgtcagggaagctgcttggttttatggtgtctcgtagaggcatacaagccaacccggagaaagttactgctatcctcaacatgaaaccgccaagctcccagaaagacgtccagaagctgactggatgcatggcggcgctcagccgattcgtttcacgacttggcgagcgggggatgcccttcttcaaattaaagaaaacagacaatttccagtggggacccgaagctcagaaggccttcgaagatttcaagaaactcctcaccgagccaccagtcttagcctcgccacacccgcaggagccattgttactttatgtatcagccacctcccaggttgtgagcacagtcttggtcgttgagcgtgaggaagaaggccacgtccagaaagtccagcgaccgatctactttgtcagcgaggtcctagctaactccaaaacgagatatcctcaggttcagaagctgttatatggtattctgattactaccaggaaattatctcactacttccaaggtcactcggtaacggtggtcacatcgtttccgctcgtcgatatactgcacaaccgcgaagcaaacggacggattgctaaatgggctttggagttgatgtctttggacatatccttcaagccccgaacttcaatcaagctagccgacttcgtcgccgaatggaccgagtgccaggaggatacccccgcagaaaagatggagcactggaccatgcattttgacggatcaaaaaggctttcgggcactagagcgggagtggttttaatttccccaactggagaaagattaagttatgtgctttggatacatttttccgcatcccacaacgtcgcagagtatgaggcgctcctccatggactacggatcgcgatctccctagggatcaagcgtctaatagttcaaggcgattcacagctagtcgtcaaccaagttatgaaagagtggtcctgccttgacgacaacatgacggcatatcgacaaaaggcacgcaaattggaagacaacttcgatgggcttgagcttagtcacgttctccgacacaacaatgaagccaccgatagacctgccaactttggatccaagcgcgaggtggcgccctccgatgtattcgtcgaacacctttatgagccgaccgtacctcagaaagaaacaactcaagttgcggacactcatgacatagccatgattgaagccgactggagagagcccctcatacgatttttgacttctcaagaactcctccaagataaagatgaagccgagcggatttcaaggcgaagcaggctttatgttattcatgaagccgagttatacaagaaaagcccttcaggaattctgcaacgctgcgtatctctagaggaagggaggcaattgttgaaagacatacattctggaatatgcggaaaccatgccgccgcacgcaccattgtcggcaaagcttaccggcagggttttttctagcctactgcagtgtccaacgccgataaaattgtgcgcacgtgcgaaggttgccaatttttcgacagacaaatccatctaccagctcaagagttgcaaacaatcccactgtcttggccgtttgcggtttgggggctcgacatggttggctcgttcaaaagggcagtcggcggttacacgcatctctttgtggccattgacaaattctccaagtggattgaggctaaaccggttgtcacaattacagcagataaagctcgagatttcttcatcaacattgtgcataggtttggagtgcctaatcggattatcaccgataatggcacacaattcactggcggagtttttaaagacttttgcgaagacttcggaattaagatttgctatgcctcagtagcgcatcccatgagcaatggacaggtcgaacgagccaacggcatgatacttcaagggataaaagcgcgagtttttgaccggctaaaaccctatgctggaaaatgggtggaacagctgccatcagtactttggtctttgtgaactacacccagtcgggccacaggccagtcaccttttttccttgtctacggggcagaagcaatgttgcctagtgaagttgaattcgaatctttgcgctttcgcaattttcgcgaagaacgctacgaagaggaccgagtggatgatctgcaccgattggaagaagtccgcaaagcagctttaattcagtcggcccgatatttacaagggttgcgacgttatcataatcgcaatgttcgatcccgtgctttcctagtcggcgacctggttttgaggaaaattcaaactatacgagatcggcacaagttatctcctctatgggaagggccatttatcatctctgaagtcacccggccaggttcctaccgactcaagcgcgaagatggtacacttgttgacaattcttggaatatcgaacatcttcgtcgtttctacgcttaagtttatccatgtatttccctatcttgactgtcaacatcaagctttcttcttgaggttgtcagtcgggggctaccataataataatggagtgtgattttttatcaattcaatttgcttacttggtctatcattgccttgtttgatttttctacttagtttacgaggactgaaagtttttaatagcttttgcgggttttaggctcaacaaagcttgataaaggcttttaagaaatcaacagctaagccagaaacaccaagcacagcataaatacaccggtattatacaaattgtgcctccatcattcgtcattcgaaacatttacatttaatcagtatcagtcttctcatcatcagagttattgttaccagtcggcctaaggtcggtatcctgaaaccgatctacgacgtcaccagcaatcttgtcggctgctttttgagcgtcgttgataagatcaagggcagcctcttcgcttgtcccgtccgcaaaaccatcaacagtatcaatatcgatcttagggtacagggatttggtcattgctaacgctaaacctgctcccatgcttccggcttctctaatgttcttgaaataggtgtccgaagcgattctcagcttgtcaaacacttcggaagcatcgaatctactcgggccattgttattatagaacattgcctggacaagcggggtagcagcattggcgacctcatccctggctccttcaagtcttttgatcttgccaaccaggacgtcgaactgggcttgggacttgatcttgcggtctacaataacaaattcatgtcaataatctgctgcatcaaagagagaaactcaggttgttggctaacaataccttcaacctccttcaaagccgagtccctttgtgcagccaattctgccttgttattttctaaggcttgaattcgtttctccagttgagctatcttggcagcttgcactgtttggattccagacggttgaggatacaattataacagcacaaattaatggggcagatcttgaggttaccttttgatgagccacttagttcaaagttcgaatcctggagttgggtaatccggtcccttagatcatgctctgtctttttggcaagctctttggcttcgtgtagctgatccctaaccgcttcaagggtccctaaatgaggaaccagcttttctaaagttgtggttttggcctcattacggagatggattctctgcgcaatgattcacggtttagtcttgctgagaaaaaacaaggtcaccaaaggcagccacctggaagacttacatttacaatgcgggtagcttctccgagtgctttcttcaactggcgcacctcttcgtcttctttctgtcgatttatgacaatgcctgcaggttgcaagttctcgtcccaccatttgattaagatggggggacgagagtcagcagctgcctttatgcgagggatttcatctctgtcaccgcctagtggtcctgatgtattcccagacattagacaagcaaatcggagttattcagattggcattacttgagaagatgggttacctgaggtgatttccggttgagcgtgaggtgatccttgccctttatctggagacccaggcgttgggtcgttaccagcgtccggtctctgggaagttgtagcctgaacttcaacttcaggaatttcttgatctggacctacttccgactgattgccagtcgggggctcttggtttgttgcggtttctgcttctgccgactggtttccagtcgggggctggtcgcttggattgaccttatcagttgaagtctaggctccagtcggctggtcctcagtagtcggcccagcttctttggatgaacctgtctctgtgttagccggatcagaatccttcccggatggatctatgtcagacggtttcctgcaaagtttccttccagttttcagtattatcttcatgagagaagcatgtcgaagtgaaacggtaccggatggtttatacctggaggattttctaaactttggcatggggcggttagacagtttcttcttcggagcagtgtgctttggtaattttttgggtgatcccttatccccaaatttattattgtcgtcgccttcgtcgtcattcatcacaagctttctcttgcgagaatctgtctgcccagtcggattgggagttttggattaggagtctgacctgatttttggtcctccactcccctgaacggtctgatgacgaggggatcagcgttgagcgattggggggtcagactttatcaaagcaaattcctgaatgaaatgcctccatggtcagttaattcaacaagaagacaaaattatgttttgatcacggtttgaagtgttctgatacataccagcggaggaggattgaatgcattatatggcacgactggcagcagatgcgaataactgacgacaatggcatttgagaatatcttgtacatcctctccttcatgatcttaaagtccagagaatctgggtcttcacggtttggatcatgtttgccgtcaaactcgaatgctgtacgagatctctctttgattggagctaatcggcacttaatgaaatgccgagtgatttgctctccctgtaagccttgctctttgagcttcaacatgcgctccatcagttctaaggcttgggcagcttcatctcccatgggaagagagttccaggtatcttggtatactgggggaagacaggagtactcgggaagagcgggctcgggattttgaacataaaaccagttggcgtgccatcctttgtttgaagtcttgaagggcatagaaaaatacttttggctcaaagtccctctcagctgaaatccagcccctccaactacgcatggtttgtttttgttcggttggggcttaaggaagaagattcggcggaacagagcaaaatgaggcctaatgcccaaaaaagcttcgcagacatggacgaaatttgcaatatggactatggagtttggattcaaatgatgtaaactgattccatagaagttcaatatcccacggaagaactttgaggttggaagagcaaatccgccatagaaaaaatgagagaaaaccacgacctcatgtgtatcgggggttgggaaagcttcaccacatgctggccgccatccgataatctccttggctgggagaacgccgtgcgccaccatctccttcaagtttccctccgtcatgtcggacgacgcccattggccttcaaagctttctttttcttccgccatcgatttgatccgaatgagctgatttgattcgagggatggctggggagagatgtggaattgaagcggtgagtcgcggggaggattttggtgaactttttggaggtggattggagcggaatggtgaaccctagtttcgccggcgcagttctgtactatagcacggaatggggaaaatggcgagagttccggcggggaagacgaagcgccgcttagacttcgggattttttgttaagggtttcgggggtgctaatgggcctaggcctgataagtacttcagcccaatattattaacagtgtggcccgttgtgctccttagggacttaggcatttttgctttggcaatttatgctcgcaatggtgtggcccaatgctgataaaatcctttttaatgcggttatataattcttcggaattattgcaatgcaaattaaaaggtacccggcagaaaagtgttatactatttttgtaagcttttttaggctgcaaaagctgtctgggttaatttgggatgacttgtttttacaatggtcattctcttggcgtgttatatgcctattttaattatggtgagagtcatagcctaggctattagacttatcaattaccatgatttttataatatttgatggattatctttagagttttttactcagatgcctgtcaaatatgttcatttgtgaactttttagcgtgttattcactcggatactttttactatggctgaaaagcagtcggctgaatgccttgttgggcgccgcatatgcttttgtcatatgatacatgattatgctattattttgttctcgactacatgtttagtttgttaactaatcatatagtcgggggctacacctaattaggtgcatctattcgatgcaccatgttttttatcttttcgccctttacagtctttgtcttcgctactcggcaggccttagcagggaaaaattaaagcactcggattattatttttgagaaagctatgttgttgactgcaaaggtctcgggggctactgtggagattatggataccccatatctacacggcgattatatttagactggatataggataccgaatatagatagaatatctttatttatatctcgggtttgtttcttaacttgtacgtcaaggaaataccctaaggcttagtcggttacgattgtattttatctgtactctcgtattctgataaggatatgagttataccttgtaatacggactccttcccctttataaggaggggtccgagttcttcctgagacatcaactttcttggagattatacatccaataatacactcggcggattcatccccggacaggagtagggtattacttgttgaataagaaggcctgaacctgtgtaaatcctttgtctccaaacccatccacttttctagcttgatagccaccccttttagtattgccgaaatcttgtttcgacagaaacttccttcaggtcgtcacggagttcaaaagttcagacttgagagacaagacatgattgacgactaccgtgtctaacacgaaattctaataccttgaatcgtgagggcacattgaagattttgattcaattgttggcatgatcggcaacactttgtgaataaaatggtgaatgaaatatggaggaatagttcatgaaagctaaaagcacagttgcaggaaataattaatcaaggttcagatcccctggtgagttgtaagcagaatttcaggacacgtaagttttagagtcttcaggttgtggttgtaacttgtgaagaacgacaattggtatatcatgaaaataatttcttgagaattattcatcttgaagttgggagaaaaaaaaaatgttgttccctcgtgtggcaattatatgaattaagttagctgtccccaaaagctgaattggtaaacacctgttaattaatcccccgctgtcagttatatatcaggtcaaaaccattttgcgaatgtcagtgcttgtagttctgttgcatgttgaatatagctcaagtgcttgctagctcagtatggtgcaagctgagttgctgacgtgcaccctcttctggcttgccgaccaacggcgcccgcatggcggagctttccgccgtgcctaccaccgtggggcgagaagcctgctagcctacttaccgttcaatttgcatccctatttccttttgggagctcctgtatttccgtggctcgatttcgggtgcatcccaatcctatcttagcagagctcttcatactccattggccgtgatgtatgccccatttcatggtccccctagtggtaaagaccagtgatttataggctgactatcggctcgtagacgccattttaaagtcgagatttgctccggtcaaaaaaaaaaaaaaaaggcctcgagatactagtacctcacagtaccaaatcgtttctgatcattggatctaacggtgtccatcctgtccagctagatccaacgatcataaacgatttaacactgtgaggtaccggtatctcgagatactttttgttggaccggagcaaatctctttaaagtctatacttgtagttcaaccagtattttctttttaggaaaactagttcagacattcaggactggtgtaggtggctactgggcatgacgtgcacgttgttcgctcctttttttttctgttcatctcagaaccacaagttgcttgtagcacaacctgccctctgaagttcttcttttcttgcaaggccagcaaaaacagttatggcaatcggtcttcaacaaattatacggaatattgcaacctcaaatttagtttggaccaagaaatatgtgcctagacgtgtatgtatgaaactacgagcacaaacttgccaatgttagtattagaatgggttgagcgtgtccaatagagtggattgagaacatcctaaaagaatttggggccaaaacacttccccatcactaagagctagcatcactaaatagattggcttaattgttcccaatccaaaacttttgggatttaggacaaaaaattactccaacagattcccctgctactaaatatttgaagttctcttacctgggtttgtcggtctctacttgtaggactgcgagggcttccaatccatctcattctgctgcagtgctgctttcctgttgcatctatgacttcccacatcgggctagggactaggatggttgtgcgaggagattgcccgttgacgaggtaggatttcagtagtttagcagagggctcactattttgttttagagaatcggtttagttttatattctctttgacagatgagtattttcacttcctatattcagtttaggaaaccaaaataaaattttgggatggattattgccaatctgttggggtgctaaggctaaaaaattagtttgttcgttggccactttgccagtaggatgggactggtccttgcaacgatcattgtttttttttctttttgttaatttcacaaaattacggatacattaactaaactatcacaaaactatatattttaagatgttatataaaaaaatacatatttaacatttaatttatcataaaactatatatttaaggtcaaatatcataaaactatagatttattaaaaaacttaccatgaaactagaactttcggatccatttaatcacaaaagcagagcataatttggtacgcgccgccaacaccgccgtgttgagcatgctcctccatgttaacagatttggctcctattcccaatgcgtcgcactcctaacaagtaatgccctccacacaaacaagcatggattcacaaacaatgtcaccatggcacatcgtccacaagtgaggacgcactccactgccctctggatgggccatcaacattcgagctcttggcagctgtggcacacaggaacaggttggagttagactgaataataatatgagtagtatggttttttacagacaatgtcattaggctgttctagctctctgaaaggacatgtatcctagtggttgtagcgacctgatcgagtagcacctcaaggtcctgagttcaaaatctgcataggagcggattttagattggtttatttgaggactaagttttctgattgatagactaagtttctagtttaaaaagactgcatatatctagttggatatagaggccgggtaaaaaaaacttctctaaaaaaaagtaaagctctgtacatggtgctatggctggctgatccctcttttggcctgtccctcacaactcaaggtttaccaaataatttccatttttatgtattttcacggatgcatgttttgttgtataacactcatgcaacaacagaacgaaaataattaatgggacactttcgaagcaaacacaaggattttcagtacttttgcactctgttttcagttttctcccttctcgttactaccatggtaaaggtcatcactgtctgttgaagtttcccagctagcatagcttccgttcactggccggctagcatagaaatggacttgttctttttatcttattcttagggcatgtttagatcctctaagatggtaaaagttttaccattttggagcatttttgtctattttatctaaacattagtagcaaaagttggcaatttggcatttgtcatttgctagtctagggtagcaaattttaccaaaaaatgttccaagacaacgcgctttctctttctctttctctctttagtgataaaatggcaaaactttagaatgcatctaagcaccaactccataccaaatcttttgccatcaaaacttatgccatttgctatttgccattccgaaaggatctgaacaggcccttgaattcagattcctgctgcgtcccattctcaatatgtagcccacaccacggaatcaccattttcacatgccttaatccctcggaattcctcatgcatgctcgataccgcttaattcgatcacacaactcaatcaggtaggcatcaatacttagctaggccccagtgttgaaatcagctactacatgtgagtgcagtgcagttatttatagacaaggtgtggctgaatcaataccaccacagaccccctcatctctcaagggttgtaacccatatacttgtggtgggtataggcctggttacaggtgggtggccaatgatgacaaatctcaatgaacacccgtcatagatgagtcatatgtgactggtgagtaagtcatctatgacggatcgtaaaatgtcacctgtcatatgtgagtcatcggtgacgtgtcgtaacttcccacccatcattaatgactcatatctgatgggctataacttacgaaccactactaataataaatcacgaatcatgatttttaaaatttaaatgcacagaagaactcaaaaaatactttggagttttactagccatcttatacataatcacacatcactacccacaaatctatgattttgtgactcatctctcatgggtcataacttatgaaccatcactaatgacaaatcaccaataactatttttgaattttaaatacaccaaaaaaactcaaaatatcttttgaaatttactagcaatcctatacatgatcacacatcactagccacatatcaatgaaatttcaagcaatgtacacacctatgtgtttgatgagttttgaagctgatgccttccactctacaaagagcacccttgccaactcatctattattcttttgacttttgactattccactctgaatcatgtaacatatatttaacactctaagtgacttcaaatgaaaacgtcttgttctacaacttttatatccggaagatctccatccgaggtcattaatagaatatattcaacatttcgtttttctcaatataaatctcaacttataatagatatttgggcttataaactatctcaaataaaaatattgtcaattataatattgtagatctagttgagttctacaacttcaatacannnnnnnnnnnnnnnnnnnnnnnnnnnnnnnnnnnnnnnnnnnnnnnnnnnnnnn

SEQ ID NO: 22688 - DNA, 1059 bp, Oryza sativa
gacgcgggagtccattgagtctaataacatgcccggtggagaagtatcatcgacaaaaggtttaaaaataaaggtatatcatgtactcgttgtggatttttcagctgataaacaatacaaatgattcaataagtagcaataagtgactaattatttaatttcctctcaatattgattttgtagatttgggcagctttttgacgaaaagtagtgctagcacatgttcccctcatccaagtccaagtacccacggtgatgatgcgcctgtagaatccatcgccgaggaagtgcttgaagagcctgttcagtgtcttgagactgtgatcgaaaatacacaagaacaaccagaacttgaaggtattgaacttattagggaatttgactcagaagttcatgttgttgttgatccgactcttcgaatcccaatagagaaattccatccggacattagatcagaagttagaagagcttatttgttgaagggacctacccaacctaaaattacatttccccgtaaataatatgggtctgataggagatattttcgagcagagtggtatgctaactatgattggttggaatatagtgtgtcaaaagatgcggcttattgcttctattgctttctctttaggcaggaagccgatcatgaaaaatttggccacgttgttttctcaaaaactggatatgataattggaagcatgcatatagagcattccctactcatgttggtggggtttccggttgccataataaagcaaggagatgtgccgatgattttaagaatcaaagggcaagtatctcacataaagttgacactgttagcaaagagtcagaaaagttgtatgaaatccgtttgactgcttctttggatattgcaagatatctcatttcgcaaggtcatgcttttcgtggtcatgatgaatctccttcctccctaaataagggaaatttcttggaactttttgattggtataaacaaaggagtgaggaggtaagagttgcatttggcgagttatgtccggataatgctcgcatgacttctcataggattcaaaagg

SEQ ID NO: 22689 - DNA, 749 bp, Oryza sativa
  unsure (1)..(749): unsure at all n locations
nnnnnnnnnnnnnnnnnnnnnnnnnnnnnnnnnnnnnnnncagcaacacatggtaactagaagaggatttgacacatacttcaatattgagaagagcattcaaaccatcctctagtgagttcaatagagatgaatcctgtaaaagagatggaagtacaatcattgatttggaataagaaaaatgccatattttagaagaaaaatataggcatgatcgcttaaacttacaagggtgcaatgtgctccacaaataagaagcttcaagttcacatcttcatcatatatctttatgtctggaaaatattccgaggtatcttcttcctcggctatttcgtttccaggaggggtgatatatatccttggagcatccccaagtagatgaggcccaagcataagacgttgcacctcattatttcttacacaatacagttgaaaagtagcatatgcaacctgaaatgcatcccatgcatggctacaggagctacaaacaggaatacacaattattggataaagaaacaaaacttaatggcttacaatatattcaacaaatgcaagacggatatgatacctctgaacaactgacatcaaggaatggcgaaaatgagatgctgcatacgatgataatgaatatctccaatacattatatatgaaataccctagcaatgaaagagtgtgaaaattgcaaatctgaaattagaaataagattccgaagtataatagcacattaggaattgtattttgggtgg

SEQ ID NO: 22690 - DNA, 1171 bp, Oryza sativa
  unsure (1)..(1171): unsure at all n locations
caaggtgttgaaatggaagaagatgaagtggaagacgacaatattccggactttgctcagtacgctggatttgaaggaaataaaacgggtgaggaggaaagggatgctgatggtaacaacgttgcggatgatcttggttagatgttgcaggacgccaaggaggattgtgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggaggtaaacaaattgcccgagacaacgtacgaggctaagaagatagtctgccctctaggactggaagttcagaagattcacgcatgtccgaatgattgtatcctgtatcgcggtgaggagtacgagaacctagaagcatgccccatttgcaaagcactacgatacaagattagacgagatgatccaggagaagttgacgggcagctaacgaagaaaagaattcctgttaaggtgatgttgtatttccctataataccacggctaaggcgtttgttcaggaacaaggggaatgctagaatgatgcgatggcacgctgaagagcgtcaataggacgggatgctgagacaccccgccgatggttcgcactggcgaaacatcgacagaaaatttaaagactttggaaaggacgcacgagagtcgacatacggtttggtttaagtacggatggcatgaatccttttggagagatgagcagcggccatagcacttggtccgttatgatgtgtatctacaacctccccccgtggctatgcatgaagaggaagtacataatgatgccgattataattcaaggccccaagcaacctggtaacgacatcgatgtgtacctaagaccactggtcgaagatcttaaactgttgtggaagaaggaaggtgtccccgtgtgggatgaggacaaacagaaggagtttaacctacgagcgctgctgttcgtaaccatcaacgattggtctcaccaactgggactaaagatnnnnnnnnnnnnnnnnnnnnnnnnnnnnnnnnnnnnnnnnnnnnnnnnnnnnnnnnnnnn

SEQ ID NO: 22691 - DNA, 7764 bp, Oryza sativa
  unsure (1)..(7764): unsure at all n locations
nnnnnnnnnnnnnnnnnnnnnnnnnnnnnnnnnnnnnnnnnnnnnnnnnnnnnnnattgccgaccgttaacgaacgtgattgaaacgtgaccgaacgcgaacgaacgtaacgaaacgttaacgaacgcgaacgaacgtgcacgaaacgttaacgaacgcgaacgaacgtgaacgaaacgttaacgaacgcgaacgagcgtaacgaaacgcgaacgaacgtaacgaaacgttaatgaacgcgaacgaacatgcacgaaacgttaatgaacgcgaacgaacgtgaacgaaacgattacggaacgcgaacgaacgtgcacgaaacgcttacgaacgtgtatgcacttgtactaaaagtgtgagaacgaacgcgtttatactaatacgatttactggtaatacatatatgattatatatgtaacttggcccgtttagactaatacattttcctgataatgttgcagagaagacatcgtcgtcgtccctcaagccgaagtggtagctagccatcgaaggaattcgcgcaggcaaatgatgtaaagaagtgattgttagatatttaatataagattgttagacttagcatatatgattattacaattttaatataagattgttatcgatttaatataagtttgtaacacttagcatatatgattgttagagatttaatatattattgttagacttattatatatatgtgactattacaattttaatataagattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagacttagcatatatatatgattattacaattttaatataatattagtagcgatttaatatgagattagtagagatttaatataagattagcagtgatttaatataagattgttatacttagcatatatatatgattattacaattttaatatgaaattagtagcgatttaatataagattattagagatttaatataagattagtagagttttaatattacggttagcaaatacatcctatatacctaacaagtattttttgtatgcacagatggctgatcgcgatgaggaacagatactatacgatacaatcgcagagagaagcagccagtactggaacgaagaagaggggaacgaggatccaaaccagtacttgaacgaggaggggaacgtggagagggatgcggaggggagcgaggaggggaacgatgaggaggaggctagtggaagtcatccctccgctggacagaagagggcactcggacaacgaggtgccgcgaagaagatagagggtcggcacatcataactgaggtggacgaagacggccgacctagtgcctcggcagaagcagccaagaattttgtacgccacagcggttgggttgtgagggacaacgtgcctgtcagcacggtgtactggcacaaaacaagggcacgcagggatatgacagtttgcccggactcaagaaagagatgctgggaccacaatgcttgagacgttcacgctacccgcgggtacggagaacatagtgaaacagtggactctgaagaaaatggcggaacagttccagagcttcaagggagatctctacaagaaatacatcctgaagggactaacaccgaacttcgacgtattcccaaagctaagggatcattgggatgagtttgttgcttacaagacagggcgacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccactaaatggccggatcgatcgaagttctggtactatgctcacggtggaacgcttaatctagttgatggctcccttgtctttagcgatcagatacacgaggccgccagtcgactaacggacgcagtggtagcctcttgtcagggcacattccgaccagacagagagaaggatgagctgttactcgccctacagactcccgagcatccaggacgaacacgagggaaatgtgtgattccctggaagattggatttaaggaggacatccacacgtacaggagtcggatgaggagcaagagagataccgaggcgaagattgcagatcttgagtacagggtatcgagctacgagctcagcatgcaagagaaggtggcaaggaaggtggatgaacgtatggccgcacatcggtcccaggatccccagccgtacattcatcctgcaatggtcagcccatcaggcaatcgtagcagctgcgtctcaacggggcaggtcggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccgcaagttgctgcttaggttgattactaatagataacctctcatcacgtgaaggtggcgtcaggaatggccatcccaacggacccttccgggacttaccactacaggccgattctagcaggatactcgagtgtcgaagttgagttggtggaagccgcgtacgaggacctcgagttggactacccaggaggagacggtgagacgcatctacgagacacaagccacgccatcatactatggcgcaagcagtacatcatccttcctgggcgacaagcggcgtctcgtgcaccatctcttccggttcctccgccacctcactgctgcaccatctcctccggctcctctagctcctccgcctccaccgtgttcgcctgcacctcccaagacaaggtctcgccaagctccactgcttgcccgcacaagggcaacaaagaaggcgaaagttgacgccaccaaagacaaggagccaccgtacgattgcagtcaagaggagcttgatgcttatgtggcaggagaggtgaagaggcaactcaagccttggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccgttggtgaccggcgaagattttggcataacggaattcatttcagacaccggtctaactgtggatcagttggttggaggagcaccaatcccgaaggcggaagtggcatacaagtttgaactcggtaaaccgcttgtcaaaactaaacagctgcagtccctaccgacacagatgtacaaattccatgaatggtacatggaaatgagtgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcaaagggcccgacggcggagggtctacgatactgggttcatcgaccctcggaaaatcaacaccgaaatgatcgacaagtacgagaaagacacagaggacaatctcgtccatctcctaacgcagcaacatttcaagacgtacatactactgccgtacaacacagagtgagtttttattgtcgttcgaacaaattttgttcccatacatatagcatgtacatttttgatcatatatatctcttctcacgcatattccagattccactgggtcctgttattcttcgacttggacgcatgcagagtcactgtgtacgactcaatgaataaagaggagaagatttttgataaggtcttcaaactgatagacaggtaatataatgccatctattccaaagtcgcggggaatctattgctattatgttgatctcaagtaataattaattaatcatagcttgcaactgcatatgtagggcttgggatcggttccgtcaattggtccgcgggacttggaaagaaaaacttggacggaggtttgattttccagtgagtacatgcatgatccaaaattatattggattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtgacatatatatatgcacataaaatgttaagtgctttaaattattcatatgtctgtgtaatattatgattatacatacacacacacacacacacacacacacacacacatatatatatatatatatatatatatatatatatatgcctatatattatgcatatatatgtattgtaacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacaacagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttatcatgggaatatgttatgcattgacatataatagggttctttgcaaaaagcagtactagacaatctggaaaagttatagcaagaatttataaaacatataaactttagatttctaaccagggtaccatatgagtcccagtactcaactccatgagtacggctattcgaatagtttcaaagatattctactgtagcagatgtacgctttacccgcagtccatgacttgctgataatcatcggctttagtcatggtccagtattaagtcattaacaattgtggcacctgttccatgaactcatatcctcatatgctctgaatgtaatgttaacagcagcaagaggagttctggcgttcccaaggtatttaaggggaactgatcgtatgacaccacgtcatctcgatcagggtttagaaatataccatatagtttatactcgagtatcacaaaccatttacctgtacatggtaatggttaaagtttcccttcgcggctatagttgcctcctgcacgaggacttaaaaataagaaccactatacagaggtgccatattgctaattaacataataactaggtctgtccctattctagaaactgcggtcgtactcgttcgttcaacataagtatctggtaaaacttatattgattgagacagtactagccacccggaaatcagccaaatcttacgtactgtcccaatctaagtatagggtattttaaccagattgtaagcaaaataagcaatactaaattatctgggtttctatgattgatttatgcatagaaaatagaatattgaatagaaggctataagtaaataatttataaaatataggcttgaatgatcaaaaggtatatggtaacttgccttgctcgatgtcctgagattgatggatattatctattgagtcagaagaatcctcaagacctagggttagacatatgtaaaattcaaatttaaaaggaattcaaatgaaatccaaaaatatgaaaaatagagaaaataaaataaaatgcaaaaatagcaaaaaggggctcaaaagatagagaatgattttagaagaatattggtccaagtttcattggaattggatctatattttaaaagatatgagcttctaaagtttaaaaatcaaataaaagtgaaatggcactgtgtgcgggtcccacctgtcagtctctctctctctctctcttctcttcttctaccttcggccgtttccccaaatgcagccggcggtgctagggtttgggattacggcggcgatggagggggaaagtggttgcggccgaagaggggagggagctaggtatctccggcgacggcgatcggcggcggaggagctaatttggtatgtggatgggttggcgactagggcggcggtggtacggttaggctgtaatggtgatcaaggtgatatgagttagacatggctaggggagggggttctagagcatctacgaggtgtctagagggattccggcagcttgccgacctttggcaaggtgcggagaatagttgccgacgagcgcctccataggcggcggccgtgctcacatcggcagcttagaggggagcatggtagtgcaaagggattgctaaaatggaatctaggtagtatgtagatggttgaaacggaaaaactcaccgagatcggttgaaacgacggattgcggccagaaaaacttcgcggcggtgaagaacagagcagcgcgggggcggcggtgctcgggttggtgcggcgaggtaaaactcgacgcagagcttcggttagggcttactatgctagaacatggttgatataaggtgttctaagggatatttagggcggaggatggatggagaggggtggagtcgatcgcgcacaaggtgttcgaccgacgagggatggtggttgatgggg

SEQ ID NO: 22692 - DNA, 6019 bp, Oryza sativa
ccggttggtgtgaaactatacctttgttatggccactttgtattgattactctgtcctttgataccttgggttacaatttgactagttgagctttatatattggttcagctagatatattagatataattgcttagccatgcttagaaacattagcacactattgggataactaatgtttcactactacttaatgatggacatgataatggtagctcacgatggctaatcatgattggttaattaattaatttgccaactaaaacttgataaatgtgggttgtgagcacatggttttgctggtcgtgctcatgacaattaaggactggttcacgagtttcggttgtgaaacattaaccgtgcaaaccacaagccagtatgggcaacaactttatcttttgtatagcatggttcattgcggggcaccagactgagaagtggcggagataagcccacgggggtcgctggggagtccatgccttgtgtttataagggggtgattatgatccaggaacggtgcactgctttgagttgtgttgtgcgaagggtactgtcacgatttccccctttgcagtggcgtggtggtacttcagggcatggtaacatgtgtggaatcgtgtcttgtgggtacagtggtacacctctggccagagtaaaactattcgaatagccgtgcccgcggttataggcaggtctaacaatgtctttcgtgattagtctcacacttttcatcataataaatgatgctataactggtaataatttgattagctcctggttttgaatggtttattcctggtttggagatagatctgtacagccgggtatggttgttcaggatggttgggcctgtgcagcatgggtgtgctgttcagtgttgattaatattgatgattaattactctactgttttacaattcttaaatgtttgctaaatgctgcttttgcaaatgagccctatattatgtcatcctttggtatccttgtgcacttgcatatttgctgtgtggcttgcggagtattccatgtactcaccttgtaataatcaatcaaacctcagttgaagaaaagttacgaaggagaagatgtttggcttataccctagttgagctgcctgtgggagtggagccggagcttcgctagattttattttccgctgcagttttcttcgtggtgaggactaagtgcctcttatgtaagtatttatcgttttagttaacttgatgaatctgtatattaaattgtcagtttgtgtacctcggctgatttctggatgaggatttaatgcacaaataagtttggaaattactagtgaatttctgggcgtgacatgccgctcccgctggagtgatagcgttatttggccacgccggcgtcgttggcttgacagtgttatctggccatgccgctctcgctggcgtggtaggataaaattgtcatgcccgctgcacgcggcgtgacagagttatttggccacgtgcgggccaaaaggtccagatttaaaaatattttttagaatggtctattaataaaattaaaacataaaaatatctaaaaaaatataaaaaatttcgcagggaaaaccctagacatgaactccaaagaaaaaccaacctgctccccctgtcaaccgtgatcgaccaattaaaatgttcgtaggccttcaggtcaggctcgcaggaattatttcctttattttcttggcccaacggagttaccatttaggaatatttttgcactttgatttttttttgtccaaatgtggccaataagaaatttagccaaaaaattaaattcttccgtaacgttatgttgtgacacttaaattttaattttagtatttatttgttgtttatattaatattagtttcatccgttgcaacgcacatacatgttgctagtaatttaaaatcctattaccattttaatatattttaaaaataaaatatgaaaaaaatgctattatgtgagaaaaattataacgatgagtcaccatactagtttcaaaataagttaaagaaaaaagctatttagtcggccctcgcatataaggccctgtttctttcagcttgggattattataatccagattattgggagtaagctgaaagaaacagacaacttattgaagtagcttattataatctggagcccagcttattataatatgataaactcatttaggtgagctttttctagattattgggtgaaaaattacccaccatgtcaccccactccctctttagacttgcaaacccaaataatctaggaaagaaacaactaaccgggtattctactacagattataacaatctagcttatagtaatctaactcaataatctagattataataatcttaagcggaaagaaacagggtctaagtcagattctctctcatggagcgcgtgggaagagtcgatttttccttttcttttttcagttttctttcggttttgtttcagttatttcagtttttaaatatataagtatctttcggtttattttatctatacacacatctctactattataaaaattgaagatgtttttaccggtactttagtacatcatccgtgtatgagtccgtttttaagttcgcttttggaaataagttcgctttttttaatatatatatatatatatatatatatatatatatatatccaggcgaatttctacaataaatttcacagcaattaaactgtatgacaataacaagattaaaataatcttcacctgttgcaacgcactagtatcttttctagtaaaatacttcctttgtttcataatacaagtcattctagcatttcacatattcatattgatgttaatgaatctaaacatattaatatgaagtgggaaatgctagaatgacttacattgtgaaacggaggaagtataaagtttgtatgtgtacgtgtatatacgtatcaatatacttatagagagagagggaaaagactagagggggaaactgatcgagctggtgcgcgaccgcccgcgcatcaaccatccccatctcccttccgctcgcatttgttcattcgcactcttgtcatcgaaatatcaagagccggacgaacatgcaggaactggagtactggacgcaccatcacccctcgaagcaatccaacatggcgcctccgctcgcacgtctcccgcccggagacctgccgtgcgatcccgattcctcccaaaatccctcctccggagccaatgccatgagccaaacacaacaacacccgggcctgcgacgcatccgatccgatcgaaatggatgcggccgaaaaaacccaaaagcagtagcagccgcagcagcagataatcaaagctgatcgaggtatgcgcccagaaaagcacagaacaaattcggttttaatttttctctccaattctccttccaaatcctgctgcgagaaagctaatttaatccgacatgttttttgtttttctctccgcaagctatgaatcatcgtcgtcgtcatcagcatcagcatcagcaggccagcagcagccgtagcaaatgtgaggaattggggaaaatcacgtttccgtgcatcgttcgatctccagtgcctcgagcggttcgtccctcccggccaatcgattttttttttttttgccgttacgattttgccttttttgcttcgcttctggggattaatcggcgttttccccttcatttttggctctattaaatgatccgagaccgagaggaaacctagggttccgttgcattctcgcccccatatcccagctccaccctttccttctacctccgccgccgccaccaccaaatggatcgagcgcttccaccggcgtcctagcggctcaggagtcccgattccgagttgtggcagtcggttttggtctcctgttagcttagatccgctcgatccgattttctctgctcgatcccattttcgctgctcgatccgatctggggtattcgtttgatttgctcggttccttttgtgttccttgttggtttcgggtggagaactattgtggaggtctgatcgatctgctgttgctatgggtgcaaacccttgcaggttttcaaccatgcctcatttccctagcggctcaagggtgaagtgcacggtgcttgcagtgctgtgtgggaaggtaggcaagcagcgggcgccaccttgtccggtgcctgggtcccagcagcagcggccatcgtacccattcccggagttgatctcgtccgggaggttggaggtaagtatccttttgctgtttatttttgttaaggagcaagtttaattgtaggctataatccatctagtataaacctatgtggaggagagataacctggagaataaaaagtgttaagctcttgtgtataaaaagttagctatacacatgctctaagatcaggggcggatccagtgtatggttactgatgacaccaattatttttgctaattatattattaaatatgcttggaactaataaattactcttagaattggcatttgcaccatggtatgtgaagagtgacctcaatgatatttttgatagctccacccctgtctacgataaatgcattaattatataaatgagaaaaagagagagaagaaaattagagacaaccttataactaatctgttacacatgtgagccctaatgctactttttgattagcttatatctagtagttagatctactattaaacttgctcttaagtacatatattttgtttgtcagttctgaacttggaaagctgggcatgcaggtgcacacgctgattaaccctacagttgatgaatttctggaggcacaacgtgctttgcaaccccgcttcatgtacctccggggtcagcagcttgacaacgaagaagaaattggtacacttgtctggcgcgatgctgatgtatctgatccacagatacttagttcactcattcgtccgccttttcctaccattgtatgcactaaactctgctgattttctatgtactatacattttatcatgtctaacttaaactagcaaatgttagacaatacaatagccctagagtgtctgcagggctggcgcctaggaaattagcaagcatattacataaaaattagacagtacaacactaaattagatcgcacaagagcacctaaggatggctagccgtctagtacacaatgtaatgcctaatcccaggcggctaataggcgcctagcaccgatttttagagcactgatgtttggctgcttggtgcttcagctcccaatagcacctggactatgcttcttttagcgctgcagtctatatagccaatatgcttctttacatgtttggtttactgatccattttagttattagtgtttgctgatgaagtttgccaatttgtataatttgggtgctagagtgcttgctaatgtagttatcactgctcttagcatacggtattgatcttttaattgagtgatcgataatacgattaattcatgcatgcatgcagctgggattagagccaggcaacaattgcatcaatactcttatggagccataaatatgggcatttaggctatctcattgggtttcttggtttaatgcgagaaaaatacacggccgatatagttatgcagagggaatagttcataaatgcatgcatccaggctccctttgttattgaggttgattgtgttttaagggccaatttagagattaactaattggccctttaaaattacatattttggtttttgttttttttaactcttgtaaccttgtttatatattccagatatatttgtctgacttgtagctactaacaattaaatttctttttaaccttcctctctgcctattttcctgtttagtttagtgaaagttttttttttccaatttttccttattcttcttccttgtagctactcatattaccttttaagctataatacaggtttatttggaagttccaagtggagaaaagattgctcaatctcttcaatcgacggtagtctgcttttatgatattttcaattacttgtttcttatttacgttt

SEQ ID NO: 22693 - DNA, 2836 bp, Oryza sativa
  unsure (1)..(2836): unsure at all n locations
tgcctatatttttcttctaaaatatggcatttttcttattccaaatcaatgattgtacttccatctcttttacaggattcatctctattgaactcactagaggatggtttgaatgctcttctcaatattgaagtatgtgtcaaatcctcttctagttaccatgtgttgctgccttttattttctatgtctaattaattagtgctgagttctaaatagagtattaccccaaagacctattttgtagaagtgctaggttattggagtaatgaagtacatgatgctaacttacaaatcagaaatactgctgcatcataagtaacatgctagtggccaccggccagtattgctaagcaccttatacaagctggtgggccggggctaggttctaaagtccatacttgtatggtgatggaatgaagctcgatgtagtttagttggagtctcactttctgagttgtaaatattcattttagactatgcagcatacccacatcgaaaaacttagtagtggtggtggtgactggtgggtgtgccttcccaccacctcctattttgtttggtaggatcttctgatttgtggatttattttttgattgatgtaggattgcaaatgtatttgttttttcatgaaatatatacaaattttaaaattggaacttgtatatttgttgatttttgcaatacaatggtattttgctagtaccattgtatgtaaattttatgtaccatgaatttaggaacaagataatatggcacatacttttcatattctctgtccatttttttctattaaattggacaagaaaaattatgcaagtagtaaaattgttggtagggccttgttaatgtttgattttcttctctccttttttcagtttcgatggtgcaaactccaggatagagtcaggtatcttccgctgctatataatacatattcaatatctcacaacctgttgtatcttaaatactattgctcatgtgtgtgttatgtttgtgcctgtgtccttgcttcagtaatcatatcataattttctatgccacagaaatatttaaagctcaaactgatgttgtctcagtgagctaacttgtattttgctgctagtataatttaaaggttaactgaggtaacatttcctatagactaaagacaaaacttaatggtaacataaattataaatgcttttattggtgtgtcttgtaaaatgtaaactaaagtgccgtagagtatttaacctgtatccttttgtaatcatattttaacttttataaagttatgcttcttattcttatttgcagttatgcatggttgcttgcacgattactataaaatttttagcttgtttctgctcacaacatttctctttgcagcgctgctcctcctcttcatgttgattcaactctgttggacgggatggttacaatatgttgtgatatcacaacatctagttcttcccatgtgtcactgcttctttctggcagtccacagacctgttttgatgataaggtattgtttttgtaattatggagcattttttagtcttcagtttgatatttgcaatgtcatatgttgtttcatggcattatgtagcttttggagaagcatattaaaaaagaacttattgagagccgccagttagttcgtgttgtctcggttagcgaggatgggccatcttcagctgagccgttgacttcaatgtccgtggcttctggagcttccacttttgaagtcttgatgaccttacctaagtgggcagcacaggttaatttttttctgaaaagtttgaatgatattgactagacagcttggtaatatgtgtgatatactgacagtttatccactactaaactaaaacataaggtgttttatacccttcttcatcactgactgaaaaatcgtttgaactgtgtaggttttgaaatatcttgctcaagaaacatcttacaaaagcctggttccacttggaattgcttctgtaaatggtactccagtttgttcgttcgatagtcaagatgtggattggcttcttttctttcgcacaatccaagatgaagctattggaactagtctatatccccatccgccaagatggtctgcatcccttgcgaagaacagagttaagggaagtatggtgtcaaaaccaggtaattcttagtgcaaaccgagttggagtggactagaaacatcttatggaaggggattaacctattattttcatatccttttcagctaggtgaaggatacaaaggcagtggcaatttgtagttgcgcaaaggtggtttctatgccagatgttgagagaatgtgcagctcacttgcacatcaacaatataccatagcaagggcaaggctctatgttgagtgaatccaaacttatactcctttgacgaacttgtcttggttttgctgtggatctcattatctggttgttggtttattaaccgcgaccaaatttgaatcttgaaagttgaatttagagatgtttttttttccattgtagtgtaagcctaggcttttaaatcgctttacatattccctttttttaatggctgcttcattcggttgatctctacatcttgtcaacggtagtctaacatattagagtcgaaatattgagcactcctgtgacctatcaatgataactactctgcctagtactacgatggcatcatcagatcgttgaaaatttcttattagttatgtccagtaggattatttaaaatgaaagtttccataaattctacgagaaattcatgtgttccaaacatagattagatcgannnnnnnnnnnnnnnnnnnnnnnnnnnnnnnnnnnnnnnnnnnnnnnnnnnnnnnnn

SEQ ID NO: 22694 - DNA, 2443 bp, Oryza sativa
  unsure (1)..(2443): unsure at all n locations
nnnnnnnnnnnnnnnnnnnnnnnnnnnnnnnnnnnnnnnnnnnnnnnnnnnnnnnnnctacaatgggttgcttgtcaattccttctcaaactcaacttctacctccaccccctgtagttctagaacccttatagaacttatctctcttttcttcttcttatgttctccaccaaacaaagagctgtattcaatatgggttgctaacaggcccgtcattgattgcactgtcaatgtcaattactcttcagattggaaattactgagttgattatgaagtgaaatttgcggcatttgcttgaaatttgaggttattttgttgagggtgagcttctttgcttctcaaggatctgatgttgcacaagtgacaagacaatgttcttgggttgtacaagtagactgctaatgacgtcatgcgcatacttctgccggattcagagaccaccgccttcagaacataagagcatcctcagccgctcatctatatttggtcctccaaatgtccatatggagtatcatccaaaaaagatatcccttccaactccaacagatcattcatattacatcatccatatctcatcatcctatattttaggaatatctttccaactaactttacatttgtattttaagggtatatttccaactaacttaattttaacggtgttatttatcgcgaaaatattttgaaacgagtaaattttaacggatatatttttaatggatagttttttaattgatatatttgaattgagggaaacatttttttatatattcgtaccatcatccataaaatgaaatgaacataaaaacacagcaaaaaatattcctatttcctatttccttttaccctattcctatttcctatttcctcttctctactactactactactcttttcctttcactctattcctatttcctatttcctatttcctcttctttactaggggtgaaaacggtacggaatttttccggattccggacctattttcggaaacggaatcagccggtcggaaattttttggaatttctcggaaacggaatcgaatatgataatcgcagtttccgtcagaactcggaatcggtcggaaacattccggaaaatttctcggaatttctgaagttaaaaaggcccatccaatcaatagtccataatccctccccaagtccccagcaggcccaacccaagctgctaaccctagagaagagagtgcagagagagaagtcagacagatcgggagggaggccgggagcggcgcatcgccatccagaggcgccggcggcggagcggcgcatctagagtgcgccaccaaccaccgctggcctgtcgtcctcgcttccttggctcctcgcgacctcgcccccgccgtcttgcatctcgcgccgcccttcctcttcgctccgtcctcgcccccaccaacggcgacggcaggaggcgacgacaacgcgcgaggcaacggcggcaggcggcggccgcacggctccttctagatttggtactctccctctccatgcctacaccctcctctccacactccacggcgagcagcgcaggcggtcgacaggctggtaagaggcggcggcagcttgcggcttgcgacgacttggcatcagcaacttgcggccagcaacggcgacgacggaggcgaggtcgcgacggaagtccgaatgtgggcaggagatgtgggcattgagatatggcgtgaggagagagaatcgctatatttggccgaaatctgctcgctttggcgcatcgtccatatttggcggactggatgccgtatctgctggaggtccattttcatctcgcgtacaccatatatcggatggaggaccggatgaaggatctcctggggatgctctaaggtagtaaagagtaaatttatcagaactccagggctgtgttcgttttaggaggatggaaactaatccctcccgcaaggaaaatggagcggtccattagcgtgtgattaattaagtattagctattttttttaaaaaaatgaatcaatatggtttatttaagcaactttcgtatagaaactttttgtaaaaatgcaccgtttagcagtttgaaaagcgtgcacgtggaaaacgaaagggggagttgggaaccacttgaaacgcctgggtgcataaaacaaagtatcttgaactccgtacaaacctcatatacacaaaattgtgtgtgcgtagcaacatctgaaaatctcatggcacacaacctcgggtgaatgtagcacttttgaacgtgaaattgaattcacttgaacagaatagctacaatgcaaagcttgactcctgatatttggatatgtgcacgctgcaaaaaataccggaaattttgctactgacagaacaacagagaacccggggaaagactcgtactagaaaacttatccaaatatattgtatgcctaaaattcgaataacatatttaaca

SEQ ID NO: 22695 - DNA, 3232 bp, Oryza sativa
atcattttgatctggctccgtcggaggagatgcaatctcggccgagtggttttaagccgactcggttaagatggtcttaaagtagctttcagccgcgttcgggaatccaaacgggaccgaaatccggttctctcccgactggtttgattccgagtcgaggagagaaatcttgccaaagttgttggtgatgaagtcgaggctgccgaaccgaaacgtctgcccgggtgggaagacgaggtcgtcgatgccggagacggaacccattgcactgatcggcgaaaagcttgacgcaacccctacctggcgcgccaactgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccaagtgcttcaagcttttcatgccaaggcctgccgagtggactgtaaagggcgaaaagataaaaaacatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacacttgacaggcatccgaatataaaaactctaaagattacccatcaagcattataaagattatggtaataaataagtcgaatagcctaggcaatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgccagcgaactagggttcacaactccggccaaatccacctccgaaaagtgcatcaaaatccttcccgtgatccaccacctcaattcctcacctctctcaagccatccctcgaatcaaatcagcacatttgagaaaaatcgatggcggaagagagagaaagctttgaaggccaatgggcggcgtccgatgcgacagaggagaatctgaaggagatggtggcgcatggtgttctcccagccaaagagatcatcgggtggcggccagcgtacggtgaggcatttccatctccagatacgcatgaaattgtagtcttctcgcatttcttctacggtggttttgctcttccgacctcaagatttttccgtgggatcttgaacttctatggaatcagcttacatcacctaaacccgaattccatcgtacatattgccaatttcgtccatgcttgtgaagcctttttggggatcaagcctcactttgccctattccgccggatctttttcctcaagccccaaccaaacaagaacaaaccgtgtgtagtcgggggggcaggattccaactgaggggaactctgagccaaaaatatttctccatgcccttcaagacttcgaacaaaggctggcacgcaaactggttctatgtccaaaatcctgagcctgctcttcccgggtactcttgtcttcctccagtataccaagatacctggaactcccttccaatcggagacgaagcagtccaagccttggaattgttggatcgcatgttaaagctcaaagagcaaggcttgcaaggagagcagattactcggcacttcatcaaatgccgactagcgccaatcaaggagagatctcgcacggcattcgagttcgacggcaggtatgatcctaaccgtgaagaatcagactctctggatttcagaatcatgaaggagaggatgtataaaatcttctcaaatgcaatcgtcgtcagctactcacaccagctgccagtcgtgccatataatgcgttcaatccgcctccacaggtatgtatcgaaaatcctcaaaccatgatcagaacataattttgtcttcatgctgagttgactaactatggaagcatctggttcaggaatatgcactgatgaagtcagatccaccagtcactcagcgccggtctcctcgccaacacactgctcagggaggtggagggccaacgatcagaccggatccgcaacctcagacctccaaatcaactggtcagacgggtcctcgcaagaggaaactggtgcttgatgatgatgaaggcgacgatgataaatctggggataagggctcgcctaacaaacccccaaagcgcaccatgcccaggaaaaaattggccggccgcgcaatgccaaaaattagaacatcttccaggtataagacctctcggtatgatttcactttggtaagctctctcatgaaaatgatgctaaattctgaaagaatactttgcaggaaaccatctgatatagatccatctggaaaagaccccgatcctgccatgacagagcagaatatatccaaggaccccgagctgactactgaaaaccagccgactgctgaaagccagccgactggcgcccat

SEQ ID NO: 22696 - DNA, 1026 bp, Oryza sativa
  unsure (1)..(1026): unsure at all n locations
nnnnnnnnnnnnnnnnnnnnnnnnnnnnnnnnnnnnnnnnnnnnnnnnnnnnnnnctttactccaatatttcccttgggatgtaggattgttagatgttactggggaaagttcctcattataattaacaaagtcacgatgccgctttgcgttttctaggtaactgcttcctctgtacacaaaatgtatgccccctcttgtccaaacaactaagcctcctgttttaatctaatgaaaagagaattaaaaaaataaatatcaaaggttttgaattgataataatgatttggacttaaataattcaaggtaaagagggtgtcgttaaaatagtttctctgtttaaccatagtttaactaagccaaacataattcatcagctaagccaacctaacaatttcagccaataaaaatcttgaatcaagcaccagcagtccaccaacgggtgtagcaccacctgcatcaattcaatcattttatctgccagaaaatgctggtcacatttgcaacttcctagcagaattgtggttcatgatgccaaaaatgaacccaccctagctacattgctctacatttttttttgaagaaagagagacaagatcgtccccctttccattttcgaaactaagttacttagctacattgctgtacatgaagctaaagatgaactccaaagtttcacaaagatgcaacaaatgcttttgcatcaccacaacaagaagctcatcgtccaggaaatcaagtagcagcagatagcaatgtgaagcaatcacctcaagaatctcccttgcccggtccatgcatcgccggagcggctccacgatcctcacgccggcgagctcctggcccttcgcccactgcccccgcaccttcttcaccacctcgtcggtgatcccggccttcttggcccgcgcccaccgttccttcccccgcgccgcccgccgaagccggtccagctcgccggccttcagctccgtctccgcgcgcgtcggcacccgcgtcttcttctcccgccgcagcaccaccttgg

SEQ ID NO: 22697 - DNA, 2499 bp, Oryza sativa
cgagaacatcaactgtatgctaagtttagcaagtgtgaattttggttgtctgaagtgaagttccttggtcacgtcatctcagcaggaggagttgccgttgacctaataatgtggaatccgtaaccaactggaaacaaccgaagacagtttcagagatccgcagtttcttaagcctcgcaggttattatcggaggtttatagagaatttttccaagattgctaagcccatgacacgactgcttcagaaagatgtgaagtacaagtggtcggaataatgtgagcagagttttcaagagttgaagaatcgcttgatatcagctcctatcttgattttacctgatccaaagaagggttttcaagagtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacagaggtgtataccgatcacaagagtttaaagtatatctttactcagccggatctgaacatgagacagaggagatggttggaattaattaaggattatgacatgggaattcattatcacccgggaaaggctaatgttgtagcagatgctcttagcaggaaaggctattgcaatgctacggaaggacgacaggtgccattggaattatgcaaggaatttgaaagattaaatttggggaattgtcagctagaggtttcgttgcagccttagaagcgaagcccactctaattgatcaagttagagaagcccaaattaatgatcctgatattcaagagatcaagaagaatatgagaagaggaaaagctatcggtttcatggaggatgagcaaggaactgtatggttgggcgagagaatctgtgtccccgacaacaaagatttaaaagatgcaattctgaaagaagctcatgatactttatattccattcaccctggtagtactaagatgtaccaggatctcaaggaaagattttggtgggcaagtatgaagcgtgaaatcgcagaatacgtagcagtatgtgatgtctgtcagcgagtcaaggcagaacatcaaaaacctgccggtttgttgcagcctttgaagattcctgaatggaaatgggaagaaatcggtatggattttatcactggtctacccagaacgtcatcaggccatgactctatttgggtgatagtcgacagacttaccaaagtggctcatttcatcccagtgaagacaacatattccggaagtcggttggcggaattgtatatggcaaggattgtgtgtttgcatggcgttcctaagaagatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaatttccgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggcccagtctcgacataagagttatgccgacaatcgccgcagagatttgagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtattttggaaatagatgagagaaggaccaggaatcgagttatccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtat

SEQ ID NO: 22698 - DNA, 661 bp, Oryza sativa
tacaagaaaagcccttcaggaattctgcaacgctgcgtatctctagaggaagggaggcaattgttgaaagacatacattctggaatatgcggaaaccatgccgccgcacgcaccattgtcggcaaagcttaccggcagggttttttctagcctactgcagtgtccaacgccgataaaattgtgcgcacgtgcgaaggttgccaatttttcgacagacaaatccatctaccagctcaagagttgcaaacaatcccactgtcttggccgtttgcggtttgggggctcgacatggttggctcgttcaaaagggcagtcggcggttacacgcatctctttgtggccattgacaaattctccaagtggattgaggctaaaccggttgtcacaattacagcagataaagctcgagatttcttcatcaacattgtgcataggtttggagtgcctaatcggattatcaccgataatggcacacaattcactggcggagtttttaaagacttttgcgaagacttcggaattaagatttgctatgcctcagtagcgcatcccatgagcaatggacaggtcgaacgagccaacggcatgatacttcaagggataaaagcgcgagtttttgaccggctaaaaccctatgctggaaaatgggtggaacagctgc

SEQ ID NO: 22699 - DNA, 1771 bp, Oryza sativa
aggtcgccgactagacaggcacgagatcgaacattgcgattatgataacgtcgcaaccctgcaagtacgaacctgactgaatcaaagctgcttcgcggacttcttccagtcggtgcaagtcgtccactcggtcttcttcatagcgttcttcacggaaattacgaaagcgcaaagattcgaactcgacttcactcggcaccattgcttttgccccgtagacaagaaaaaaaggtgactggcctgtggcccgactgggcgtagtacgcaaagaccaaagtactgatggtaactgtgacacccatttgccggcatagggtttaagcccggtcaaaaactcgagctttaatcccttgaagtatcatgccgttggccctctccacctgtccattgctcattgggtgcgctactgaggcataacaaatctttattccgaaatcttcacaaaagtctttgaaaactccgccggtgaattgtgtgccattatcagtgattatccgattgggcactccaaatctatgcacaatgttgatgaagaagtctcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagcgacatcatgggtgcccgtaatttgagtggcatctttgtgaggtaccgtcggcgtataaaggtgttcgacaaaaacatcagagggcgccgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaagaccactctttcataacttggttgacaaccagctgtgaatcacctcgaacgattagacgctttatccctagggaaattgcaatccgtagcccatgaaggagcgcctcatactcggcgacgttgtgggacgccgaaaaatgtatccaaagcacataacttaatctttctccagtcggggaaattaaaaccactccagctccagtgcctgaaagtctttttgacccgtcaaaatgcatggtccagtgctctattttctccacgggggtatcctcttggcactcggtccactcggcgacaaaatcggctaacgcttgagacttgattgaagtgcggggcttgaatgatatgtccaaagacatcaactccaaagcccacttagcaatccgcccatttgcttcgcggttgtgtagtacatcgccgagtgggaatgatgtgaccaccgttaccgagtgaccttgaa

SEQ ID NO: 22700 - DNA, 2395 bp, Oryza sativa
cggttaaccctagggcgtggcatgtgggctttgttgaactttggtctcttcaacttatcgatgttaaagtattattgaactttgtttatattattcgtcgaacatattatcatatcattaatcatcatataatggtattatgtggagtgtaatgatgtaagaataaagttataaagttatcttcatgtataattaaatatgtgattatgcctcactttgttgtttccaatatgaattttcttccaaccaacatcgctaggttctgtttcgacgtttccatttccaatatactgatatcgttatcgtttttttataccgtttcgattccgttttcggaaaaaaagaaatatagaaataaaaatggtagagggtttttccgaccattttcatcctaaacaccaacagcaccatctctctccaaattgtactagcatcgtgttattacttattccacgttattatggtaaaaaatttcacggcgcaaagcatctaggctagtccttaattcactacgtagactcgtggtaccgtttgtaaaaaaaaaaattgctccttggaaatcgagcgattttacaaaaaatgataaaaatcctagtatgtcccaaaaattgtttagagttttaccctgattccaaagtagcaaaaacttataaatttccttttgttatgaaggaggcccaagttgcttagatgactacgtacgtggtataattttcaataaaaaatcggtgcgtgttgtatacgtgagatcctttttgtttgactatggcaaatgtcaactaaggaggtcccacttgcaagacgttgatgttcccttaattattttgcaagtaaaaaaaaagattttgcaaagtaagcgtaattcaatcgattaggtttttttttagaccaatctacccaattgaagttatagacttgacatgggtgctcatatttatagtttttattattatttgatgggaatagcttattattttataatggtaaacgacatacccgtcgatagtgagtcgtccgtggtttcgtcaatctcaagatatatcggtcggtctttcgaaggtacttgtatgactagggtgtgagtgtttgcatttagggtaagagcgcatatgttgtgtacttgtgtttgtatatgtttgtaccatatttctcggaagaaaaaaaaaaggattttgccaaatgcagccgataaagtgttgagtacttctattttgcccatatatattgaaagatcagtagtgttccttcctttgcaagaagttggtgtaccattctggaaagagactaatctattgatctttcaacaaatttggaactctaaatcttgcagaatattgaactaatgtatagaacccattttgaatgaaaaaaaaggataaacacataaaaatcataaatctagagaaaaaatagttgtcaaaaacataattttgatgcactataactaatataagttttatgtaactaagtataaatgcaatgtaattgggtataactacaagttaaatctacatgtacacaaatctttgatgcaatgcaatattttacagatgaaaaatcaaaatatatactctctccgtccctaaatatttgatgccgttaactttttaaaacatgtttgattgttcgtcttatttaaaaaatttaagtaattattaattctttttctatcatttgatttattgttaaatataatactactactcaagcttttgaatattattcaaaaaagtttttaaaaaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccggagccgccgccccctcttcgcgccggcgggcttcttccgcctctctgccgccagtccccggccgatcccatcggcagtcggcgggcggtctccccgcgggtggggtgggggcgggacggacgatgaaaccggtggtggggatcgtggtgtcgaacaagatgcagaagtcggtggtggtggccgtcgaccggctctttcaccacaagatgtacaaccgctacgtcaagcgcaccttcaagttcatggcgcacgatgagaccgaggactgtaacatcggcgaacgggtcggtaaccgagcttcccttttcacttcccct

SEQ ID NO: 22701 - DNA, 4782 bp, Oryza sativa
attgaattgtcttttgactcgagtcatgctgtagttgctttaaagtgtcaaatctgttgttgcatcacttggagccaacaaaatatgtgttgcttgccctgccttgctctgattgcattatctgcctgagccatgtgtttttatgtatatgtttttctacttctaggaggttgctatcttgatagctgtgtctagttaacacagtaattgatgccttggtagcttaaattgctacttgtcatgttgctcgtcactcctcaaaagcaccatccagaatgctgctagttataacttgaatttttgaagcattgtacttttagattgggttgggggtttctcttcagtttcaactgtatatttaagctgctcaactaactgatcagtaggttacctgcatagctcaccattgcacctgtcatgcttatgtcttgaactatatttgcacaaaaataacacaattctcatgtttgcggcattggccagtttagcagcgggcctttcattatgcttgttgcatgaataaaatttagttgtactactatgtttgaagctggaatttgattgtgccatttagcaaaatttgattaaatgtcaacagaaactttttttcatttgttaaatatctagcctgcctttctctgttctctcaatgtgcatggctgctggaagtccagaaccaccatgtatgtacatggaagtgatgttgtctagccagccagtttgtttgaaccgggtcagagacctttttttttttaatttgtatgcttctgagcatccctgagtgaatcctttcaaaggaaagagaaaatcagtacatgaatactgactactgatctgttttaacaactactcctaattgctttggaactggagttggattctattgtatttcttgaccagattttgcctacatagaatagagttgtattatgtcaacgactcaaatgcctataatatccaataatcaatctacaccgttatactctggactcataacaatctaatggtgtaaatatttactttttccttcaattaatgtggtaatataatatatagagtgcacatgatgccttctttttgagctatttttataatctactccctccgtttcaggatgtaagatgttttcatttcgtcctaagtcaagcttctttaattgtgaccaaacatttaggaaaatgtggcaacatttataacaccaaattaatttcattatatccgccattgaacatatttttataatatatttgtttggtattggaaatgatgatacatttttctatgaacttggttaaacttgaaggagtttgacttgtaacaaaactagttgttacagtattgtggattgttatcctattctgtatagttccagctgttaaattgatgcctgtagggaggttgcaaccatatggttgacatcattacatgtcatggcacctaatccttaagagttgacatttctctgtctgcttgcatatctgctcgttaacaatgccatgatagtatttctgaaaacaacttcaattagtattagttttgtattttactactctcggcagtgaacaactgtttggattatatgctactgctttctatttatgatgttcatatatgagctactagggcactactgcatagtggtactctttgagttacagtttgtgttttttttccaccgtgataagttatcttaaatattgtgttcttgtaatttgattttggtgttagttatgtacattgtttcatatagttcagaaatttgagggttaatcataagcacataatagttcttgaccagagctttttgatatgtcaagtatttatagcctcaatctataacattagcaactgaaagttaaggcacaatctgaagtttaattcttggcgtaattgatacactaaacagtaagccaaccctttaatcaggagtgtcaactccagacaagagaggccccttttgggggctctgaacttcagtaagctagttacttcatcagatgcaaaacaatctttccatgagaattttgacaatgatggttgtactagattttaatagtggcataatcttttgcctctgaattttctcatatcttatgtgatatggcaacttggcaaagcatggacggaggtctgaaagataatttgttgcaaagcatagttataatgttaacatgccactttctaattagttttgctttatgcaaatgtgataacagtgttaacatattcacatcataagattttgcctattcaaattaatttgttttgtgcgcccgaagatccacattaccaagggactggatttaacagaaacttttatgttctgactattgattgcaccacctattgttaaaataaataaataaataaataaaaagacagcataaaagttcaactttaccctgtgagtttgtgacagggattttttttttagaaaaaaaaatatgttgggactaacatatttgctcttatgacgaatatattagtgatcttgagctgtcctactgcacttttctattttatcagcttgctggagactaatctcccccttttgtagttcacaaagtgcgacctaagagcgcattaattttttatctccaagaaaaacctttttgatgatgactggataatttctctccaggttaagcttgatccttctaggcccttgagcaaaaggaagcactgggttgttgccgagattcttcgtagagctaaggtgtattctccatcagctgctgcagcagcagtttctgctcaacctggtgccacagttcaacaggcagaagctgctagcaaatcataaacatagactcctcttctgcaataaatggacactttttcgggattttcttttatgttgtgtaactgtagtatcatctttgtggctcccttcaaatgcactcgtgtttttgaaccatgtgaatggtggttatcaactcactgagggtgcatcttcaaatacttcgaaattcatggatgcaacagaccatatccatatgtagaacggaatcttctattatgaattgtattcatccatataaatgtgtacatcgcaggcacgcatgaagcgcttattagtctttcatcatctacacatttatgcatacatgaataaggttatctaaaggtcattcgtcatcgcctactcacttatttatgcatacattagtgaggtgatctgaactcatggaacgagcgatgggcggtgggtgactaagttttgtaaaagggcggcgagggcgactagttttgtaaaattttcaaatagaaaattatttatgtaaatattttaataaataaaagagttaattttaccaccttttattaccgatgtttcgctttggaccaccttaggactaatgttttcactttggaccgggtatttttacctttatttcactttggaccacccttactcttttatcgatctacatccaatttttaatatgtcgaagaaatagtcttacatatagctgtggcagttcattgacgagtaggagatgatgtaatcgagatcgttcatatgcttgagaagagagtcgggtggtccaaagtgaaacaaaggcaggtttacccactccaaagtgaaaatattgcttaaagggtggtccaaagtgaaacatcagtaataaaaagtggcccgaagtgaaatttattcttaaaataaaaaaaatcaaaacgagcctgctcggttcaactcttttaaccttaaggaactaagtttggctctactcgcaagttagcctgttaaactcgtataaacgtaattatatcacccttatactttcaacttttaccattttattatagcaaatttgttatatgcacacaagttttcacgtgtatatatcgtgttcacataaaactctagaaaaaaatgcacatgtattttcaatactattacatcaacgtgtaaactttattattaaattcatcatatatacagagagaaattctaaatatttatattcttaaaaacatcagattttttaggctaaaatataatgagtttgagttacacataggtgtaaccctattagaaattatatgcgtaaacttttcgagaatcgtaagtgacatttagtagtttgtgtgcagggagtatacatgcgaagtttgtgttatatgtttccactaaacggagccttggtgtagcacgagtaggcctatgccattctttcacggaaaaagtccactttgactacattaaatatatatatatatatatatatatatatatatatatcgaatttgatttatatccctcaaccgtcaaacaaggtataatgactccctcagctattaaaacttgtacaaaattactcctaaggtaatagtgagagttgtattgctgacatgacgtccatgtgttgcattgacatgttataataaaaaaaaaaaacattaaaaccatgggactcataggtcaacaattgtatttttcttcctctttttccctcccactctcttgtggtcagggcgacgattggcgccttggcgggaccaagggcagtgcaccaatgcccggcagaagaggccggaagtggtggtgacctcgtaaacgagaaggaatgcagcggggccggttagccccttggagcaccaggaaggatgggtaggtagcggggaggctggagaggatgacgacagggaagggagtggtggcgccatgcgcgatgcctgacgaaagaggaaccggaggcagcaagcgaccttgtcgaggagtgatcctccctagcaggtggtcgtgagaccccccccccttgtgagttcggccggggg

SEQ ID NO: 22702 - DNA, 7021 bp, Oryza sativa
  unsure (1)..(7021): unsure at all n locations
nnnnnnnnnnnnnnnnnnnnnnnnnnnnnnnnnnnnnnnnnnnnnnnnnnnnnnnatcttccattccccaaaaaacctcgcaaaaccctcggccctcacccgccgccgccgccgtcgcctccaccggtaaacggcagcatgaggtgagcgattgctcccctcctcctcctcctcctctcccatcatcacttcggctcccgattcggcggagaaacccatactccgcgccgcccgcacgcgccgtccagcgccgggagcggttagatctggagggggcagccgctgtgcacgcggggggaagatccccggcagcgcgagagggcccgtggggtcccttccgcgggcgtgggcttgacgctagggttcgtcgtgttttgatttctgtgggatctgtttgttgctagggttggggggttgggggttggccgtaggaagtttagatggtttttggtggtgcgcctcagttcacggccatgtccccgcgcacgtgcgcgggttgcccccagctatcggtgtgttggtagatctctctgctttggtttcccactgtgtcgggttggttaattatgcttgtgcggcagctactgtttaggtgtagctcgtgtggtttattgagctagccagggttttatttggttaattggaggtgatcatctgctcgtatagtcctatagttaacgaggataacttcgcactgacgaccaggagtttaataataaagtaataataagctcaagtttaatagtgggctataagccaagtagccaaatgtaagcttatgtggaagagagagtttgaaaaatgaagagggttgggtctcagtctcatgtaagagctaaccattcacatactttaagatggataagttaattgtatagatgagatagagaggagaagaaaaatatagataagcttatagcttatctactatgcatgtcaactctaatatgtgctataagttcatagttggctttattattaaacttgctctaagttggttcatgccatggtgcgtgcagcttctgataactgttaggaggcaattagtttatctcttattcctagatatctcttattagtagatatttctgtgcctttgtagttttgtctatcgattgtgatatttttaagagattgaaatctggtttgtaatacatttttgcattagtgctttctcattgtaagtgttagttcatgttcagttgtaggtaactctgatactgatgccaatggcaattgtgtctcggtattctctaaggattctttgttggttttgctttatgataggattaccagacaccaccattttatattcattaagaaaactttcatttttatcagtattttgtataatactccctgtgtttcacattataagtcgttttgacttcttttccagtcaattttttttaaagttcgtccaagtttatagaaaaatatggcaatatttccaacacaagacaaacatattaccaaaatatattcagcattacattttagtgaaactaatttggtgctgtagatgttgctaaatttttctataaatttggtcatacctaaagaaatttgactagaaaaaaagtcaaatatgatacggagggagtacttgtcacttgttcatatagcatggatattactggcacacagtaaacttgtggatttttgtaggctgctgatgtatttgtattggagtttaacctcaaagggatctaaccctcattcttttgcttcttgtaaggtgctcagaattgaattttttttatggttttctttttgtttcctgtagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggtaatacatgctcgtgcaatagctatatgactgcagtttcctctatattaaaatgcgtggttccttatcccgtgtttatttgttttgattctacaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtaagctatgcacttcttttgcggtgataaactgtggacttgttttctcatgtttgacgcaactagtagcagcataatgagaacaagtgagatgaagcaagtgcgcctaacatgttagaatggagtatcatttgatcatagcacataatgacatgtttgaatttgaagaatgttccatatatgtttctctttaaggcattccatttgtttttcaactggtcatggtaaaaaaaaatcatgcgcaggacaaactgttattactcgttatgttggatataaacctacattgtctcactcgtttagattccacattcaagccccaaaactaatatcagtttagggacctaatctgctcttataatatattattttttaacttaattatatagatattccaggaaatttaatctggccttattaatgtaaataagcccttgttccttatccaacgttttgatatgcatatattttattttttaggtgctgatgtcaacgtggatggaatggacttttcggtaattagttcttttcagatttcatgtttattcctagatttcctttttgctcatgcatatattgttttttaaactaatgtttttctttatgtctttttttatagaattttggtggcatgggtggaatgggtggaatgggcggaatgggtgatatgatgggtggcatgggtggtatgggtggcatgggtggcatggctaaaaagatgggtggcatgggtggtatggccggtatgggtggcatgggtggcatggatgagttcgaggacgagagtgacgatgaaggtttgtcttcctttattgtgtccacagattctcattaatatccacttgtttctattagctatatgatagcataatatgattctgtgaaaatataaattaaggaagcattatttttgcagtttggtaagattagtatggtttagtttgaactgcctgaccagatgagtgatatgactcatgcacgtgacaaatgccattaattgaaaggccaattcttgaaaaatctgcaattgtgtgattcgtactcttaacagcagtgatcaaaatattgcacctttcatgcttggcacatataaatgcaactcaataggataaagctatttttttcatcatacaggactgtttcttgatattgtgattgtagaagtaaaagtgctatttaatggttctcctgcacattttggaatagtttggcccgaattatgttgttcatgctgtaactattatggtggtaattagtctgatatgtttcttacttgcattgattttgtgataggtatgatactaaccttaatcacatgcatcaaaagtttcttaaccattatacttacatactggttaggaaactttttgatgcatgtaaagttagtgtcactaggtgcagattaaggttagtgtcgcgtgtactcgtattcatcatattgtacttacgtctagagaactgaagcacattcccaagaaattgcaaatcagtttgtattcatcatattgtacataaatctagagatttgaagtacctccaagaaattgcagacttgaagtacatctaggcatcaattataagcaatttaaacaactatgttatgtcaattaagttgatataagagtgccagttatctttgtttttttatatatcttagtaccttttaattgtaatcttgcttgttaaaagtcctcatgccatcttttttgactttgttgctcccttgtttagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttcacaactctgttctgcgctaattggttgaccgtgagaccttttggccagcgtagaacgactactacctgtttgcatgtggtcttacggtcaacgtgcatggcaggatgtaagtaaggtccctgactcctgctgttaacagagtaacaggaacagggcttttccggaaaagcccgcattcatcagattgaggcgaacgtgaacaaacgtttttaattgaattcagattaaccaacttgttaatgcttgttcaattcaaacgtaatgctaaaaaggggcctaacacaacatttaggagtgttgataagagtgtcaccctattagtactgatttattccctctgtttcgattaaaaataatcgacgtattgtagaaaaccaaaaattatcatcgtcgtacttcaaaggcagcacccgacacatctcgcatatgcgcttcgttttcttatcctcgccgcttcgtatgccaaaaacctcgaattttgttgagaattaatattatttttatggaaaatcgcaaaagtagtggccaaccggggaaaatcgcgaaagtaggtccctgtcgaacgggtgcaattcgatagggcacctatcgaacgacgggcagtcgacaaaggcatgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcattcgacaagccggtttaaagccccgtccacccaggccgcgagttcgatttgttttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaatagatacaaaggtgttatattttatttggattattaaactagttgtttgttactaatagttgtaaattagtacacggcaatatagtataagttataatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaataccgtgtggccagtgaggggtcaacatgaatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggtggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtaggttcgagggttgagcaacatacgtgtttattggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaactcatgaggattcttatcacaatcttcccccactattggaggtgatgcaggcaagaaacccgggcacacacatggctattctcgatgaggtgaatgaa

SEQ ID NO: 22703 - DNA, 783 bp, Oryza sativa
  unsure (1)..(783): unsure at all n locations
nnnnnnnnnnnnnnnnnnnnnnnnnnnnnnnnnnnnnnnnnnnnnnnnnnnnnnnnnnnnncatcgttctacaagggagcacccatccctaccgtcataacgtaaaatgttttcttcagttcaccagatccataaaagacgggatgcaacagagaaaggaattatgtagaggggccttcgattgctctaacttgtctcggctttagcgtccgactcctgggattttccggcttcagcagccttctctgcgtcttgaggtttagacacttcttctaaacaagggagcaacaaagtcaaaaaagatggcatgaggacttttaacaagcaagattacaattaaaaggtactaagatatataaaaaaacaaagataactggcactcttatatcaacttaattgacataacatagttgtttaaattgcttataattgatgcctagatgtacttcaagtctgcaatttcttggaggtacttcaaatctctagatttatgtacaatatgatgaatacaaactgatttgcaatttcttgggaatgtgcttcagttctctagacgtaagtacaatatgatgaatacgagtacacgcgacactaaccttaatctgcacctagtgacactaactttacatgcatcaaaaagtttcctaccagtatgtaagtataatggttaagaaacttttgatgcatgtgattaaggttagtatcatacctatcgcaaaatcaatgcaagtaagaaacatatcagactaattaccaccattataagtacagcatgaacaacat

SEQ ID NO: 22704 - DNA, 588 bp, Oryza sativa
  unsure (1)..(588): unsure at all n locations
actatagggcgaattcgagctcggtaccccccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatctgctaaagccaccggtaaatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggnnnnnnnnnnnnnnnnnnnnnnnnnnnnnnnnnnnnnnnnnnnnnnnnnnnnnnnnn

SEQ ID NO: 22705 - DNA, 743 bp, Oryza sativa
aaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccgcagccgccgcccccctctccgcgccggcggcctcctccgccctctctgccgccagtccccggccgatcccatcgccagtcggcgggcggtctccccgcgggtggggtgggggcgggacggacgatgaagccggtggtggggatcgtggtgtcgaacaagatgcagaagtcggtggtggtggccgtcgaccgcctcttccaccacaagatgtacaaccgctacgtcaagcgcacctccaagttcatggcgcacgatgagaccgaggactgtaacatcggcgaccgggtcggtaaccgagctcccctctccactccccctctctctgtttcagcttttttctttttttttaatccatgctgatttgtgatgcgagcatttgatttctctggtgtgatgtcgttcatt
